United States Patent 9,238,822 (COMPOSITIONS AND METHODS FOR CONTROL OF INSECT INFESTATIONS IN PLANTS) - sequence listing, part 3

SEQ ID NO: 5776 - DNA, 425 bp, Diabrotica virgifera
  misc_feature (3)..(26): n is a, c, g, or t
  misc_feature (49)..(69): n is a, c, g, or t
aannnnnnnnnnnnnnnnnnnnnnnntagattcctagttgtgttatcgnnnnnnnnnnnnnnnnnnnnngttttcatgttgaattaaacataattattaagtaatatctttgccgaaaatgcctcttcctgcatcatacactccaaactacttctcaatggaagatatattagctactcaagaaagaacaccatgtaaaattgttcagactattccaaatatgggtcatttaaattcatctgctgctgaaaaagatctccaaccagggacctcccatgagtttcctttgtggttagtaagtgaaatttcatttagtcgtcaaccgctagtacagcctgatttacccaaaatatacaaagaagcatatagagaaattttaaaagctgatgcctgtgcagtagaccttcacaaattcaatctgtatt

SEQ ID NO: 5777 - DNA, 144 bp, Diabrotica virgifera
  misc_feature (12)..(97): n is a, c, g, or t
  misc_feature (99)..(112): n is a, c, g, or t
agcgaattcgcnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnncaatgaaaaaaaatgcctcatcgggcaggccg

SEQ ID NO: 5778 - DNA, 276 bp, Diabrotica virgifera
  misc_feature (21)..(21): n is a, c, g, or t
tgagtcgtattaaacttgggntcttctctgccgggctcgtatgggtggttctgccgctggtatcagggtccagctgtgccctgatcaggaagtacccgtggacctagtgcacaggcgtggtcatgttgtgcagcagctagcagagctgcatgaagatgttaagcctagccttcggattatggagtctgaagaagttatgaataatatggaagccatgagagattcgcatgcacttattacatatttgtcactgtgagtcgggtttgaccttgaatt

SEQ ID NO: 5779 - DNA, 314 bp, Diabrotica virgifera
cgtcctgttaacgcgtccgaccaagcgtctggctgaagttatgaggtacttttattcactgatagtaggttactacagggagagaatattgaacttattcagaaaatagatcgagtgtctggaccgagtgcatcagggatgacgagtaaatagtggcggagccaggagttacgtattgggggtgcatacagaacgttaacatctattgtgacctggagaccctatatccgtatgttgtattgataggtgtgtccgcattttgttatatcgaagtgaccatatcacatattacatttacttatgtacaatattga

SEQ ID NO: 5780 - DNA, 389 bp, Diabrotica virgifera
tgggtcgatacaagactctagaatgagtcgtaataaacacggcaaatagtaacgtgcgttttaatttacaggaagcagttataaaggccgaccgtatagaagatgcatgtattagtaatcgcaactattttacttgcaattgaagcaaattcaataccagtgacaaaatcagacgatgaggcatttaaatttccaatcacgtttgagaatggtagaataggcgtaaacttcctaggatttcacgcttcagctggtttaggaggtttattaacaggtaatagtgcagatggtggcttacatgcggaagctggaactccgtttgggcaaagagcttgggctggattaggaggagatataaatggcgcaagtagatcagggggaggtctata

SEQ ID NO: 5781 - DNA, 390 bp, Diabrotica virgifera
  misc_feature (33)..(57): n is a, c, g, or t
acccacgcgtccggtaaatattaagcgataacnnnnnnnnnnnnnnnnnnnnnnnnnccagtaaaagttgaattagtaaccgctaggagcgacaccagcgaagctcagagcgtatagacaaaccaacactgtgtcatatgtcaacgatgactgttgacatagaacttaacttctctattccaaagaaaaacaccagaatctttatttttccaaaagtatacaatagcattaaaacagaatcgtataggtcaaaaaaatgttccagatttatattgacaatggataaatactgataaaatttgcagatgtttcttcattctttggcacaaacgtgtagttaatacttttttgccactttccacttgatttttgtaaagagattttaccaag

SEQ ID NO: 5782 - DNA, 372 bp, Diabrotica virgifera
  misc_feature (130)..(145): n is a, c, g, or t
ggcgtatcgactaagatgtatgcaagagagcagtcaattaatgattcagtggagacgatcacacatgacgactgatacgattatgaggccacggtctctggatcggacacatgtagcctagataatatcnnnnnnnnnnnnnnnnggactatctgagcagtgtctcagagcggtggagataaggaagatgacaagaagtatgtcgtcaccaatcacggcttagctgatctttttgttgaagtagtacaccatcaagtttcatgatgatgctccacaagtgtttgtggtccagccattacataccactgagatagccattgatgacattcttgaacaatgcgtgtagcttgtgagcaacaacagttacgacca

SEQ ID NO: 5783 - DNA, 336 bp, Diabrotica virgifera
  misc_feature (89)..(114): n is a, c, g, or t
  misc_feature (232)..(252): n is a, c, g, or t
cccacgcgtccgagttatcatattgtaataacatagttttgagtatacgttcatgtacatttgaggttacagatcattagttaatggannnnnnnnnnnnnnnnnnnnnnnnnncgaagtctttatcttttgtaccgtgtgtctcagggattattaatgaatgtttatacatttaatatggacgaatcttaaaagagctacagtgattaatatttttatgtgtatgtcaacnnnnnnnnnnnnnnnnnnnnncatgcagtgatattcggttttaaatataactagttttttacgatatataattcccttaattaataaccatattcttacaaacta

SEQ ID NO: 5784 - DNA, 354 bp, Diabrotica virgifera
  misc_feature (126)..(151): n is a, c, g, or t
  misc_feature (302)..(302): n is a, c, g, or t
aaggacgcgtggggaaaaaggtagcctatttgcactggaagcccagctacctaataacaaaaatcttactaaatcaacttttccatttctatcaaaaggtacccttcagtcaaatcggcaactatnnnnnnnnnnnnnnnnnnnnnnnnnntggcatgtgaccatttaatgtaaaggcacatacattttacaagtgtatgcaggatgtttcacggacattaggacctcagtttgagccaaagccaatcaacccaactaccttcgacgtgccacattctccatattacaattcacctattcangtgcgtcgactacatgaactgaatttccagatcggggagaatgcacaggcga

SEQ ID NO: 5785 - DNA, 451 bp, Diabrotica virgifera
gcgtgggtcgttacaagactctagagtgagtcgtatgaacggatttctagccttgcagaaggaccgttgatcggagggttcactatctcttagtcttagactataagacacgtcttcatgtcgctagaatagttaatgtttaccttgatgagattcaatttaaaaattatattgcccaccatatagcctctatcggagttaaatccgatcgagcattttatgacactttaaaacatcgtattcggaaaataacaaacctgagacacggccagggctaaggattgcatcacaaaaatttcacttaacatgatattcaaaatattcgatatttttgtccagcagtgtatttaaaatattattcttggttttaggttttggcagtaagcattcgtttatttgaattactactttatacttgcctactcataagttccaacaataatgttggaaa

SEQ ID NO: 5786 - DNA, 392 bp, Diabrotica virgifera
gtaaacgcacatctaaaaggcagcgtttagacaccgcgataaatcggagcaatttatcgatatcgatcgagttatttcaatctatcgttgtgtgtaaacggtacatcgcagcgatttatcggaattggagttggattggagttggtatcggattgcatcaatttattgtaacgatcgagttgtttcagtttatattcaatcgcgacaatatattgcagcgtctaaacagcttttaaaaaatcaataaaccatagcaatttatcgtcacaataaattgctcgcatttatcgctccgtctaaacgccacttaaaatgttactgttttatgctacctttttacggttctactagactactagacggacagttgagtgtatgttttgtttgtgttc

SEQ ID NO: 5787 - DNA, 390 bp, Diabrotica virgifera
  misc_feature (84)..(102): n is a, c, g, or t
  misc_feature (157)..(169): n is a, c, g, or t
  misc_feature (171)..(196): n is a, c, g, or t
acccacgcgtccgctaccataaacagagcagtacctgttcctgtacctcaaccttatccagttactgtcaatagaccagttccnnnnnnnnnnnnnnnnnnngtcgaagttccagtccccagaccagttcaagtaagttgttaatatacttaaaaannnnnnnnnnnnncnnnnnnnnnnnnnnnnnnnnnnnnnngtaccatgtttattcattctgtttttcaataggttccagttccagttgctcaacctgttgaagttcccagaccgtaccctgttgtagtaaatcgtccagtacctgtagccgttccgactccagtacgtgtaccagttccacaacccgttgctgttccagtgccacaaccttatccagttacagtaccacaacct

SEQ ID NO: 5788 - DNA, 311 bp, Diabrotica virgifera
acccacgcgtccgttcacgcttctgatctcactttgccaggagatccccaacacttcggggtaatccaccgataccaaccaattgaaattgaccgtgttgcgactctcgaacgcagcttatagcacatgaccaccatcagttacaaacatgacgagtcatttcctgcgacacgtggccacattagatacgatttggtggatatcccgcatgaacttcctgcttcacacgatgcagtatcagatccgagccttctgaaaaacttttccataataccacaatatgcagtatacagattcgagtcatgatcttc

SEQ ID NO: 5789 - DNA, 413 bp, Diabrotica virgifera
  misc_feature (243)..(257): n is a, c, g, or t
tcgcgggtcgatacaagactctaaagtgagtcgtaatatctataaaatacgtaaaatataaagactaatcctcgtatgtaaaggactgactgaggtcctggacgctgatgctgatgaacgtaaatgttgacagcgttaagatgggtattatgaaggatgatgggtgatctttagtcaatacccatagaccggggaacggcgatcaatacttagccaagatgtggtgcgatactaatgcacttnnnnnnnnnnnnnnnttgctaataattcttagatcaaaagtgtttattccaacatttgttaagaactttatggtaatcaatgacttataataattacaagatattttaaaatttcaccctgtattattcgatgagagcataaatattacaatttgttggtttcagcttatt

SEQ ID NO: 5790 - DNA, 329 bp, Diabrotica virgifera
agactaacgcgcactattatccaaaccaaacgacttgtgggtgctcagcaacctcatttgacctgcaaacttggatggtaatgccgtacacaatcgtgtcttgcctgacgaactcactcagtccgacaatcgtatccacgtaacgggagacttcatgtctgaggtctccaattcattggatcagtaggactccaaaacgatgtagatacacagcaggttcgaagcctaatccgtagatgtgagtgaacttctagtgacagatcacacgctacgctcactggaactccgtctcctactagatcgatccagtcaataggagattctaagca

SEQ ID NO: 5791 - DNA, 113 bp, Diabrotica virgifera
acaaaaccctatagtgacgtcgtattaactcgcatctcacttatagccatatttaccatttaatctattcatcttctctaccatagctcccatctccagcatcacattcaacc

SEQ ID NO: 5792 - DNA, 377 bp, Diabrotica virgifera
aaccacgcgtccgaacctataatggatatatttttaatttgcaaatcatacttttaagttaataaaatgcattcggtaatatctgtgttaagtagaataaaaaatattgttcccgagcttcaaaatgctttaccaaatttgacatttcacgaagtctctaatgcagaattggataagcagttcaaggaatcccacataatagtagcagattacgacctactaacaccgcacatgtacagtttacctcaagccaaatgggtacaaggaacatgggcaggtgttaacgatttaatggcaaaagttactcaacctccaccattttcacttagcagattcaccggaaggcattttggggcgttaatgagcgaatatgttgt

SEQ ID NO: 5793 - DNA, 240 bp, Diabrotica virgifera
  misc_feature (13)..(38): n is a, c, g, or t
  misc_feature (203)..(228): n is a, c, g, or t
ccggcctcgtcannnnnnnnnnnnnnnnnnnnnnnnnncattccagtgttgaagagttcgtggttactccaaacagcgtatttactgtataggtgtgaggtttgagtccctcatgagccaggggccaccctacgatgccagacatggcttcctcgctaaggtgatcatcagctatagggtccacaatagcggggagtgatccnnnnnnnnnnnnnnnnnnnnnnnnnngggttgctagct

SEQ ID NO: 5794 - DNA, 409 bp, Diabrotica virgifera
  misc_feature (88)..(113): n is a, c, g, or t
  misc_feature (232)..(249): n is a, c, g, or t
  misc_feature (266)..(289): n is a, c, g, or t
gcgggtcgacacaagcgtctaaattgggtcataatacttatcaagaactgatggaataaggtttgaacttgaatttaggtacttcgtnnnnnnnnnnnnnnnnnnnnnnnnnncgatcttttttcagctttaagttgtttttaactcaaaaacgaccaacttaagaaaaattacaaaataccttttttgtttcgaatgatccaaagatctaaaaaaaattattgccagggcnnnnnnnnnnnnnnnnnnataaaaaaaagttatgnnnnnnnnnnnnnnnnnnnnnnnngtcagaacaaaattatatcccactgtttggggatataatgggggcacccattgttttttataatttttaacataccatattacatatcaaatggtttttattcattaaacgaatcggtgc

SEQ ID NO: 5795 - DNA, 424 bp, Diabrotica virgifera
  misc_feature (84)..(104): n is a, c, g, or t
agggtactggccgaaaaatacatacctttaattagctaataactcacttaaagttaacactaaaagggtttttctagtaaggannnnnnnnnnnnnnnnnnnnncttcaattttgggaataataggttttttgtaaaaacatagtttttgagttttttatgaaaaattggttggaaacatgcatttttctcacgaagaattaaaatttttgatctttaataactcaaaaagtatgcatttaaattaataagttcgtataacaaattttacttaaaatttatctctctatcgaattttttggttacttttaataaagtaattttcaccccgagggggggtggtatccacccccaggatagaggcgcaagttggcactatgtcacctttgttccttgagatgtcctctagccactcaccagttttc

SEQ ID NO: 5796 - DNA, 428 bp, Diabrotica virgifera
acacaacaacaccatccgttggtctaggaggtctagctactacacaagccaaagtagtcaccgcacaaaaagatgtcacacctaaagatcagccccttcctaacgaacttcttcaaactgtagaagccttcaaaggatttgtgaagcaacagaaagtttacagttcggacatatcaaaatgttcagctcgggattttaagaaagtagagcaagacattaagcaattgacggctcttctgaaaaatgtagaacatcagctgcagataaataggcaattggcagaaaatttaaaatatgatacagcaaaatgtttacaagacgtggaaatagcacaaaggactcaagatactccacctgggttgcagtacgaaaacacagaacctctgaagtttttcctaaatcctgcggacaaattcgaaaaggatatg

SEQ ID NO: 5797 - DNA, 59 bp, Diabrotica virgifera
taattttttaggagatacgttagatttagttattagcaatatatttaggattaagtatt

SEQ ID NO: 5798 - DNA, 422 bp, Diabrotica virgifera
cacacgcctctacagtgactcgtgttatgacaagtcttagcaaacgttgctaccgtcaacatgttcaaattgactgcattcatcgccatcatggacgcagctttcgcaatgccagcccccagccctagccgcaaaccggatccactggctcagtattcagcacgtcttcccttgacatacaccgcatcgtagcaaccattggcgtacacgaacttgggctacaactaccatgccatatgcctacaactacaacgactagatcggagatgcaccattggcctacatgaacctcaactattacgaagatgaagtctagtgaacatggatcgtgactgaaaggaaaattagcaaattagtttttggaatgatcatgtgcgaatttaattctggtagtaataaattgacattttacattagaatta

SEQ ID NO: 5799 - DNA, 326 bp, Diabrotica virgifera
  misc_feature (5)..(5): n is a, c, g, or t
acgancgagaagtttttcccgtattaagtgtaagatgccaagaacgaggtgtgaaatagtagtattcgagtgcaaggtaagtcaagatgaagttgaacgtagcgtatccggccacgggtagccagacacttttcgaagtagtggacgaacacaggattcggatcgttcacgacaaacgcatgggtcaagaagttgaggctgatgcgcatggtgacgaagggatgggctacatctcgaagatatctggaggtaacgactgacaacgattcaccatgacacagggtgtccttacgcacggtagagtaagacgttgactttcagaaggt

SEQ ID NO: 5800 - DNA, 321 bp, Diabrotica virgifera
agtcagaggagcagtcaatccatacgacccccattactacgacgaagtatacaccgcgcaatattgtgaatggagctgtgataaacaaggtggtggtttcaatataggcacatgagtcgacgggcccataagtggcggcatcataaattatggtgcccgattctgatggcagcaacagaccttcaggatgttcctgaaacagaggaggatgaggaggatgatgagatcgtaatggatatgcatgctgcagtttggctagttaccgcaacaacttagtcggtgtacgaatcagtggaacatacagtggttttggtgtaggaa

SEQ ID NO: 5801 - DNA, 420 bp, Diabrotica virgifera
  misc_feature (226)..(293): n is a, c, g, or t
aataatgataatagtatacagccctatctacttcctttctttgttttgaacgcatttgaagggatcccatttgactgaatcgaaagcctttgtgtaatcaacgaaaaaaagcaacattggtatattgtattctttcactttttctattatctgtctggtgtacaatagttgctcacgcgttccttttcctggttcaaatccgcattgttcggctatctcaggaagnnnnnnnnnnnnnnnnnnnnnnnnnnnnnnnnnnnnnnnnnnnnnnnnnnnnnnnnnnnnnnnnnnnnggataaggataaaggttgattcgtaccactcatcaggctattcacctgcgattcatttcatgttgcacatatccagtattacatctacgcctacgccaatctcatccattgcttttagagtctccgc

SEQ ID NO: 5802 - DNA, 165 bp, Diabrotica virgifera
gtgagtcgtattaaagagggatgatcgaggagatagacatagtcgagatgatagatgcaggtcaggcaggcatagaagaagaagcatgtcgagagatacagatacagggcgtgagagatctccgagacgttcaggatcgagagagagacctggcagatgaggttt

SEQ ID NO: 5803 - DNA, 355 bp, Diabrotica virgifera
  misc_feature (245)..(262): n is a, c, g, or t
gtatccgacagggcagaatggaagaacattgttaagcaggtcaagactgacaaagggttgtagcgccattagaagaagaataagtgttgtttttgtagtctaccggtgaccctaattgttgacatgaaatatgaaacggaattgtaagaaaaaggaataactgtttaccctcaaatattgtttcagtaatttttcatacccccgaaggaatagtttacaatttgttttatattttgtacataggnnnnnnnnnnnnnnnnnnaggcagttgagtgacgttgattttattaataaaatactcaaacttgttatgaacagttttaaaaagtttatacaaaagttgatacgaaatatg

SEQ ID NO: 5804 - DNA, 224 bp, Diabrotica virgifera
aagcggagcaagattatacagcgccagaacaacctagggcagtcgcattagagaacgaactacttgcaactaatgtgactggcacagtaaaatggtttatcgtcaaaaccggttatggatttatcaccagaaatgagatccaataagacgtttttgtgcaccaggcatccattataaagagtatcccgaagagagccgtccgatcagtgggcgactgtgaagtc

SEQ ID NO: 5805 - DNA, 433 bp, Diabrotica virgifera
tcacgggtcgacacacgcctctaaaattattcgtaagaatgtaccgaattggactgatggatgttttttctttggtgatgggggccaactgcttcccagacggtgcgcccgtggatgcttgtgtgaagccgagggttaaccagccataccatggacaagccagaccccaatcaccagaaaccaaccccttcgaggttctgcaatcagaggccgattatggaccgggaactcaaatcacagtgaccattcaaggggtgtccaattttaaaggattcctcatccaggcccgtgacgtcgcctccaacgagtggataggaagctggatagagacgccaaacaccaaaatccattccgaatgcagcgccatcactcattccgaccctaatccgaagcaatccgctacattggtaaggcaagcatcacacaacaccag

SEQ ID NO: 5806 - DNA, 413 bp, Diabrotica virgifera
ctcgcgggccgacacaagcctctacagtgactcgtgtgaaaaatgacgatgaaagagaaaaaactggaaatggtagaactggactatccaagaagagcgtgtcggatatccatatacttgatcacatcccaatagaagaaatcaaaagtaaaacaggaaggatttacaataccgtagatacaatagaatttaaacaacctttgttgtttaaaaattttaacatagccaatgattggaaaacaatccaataatattgaatttagagtgataaagtaagttgacagctcaagaaggttattgtttaattacaacagacaaatattctgcatactgcatggatagataatatcagatttaagtcttcacagtatgatatattaaaagtctttaacaaaataatctttgcgtgggta

SEQ ID NO: 5807 - DNA, 138 bp, Diabrotica virgifera
  misc_feature (27)..(133): n is a, c, g, or t
cgatacaggcctctatactgacgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggg

SEQ ID NO: 5808 - DNA, 371 bp, Diabrotica virgifera
aaaatggcgatatttcaatcgatgaaaaaatagacaaacttgttggcagtggaaccggagaagaggaatcgaaagagaacgaagtgcctaatgaccaggaagccaaagaggataaggattctgaagataaaaaagagggctctgtcgagaaggaagaagctactaaagacgatgatgtcgacgagaatgaagaggaagacgacaaagaagatgaaaaagaaacttcccccgaaaagtctgatgaataaatattaggattatacaaagaaacgcactgatgacctaattataagaaatcgaaacaccaaaatgattttcaaattcgttattgttttgcccttttatttaaagttgtttacaacttttttgag

SEQ ID NO: 5809 - DNA, 369 bp, Diabrotica virgifera
  misc_feature (140)..(157): n is a, c, g, or t
gaaaaattagtattaattagtcaacattcacttacagtgataattgctaagtaatagcatcatatgcgggatacttaagcagcagagaatatattttaattgtaataataagttaacagtgataagaaacaactgaatcnnnnnnnnnnnnnnnnnngaaggtggaccaaatattcaagaaaaggatgatgaacctgtagctccccggggtttctttaatttcctttgtcaccccttaggttctggccataggtttatagctttaatattcatgtgtttcctaagttttggttcctatttttgttatgataaccctgctgccttacaagataaaataaaagaaaacctagatttatctgaggtgcaata

SEQ ID NO: 5810 - DNA, 377 bp, Diabrotica virgifera
  misc_feature (354)..(354): n is a, c, g, or t
aaatttttcacaagtatgaacttcactttactttatagctctacatctgtttcatagtcaagatgatatttttaatttccccttgatataaattattgagagaatatagagatataccctcctctgggatttgcccatatatacccttctgacgatccctaataagggtgaaatttacgtaaggacgtttttggtcctctctgaacgaattgaaatgtaagatgtctcttgttttcgtcttgtaccgaattcattaataatagttttactcctatataagtatcgggatcaggatttcgttggatttttgccttgatgaataggcaggtagaaaagtgcaacttttagacttcnccgtatcttccttcattcatcgt

SEQ ID NO: 5811 - DNA, 344 bp, Diabrotica virgifera
  misc_feature (203)..(221): n is a, c, g, or t
  misc_feature (291)..(309): n is a, c, g, or t
caacacatgagagttcacactggagaaaaactttataagtgtgaactttgttttaagcagtttagtgattcgagtagtttaaaaaaacatttgacagtgcacactgcagaaaaaccttataagtgcgaaatttgttttaagcaatttgttcaatcaagtgatttgaaaaaacatttgagagtacacactggagaaaagcctcnnnnnnnnnnnnnnnnnnncaagcaatttactcaagcagagaatttaaaatgccacttaagaattcacactggagaaaagccttacagnnnnnnnnnnnnnnnnnnncagtttagtgattcgagtagtttaaaaaaacattt

SEQ ID NO: 5812 - DNA, 387 bp, Diabrotica virgifera
  misc_feature (3)..(24): n is a, c, g, or t
ctnnnnnnnnnnnnnnnnnnnnnncactgacgtcctattaaaacatgtctcataaaattattttcgcggtgtttacaattgttctattaacattacctttcaaagctatttcggcctgtgggggtatcaaaaatgttttaatcgaagtgaaagatagtgagagtgaaagaagtaacatcacattcagtggttgcttggagagaaaaaattttggagggaaaaccattaccgaaattcatataagaaaccaaaatattccaaatataggatgggaatatattacacatttagttagattagatgttttagaactcaacaactgcaaaattaaaaatatcgctagaggagcactaaaaaatttaccaagaatcagagttgtcgaagtta

SEQ ID NO: 5813 - DNA, 395 bp, Diabrotica virgifera
  misc_feature (174)..(191): n is a, c, g, or t
cacaggtctaggactcgcgggtcgacacacgcctctacagacactcgggcgaacgcgtgggtccaagttgtgtattctctccataccttgaagggacgcactattttccggaacacccgttgcttatgaatcatcctatacagggtgttattttgcctgcaggttttttgacgnnnnnnnnnnnnnnnnnngaaattcatactttatttgtggatcccacaaaagcgtatgacacgattctggtgagaaagttgtgacagtctcttgaacgatcttctgtaaatagcacgatcatcgccgcagtcacacaattatgcaataaagcaacatcagcgagtcgtactacatcaggtagtcgtagtgaatgatgaggaagacatggactacatgtttag

SEQ ID NO: 5814 - DNA, 391 bp, Diabrotica virgifera
tacatacaaagaaaatcttgggtatagactatagagagtattttgcataaaatattccggcagaagaaaatattactgaagtatgtgggaagttcgcaggaatttaaaaattcctgtgtcctttctgtatgatatattatactttccacacatgcatgcacaaaataaaaataagggcgaaaatagtctgcctaatttttgttagtaaatagagagaagactaaacaggtctctctagatgctattttaaagacgtgtgtgttaaatttgatttttctcgacactgaaacattcgatttaataattgtgcgtatataacttttaagagtgtaggcgcgaaatttcgtgccaatgcttttttatatatatacattttttttcaatgggaaaa

SEQ ID NO: 5815 - DNA, 374 bp, Diabrotica virgifera
cccacgcgtccggttcgttttccttaacaccgtgtagcttttattttacctctcattatgctttgtactacctactgcatatttagaatctcctcctgcagttctatattagtgtttctttcagtttataatatccctagtatgtgccaatgaaatcactttcatctgctttgagtctatcaagtttgaacttttttagcattcaggattacaaaccgtaattttagtatttttgttataaatacatgattatttttgatacagaaaactctcttgggatttatgaatactgacctttgcgtgcttttatttccggtaggtacttatctccgtggcaacttcatataaatatacactatccctgcattttggtc

SEQ ID NO: 5816 - DNA, 378 bp, Diabrotica virgifera
acgcgtgggtcgttacaagaccctagagtgagtcctatgatttggtcaagaaaccagaagaaggccccgaaatcactattcctactgctgcaccaacacaacccagcaaaccagaagtatacttcatcagatacaagacccagaaaaccgccggaggtggaactggattcggaggtggaagcggtattggaggtggcattggaggcggtattggaggtggtattggaggtggtattggaggaggaatcggcggaggaatcggaggaggcggtatcggaggtggaatcggaggtggaatcggcggtggatccggcggtggtatttcatccagctacggcccacctggcaaatccggtccatactaattttcttactaag

SEQ ID NO: 5817 - DNA, 377 bp, Diabrotica virgifera
  misc_feature (69)..(107): n is a, c, g, or t
  misc_feature (292)..(315): n is a, c, g, or t
agctgaatttaagtttttttaaggttccgtaatatgtaattctaaattaatctgcgccatctacaagannnnnnnnnnnnnnnnnnnnnnnnnnnnnnnnnnnnnnngatatcttgcaggaagtttagctgtaatgaccgatgcggctcatttattttcagacttgataggatttctaatatctttattggctatatgggttgggaagaaaccacctacaaaacgaatgacttttgggtattacagagccgaggttataggtgctcttcttagtgtcttaacaatatggttnnnnnnnnnnnnnnnnnnnnnnnnggcaatcgagaggatatataccaaagattacgaaatacaagctaatacgatgatgaatatat

SEQ ID NO: 5818 - DNA, 358 bp, Diabrotica virgifera
  misc_feature (109)..(135): n is a, c, g, or t
atatattatttgctttaatcaattttaataaaaatacaatatgttgaaatttgtatgcatttcttaaatacatgttcgttttttaatagtttacattgttaatcaatcnnnnnnnnnnnnnnnnnnnnnnnnnnnctacaaggggttcccaagcacagtgtatcaactaatattaaagattttaatttagattttcagtctcatttaagctactttgcacatatttcaataaatttgtacagccagtattaaacacgataattcagatcgagaaatcaacaactataatatattccaactagcatttcaaagtaaaatacggcaaaatatatggacaacatttttgtatcattgacgt

SEQ ID NO: 5819 - DNA, 215 bp, Diabrotica virgifera
taatgatatctaactatttcgtcatctacaaaatgagtatgctatcaaccttgttaatattgacaatctgcgtcagagtgtatgctcaaaggtggcgcattgaaggttgccctcctggtccttcgttttcctgtcgacgggaagttgaatgtgatctgctcaaatgcggtaggctaccaccctgggccgtaggataaatattaggtagtcttcct

SEQ ID NO: 5820 - DNA, 175 bp, Diabrotica virgifera
acgttgaatacccaaatggttacccttttgttgcacgaagcaacaaggtcgtcgcatgcgccaaacactttgttggagatggtggtacggacaacggggtaaacgaagggaacaccattgcatcatattaagacttggagaagatacatattcctccatatcgtaagtgtcttgc

SEQ ID NO: 5821 - DNA, 247 bp, Diabrotica virgifera
ttccctggccaaaccactacgactgagtcgtattagtcatcattaacaccgagttcggggatgaattgttcgatgagatgaatatataagttaagtttgataaagatgcagagaagagggattagtcgaggacaaagatgaaggattagaaaggttttaatatgctccttggtttggacaaatcaaatatcgactaccagcatctaatggaggagacaatgtccgataatgcaatggacgtcgaaaa

SEQ ID NO: 5822 - DNA, 315 bp, Diabrotica virgifera
  misc_feature (34)..(58): n is a, c, g, or t
  misc_feature (64)..(106): n is a, c, g, or t
  misc_feature (143)..(159): n is a, c, g, or t
  misc_feature (161)..(174): n is a, c, g, or t
  misc_feature (203)..(232): n is a, c, g, or t
  misc_feature (295)..(314): n is a, c, g, or t
gacccacgagtcaacggacgcgtggttatttaannnnnnnnnnnnnnnnnnnnnnnnnctttannnnnnnnnnnnnnnnnnnnnnnnnnnnnnnnnnnnnnnnnnncattttactaaaatttaactttcaaataacaactaannnnnnnnnnnnnnnnncnnnnnnnnnnnnnnctatttacttttatatattattactttcnnnnnnnnnnnnnnnnnnnnnnnnnnnnnnccttacattatctaaatttagtaatcatgataacattagtattaacaaactgtatatttagcnnnnnnnnnnnnnnnnnnnnc

SEQ ID NO: 5823 - DNA, 304 bp, Diabrotica virgifera
tcccgggcccacgcacgacgtctagagttatggcaacttccgaggacaatcaacaggaaaatccccagtcaaagttatcttaagggacatatcatcctgagggagcttcactcggcagtgattgcccaggtccccattcaacgcaatgctacgcatcttagccaatatccaacaccagtgtggcattcatgaagaactactgagactataagcttggatgcacgaaatgatcatggattgcatgcctatctacaaaccaagacattcgcaacagacattgcggagatctccactacaaacctca

SEQ ID NO: 5824 - DNA, 415 bp, Diabrotica virgifera
agcggacgcgtgggttcaatctaaggcgacaacattccttcatgtcaataactgatcaaagaaactgtacaaataatctaaaagtaaatgcccattgtgaatcggtttattaaaaacaaatttcttaagaacacattatatgttatgctaatcaagaactgagaaggaacaatggtttcaagacttgtgttagcgttggttggacttatttcaaccgtgaatggtttggataatggacttgcccgtacgccaccaatgggctggatggattggcaaagatttaggtgtctgacaaattgtacactatatcctgatgaatgtataagtgaaaaattgttccgagacatggccgatcgtatggcagcgggatgggtatcttgctgctggctatgaatacattatgatcgacgattgt

SEQ ID NO: 5825 - DNA, 309 bp, Diabrotica virgifera
gcacgaatcaacatagagtcgtaatctggcgactgaaattagatatcggattggaatgagactgatcttaatacaattcatcattcatacatcttcatatcatttttcacaggactttatgagcgccgtgatttaactttttatgggtatgtgcgagtttttccagtttgcttttcaagattctagtccataccgcattggggtgtttgttcagggtctgtgccgttagagcttttgccaacccaggaagatcaggtagtgctcagttcgacatttggtggcaacatttgactggacaccatttcttct

SEQ ID NO: 5826 - DNA, 377 bp, Diabrotica virgifera
  misc_feature (285)..(310): n is a, c, g, or t
cgggtcgacacacaaatccgcggccgcgtaggaaaaaattatgggaaaagacaggactaaagtcatttagagtaaatatgccggtaaaagggatagagcagaattgcgcaaacataagggattcggttaacttaacggtacggtctaaatgtgatagttttcaaatggacagttgtttcttatccattgataaaatttctgacggtctaccgtcacatagcatggatttaggaaatacttttaaaatttcggaaaatattacgctagcgggtactgagatttgcnnnnnnnnnnnnnnnnnnnnnnnnnnttggtcaactgtattttgggacttactttgtcaagggcggttcaggttgaataaggtaggacctttt

SEQ ID NO: 5827 - DNA, 421 bp, Diabrotica virgifera
  misc_feature (271)..(315): n is a, c, g, or t
  misc_feature (341)..(387): n is a, c, g, or t
  misc_feature (390)..(418): n is a, c, g, or t
cgggccgacccacgcgtccaatcacacacggattcgcctatgttgtccagtcccaccaaaacaactttgaatggatttctttcaagacaaacgctaacgcgatggtcagcacgttggccggtagaacctcggccttgagggcattgccactagaggtcataaccaacgctttccaaatttctctcgaggaagctagaaggatcaagttcaacacgcttgagaccactttgactcgtgcgcgcggtggacaaccccagttgatcgaggagannnnnnnnnnnnnnnnnnnnnnnnnnnnnnnnnnnnnnnnnnnnntgacatggttactattgtaatggtcnnnnnnnnnnnnnnnnnnnnnnnnnnnnnnnnnnnnnnnnnnnnnnnaannnnnnnnnnnnnnnnnnnnnnnnnnnnntgt

SEQ ID NO: 5828 - DNA, 408 bp, Diabrotica virgifera
gcgtccaaatggattatggagtccggcactgatatcgaataagcacacatgctttttgatcgatcctgacagatagtaaattgaacttacaaaaaccaatcataggattcttagactacgttaacatcaagtataatagtgttagttaagtgtgtatagaacaacattttctgtgagtacatatttttcgattaataggtaattcataaccaactgaattttataaaaccgtcaataaacaacaccagtcattgatcgacaccaattttttgtcgttaaagacaattaccaaaatccgaagcggaacaggtccgtacttaggaaaatcaaatggtgttgagaaatggaattcgacgtcactaataatagcgatgaatcattatcgcaatccacatcacaaaaaccttt

SEQ ID NO: 5829 - DNA, 397 bp, Diabrotica virgifera
tgaaatgtcatacctttctaaaacttccgaactgtctacatcatgtatctaagatacataatgactatacctctgtaaataatcactaatactaaagtgtaagtaatcatgccaatgggatgaactatactgaagctataatactgctattagtttcttcatggatattaggaaattcctgtactaattaaaacgtctttcacttgtaaactgtactctgcaagggattacatgttttcccagctactcatgagatcattaatggatattacattgatttaattatgtttaagtgctacataagttaaactttcagaggcacaaaagataaaactcgattaataaggaaaaccactgcatatcctacaccagtttactatatccatatcatcatgtg

SEQ ID NO: 5830 - DNA, 391 bp, Diabrotica virgifera
atgtacatggctgcctctgccttctcgacattttttaggaaacggtgttgtatactattgacgtacgggcgttgttgatatgatttgattgccgaaaagccggttatttggttcttgaaccgggtctgtgtttctccggtttgttgttttgagggatttccgatttgttgtcgcgaatatcttgatttgacagattggattctacatcgaattctagagtagtttctcgcgcatcgaaggatgacaaaaaaatcacctcaagctgcgacccatctacctcaacggcctccaccgcgagtggtggcagcaacgctgccggcggaaatagtggtgctgccgcctcaacatcgggtaaagcccaaaagaacgaaccgatggaagtgaagacttc

SEQ ID NO: 5831 - DNA, 176 bp, Diabrotica virgifera
ctcatgacgttcgcaatactattgctaacagcgcttatgaactatagtcccatcattgtgtctaaatgtactgtatcctcactatgtccgaattccaacctatgccatatggtattatgatctagccgctgcatgagtggcatcaggacacaatgtcccgatgcttagtcctcatc

SEQ ID NO: 5832 - DNA, 393 bp, Diabrotica virgifera
accacgcgtccgcgaactttgagaaaaaatcacagtttgattggtacatccggtatacaatgacaatttacctgtctagcagcaatattattacagcgatattgttcatgaataaggctacatgttaaaaaagtcatttggatcgaacagcaggtttggtaaattcgagacatcaaaaatgatccgtttttgaggtggtgcgttaatttcttggagaagtatatttagatataacccaaattttttgacttttaaattgtagggcgttgttgaaaattgtctaaaaatctttgacttatcgggcaaagtgcgttcccctgttctggcgactactataattattctcggcgcgcatgtgcctattcgttgatagtcctaattttatattacaaa

SEQ ID NO: 5833 - DNA, 379 bp, Diabrotica virgifera
gttagttcagggagagggtcatatcactattttgcacaacgacatgatacacgaattgactgataatacaactataactggagctttgggatgcaggaatctggctgtgtatccatctaacatcaagtagttctaatgatgagccctgtcgtcgagatcatgctcagtcgtttaacacagtgtatgctaggttactcacgttcgtacagcagtagcgagtacaatagcagatgtcatagcactcagtgacattatcaacgatccttctgtcatggatcatttgacaggatacatatataccgcaatgaatatgcaaacggcaattgccaatactgacagtactatactcagtggagcaactggtaaaggatgtaatttc

SEQ ID NO: 5834 - DNA, 397 bp, Diabrotica virgifera
  misc_feature (294)..(311): n is a, c, g, or t
acccacgcgtccgggcttggcttaaagggcaacatgcttccctgctcgaaaaactaggtatttgccagttcaatgggcagaaaatgggcatttttgtatttataatgtattaggtatatagtatgtagtacccaaaaaaacccatttgaaacctggctacgcaagtgttccgaacatggtatatttttgccttatttccctggtgtatattgagataattcctacatcttgccgagttttgaaatgagagcattatacatattatgtgaaaaaccaagtgacttaatctgaatnnnnnnnnnnnnnnnnnngctagtgtattatagagttttatgcaaaagtttggagtaaattcgttatttcagaaagatacgacttctaagaaaatcttaaaact

SEQ ID NO: 5835 - DNA, 400 bp, Diabrotica virgifera
  misc_feature (294)..(314): n is a, c, g, or t
gccgacccacgcatcaatatagatattgatggatgaagttctgcttcaaaaccgccaaatattgtttttattatggctgacgagttgggatggaacgatgtgagttttcatggatctggccagattccaactcccaacatagacgcgttagcttaatcaggccttattttacaaaactactacgtaaatccaatatgtactcgttcccgaagtgccttaatgactgggaagcatccgatacatacgggtatgcaacacacagttttgttctgagcagaagctcgtggattaccnnnnnnnnnnnnnnnnnnnnngcaatatttggaagagttgggatatgagaatcatattgttggaaaatggcaccttgggtcagataaactagagtatacagcaatgt

SEQ ID NO: 5836 - DNA, 415 bp, Diabrotica virgifera
aatttggttctcaaatttttaacaaatggtactgggtgtgtttttctaatatccccgccaaattgtattttcgcgtcgcttgtaccatggataatcatttcccttctttctccacaattctgttgattcttgagttccgcaatttgtttttcgttttgcttaaatttttcttctatttctcgcctgtcttcttgtattacattttcaaatttgctttctaactgttctatctcgtttttcattgttgtcaaacatccttttatttccttttcatacttttctatgcgttcctctattttcttattgttctcttctattgcttgttttgtttccttttgattgtcatccattttttgctgtgtttccttcattgctagttttgtttcctccggatttctatccaatggtcgttttg

SEQ ID NO: 5837 - DNA, 405 bp, Diabrotica virgifera
  misc_feature (266)..(290): n is a, c, g, or t
atttcagttaaaacacatgttaaacaataacaccgtatattttctttgtttctaaatatatcagggataatcaaaaaacaaaatgttcaagaaatatgatactataatacgatttcgatgtatactcacacttgtaccttgtcctccctacagggtgtctcaaacttggcataagagaaacatttcttttcttctacccggtataaggtataattacaaaaaaaagtgagtaaacatttgccaaaatgtgtaaatgtgtataaggnnnnnnnnnnnnnnnnnnnnnnnnngcataatccgttaatctgtctatgaaaaaatcatctgtgaaaatgaacataaatttaagtgatgcataacttttgaaactatgtttatttaattggagatttaacttaagtgtat

SEQ ID NO: 5838 - DNA, 385 bp, Diabrotica virgifera
  misc_feature (9)..(40): n is a, c, g, or t
tgaacacannnnnnnnnnnnnnnnnnnnnnnnnnnnnnnncctatgtgtcaatatgaatgagtcagataaaattaaattgttagaagaattttaatcaagcaacaaaaacttaatttattatttgataacgatttctgaaggggaaagcaaaacgtcaaataaattgaatttcaaacgaaaattgtggctaacccaaataaaatgtaaaatacttacaagtttaaatttttataaagatagataacctattagttttctgtagtcagaattatttccaagtactgtttgcaagctattcaggatgccatatacatgtcttccaatggtatatttagggcaatcaattacgaaatggtctctatactgtctactaaatcacaactt

SEQ ID NO: 5839 - DNA, 301 bp, Diabrotica virgifera
cgtactgtcacacttcgcgagggtttaagaaaatgtgattcgtgttaatatttaattgataaaactcgacaaaatgtcacctttgacaggttttttgagtgtagtgtctttgtgcgttgtgatttccgcgctaaaaaccccaaaacaagtgaacattacgaaatgttgcaagttcgaggagtctcttaagaccggagacaacgtttgtgtccaaaactcttccagttcgtggaaattagagatatacaatgctcggaaagccaaattcgagaagcacactgaattacctttgaaattggaa

SEQ ID NO: 5840 - DNA, 399 bp, Diabrotica virgifera
  misc_feature (27)..(47): n is a, c, g, or t
  misc_feature (98)..(118): n is a, c, g, or t
  misc_feature (157)..(186): n is a, c, g, or t
  misc_feature (206)..(254): n is a, c, g, or t
  misc_feature (286)..(317): n is a, c, g, or t
  misc_feature (333)..(361): n is a, c, g, or t
cccacgcgtccgcggtcgcgtgagatnnnnnnnnnnnnnnnnnnnnnagtagtagtgaagaattttattaattgatggttgattagtagtgtggtagnnnnnnnnnnnnnnnnnnnnngaagaatttatttatttgtagcatgtggagcatggaggnnnnnnnnnnnnnnnnnnnnnnnnnnnnnncgacgtaattagagcagctnnnnnnnnnnnnnnnnnnnnnnnnnnnnnnnnnnnnnnnnnnnnnnnnngtgatgtgttgttcgtcgttaaatagaactannnnnnnnnnnnnnnnnnnnnnnnnnnnnnnnaacaacataataatgnnnnnnnnnnnnnnnnnnnnnnnnnnnnngtatttttattggaggatcatcttagtaatattttatt

SEQ ID NO: 5841 - DNA, 380 bp, Diabrotica virgifera
aggcgtatcagctgaaatcgaaatcgctactcggcaagaaaaagaaggcgaaggagaattatactacgtcagaaatacgttgactcgtaccgaacctttagtcatccacggtaacggtgcagccaaatacgctctgaactatctcagcaattacgttcctaacgtatggaactccgtggacgggtgtaaacaatgcaagaagggagcgatcagtctcggtactactgcgcctaaagattttccttccgtgctgatttctgtattcatcgaacaaagcacgccgtttttggaagagatgttgcagaaggtgtacttcctggactatcctaaagaaagacttcatatttttattcataattcggttaaatatcatgtcgaca

SEQ ID NO: 5842 - DNA, 330 bp, Diabrotica virgifera
  misc_feature (72)..(90): n is a, c, g, or t
agttactttacactaatccactattttttagcaaaactaaagagaacttttatctactgatacttaattacnnnnnnnnnnnnnnnnnnnctttttacccaagatgcggttattctttgtaccctgcgtatcagggattatcaagtagtaactatatacttattacttgcgcatttacaggagctacaatattaagctttttactgtcaactaaatagtttacgtaacttttttgtactgcaatgttactcgtttttaaatatatccaatttttgaagcagtaactgaggtttatctagtagcaatatatttatcattaaatacctttac

SEQ ID NO: 5843 - DNA, 322 bp, Diabrotica virgifera
  misc_feature (38)..(55): n is a, c, g, or t
cccacgcgtgggaaaatgtgtggtcacgtaaaaccccnnnnnnnnnnnnnnnnnngcaatttaacatgtaaattaactttaatacacacaggtattctcgctgaagttaatgtttatgttaccgaacatatgtcacaaaagttgtggcagaagtacaggactaatgccaattatagcattcacttcagcatcatcctcatcaccacagttaacggaaactaatgctgttagtgaagatgttagtgatcatgcggagcaccttagggcgctccagagggcacctcaaccggagaaatcaatagtggcagcagcatttgcatca

SEQ ID NO: 5844 - DNA, 377 bp, Diabrotica virgifera
  misc_feature (76)..(93): n is a, c, g, or t
accacgcgtccgcttcagaataaaacttattgtacttttatgtcagttttggtcaattcacaaaatttttatgtgnnnnnnnnnnnnnnnnnncagcaaaaaaatggcttgtggcgattgtggctcgtgcggacaatgttgcggttctccatgttctccagcaatgtatccccatgctgtatgttgtatgtcatgtcctccaccaattatccttccgactaagccagaaccagtagaacctttgcaaatgccgtgtgctctaattaaagacgaatgcataccggaagacgtagcattacaaaagcggtaccaaaatttttacaatgcactatatgaagactggcattgtataacaccttcaaatcgtggtccaatgc

SEQ ID NO: 5845 - DNA, 430 bp, Diabrotica virgifera
cccggcccacgcgtcaaggcagaatggcttgcatatgggacatgagaaattccgtggcagcttccttactttattccaacgaattctcagccatcaatagtgtctcctggaaccagtccgatactaactatatagcagtgggaacacaagcaggagacgtatacctattggataaaagagaaccaaaagacttcgtttcagttatttcttgtttttcttctccagtaaataaacttcgttttaataattcaaatcttgcagtttgtggcgattcaaaagatgtgctagtggtcaacactcaatcaaacagtatgaatgtaatttataaaaatgaagagcacaaaggacatgttaaaggactttcctggaacaaggacgttttgtttttctggtggattttaaaagattctcaagttaaccatgttattgt

SEQ ID NO: 5846 - DNA, 349 bp, Diabrotica virgifera
agactatttactagtctaataaagatggcttaaaataagtacaacagaaaatacaatgtttaattctagtatctgtgagaaaaataatgtttttttggtacctgaagatattgaaaactcttgtcgtttgtctcaacaaaaatgctttggtagatatatttaagactaaatatcaagaaactacttttgctgatatttttacaatggttttcatattggagttctcaaagaggctaatattatatgctatgcagatgacacagccattgttgtttgtgagagcacttgggaaaaaactcttaccatagcagaggaaatcatggcaaaaattaaaagttggtttgatgtc

SEQ ID NO: 5847 - DNA, 449 bp, Diabrotica virgifera
  misc_feature (18)..(18): n is a, c, g, or t
  misc_feature (24)..(24): n is a, c, g, or t
  misc_feature (28)..(29): n is a, c, g, or t
  misc_feature (59)..(60): n is a, c, g, or t
  misc_feature (78)..(78): n is a, c, g, or t
  misc_feature (84)..(84): n is a, c, g, or t
  misc_feature (90)..(90): n is a, c, g, or t
  misc_feature (98)..(98): n is a, c, g, or t
  misc_feature (218)..(218): n is a, c, g, or t
ctcaaaggccgggtatgncttttnggannaaagaagaaggactctttagagggggaagnnacacaggaaccggcaggngacggnggaggngagaaagnaacgcacccgcaagcaaaattttccgcagacggaccgagcccagcggacgaagaggaccggcggacgagaccaaccgccagagccaccgccaaacacccacccaaagaagcagaaggcangggacccaccacgagaacggcagaaaccgggggacccgaagaaggaaaaccggacgggaccacggagaacccaggagccattggcttccatcagaacccaatacaccccagaaatgttggagaagaatattcctgctacgagggacagaccccctaccgccctcgcatacgccaccgacattagacgacttctccgccatcgttaacgcatgaacatcccaccaccgcaga

SEQ ID NO: 5848 - DNA, 486 bp, Diabrotica virgifera
cctcgcatagaactgatgtataccctcttaggatccacatccatcttgacactctttgggctggacagatgcacactctcgatcttaaggaagttcacttttccatgcatatcatggacatggatgattatgacgatggagaggctgtgatctccgcctgatgtgctgaattatctttctcgatacggtaaagaacaaacggaaacatagccatcagatgagatccattatttgatcagtgaaaagagaacttacatctggcctttccgctctgctctgaataagtcttgctcccgctcaaagcgcataagaaaggaaagagcgtgtcctcgaatctaaccttagaattgaaactactgatgctgaagatatccaagacgtaatgatggtacgtcatgacccatcacatctcgacgatatcctgcctggtgattacctgactgttgacttcatggaagaacactaccacgaagatcttcacttagc

SEQ ID NO: 5849 - DNA, 1001 bp, Diabrotica virgifera
  misc_feature (27)..(53): n is a, c, g, or t
  misc_feature (78)..(99): n is a, c, g, or t
  misc_feature (660)..(691): n is a, c, g, or t
  misc_feature (844)..(844): n is a, c, g, or t
aaatttataggttatgtttatgtgtannnnnnnnnnnnnnnnnnnnnnnnnnnttttggtaataatttaccatttttnnnnnnnnnnnnnnnnnnnnnnaaaggtgctgagtataatattggctgaacgatttggtgcagtggtagagaaagtaggaacttgcttgtatcaatatggaagtgcacctttacttcacattaaaaaaagaactgaattacccctttcaaagctcaaagaatctcttgctatacttataaaatatcaacttgtaacgtttgttcctaaccagaatgaaaatttggcgaattattgtataaagccagacaaagtattactcatgttacgatatccaaagtatataaatcttataaaaaagaaatttggggatgcttcggaaatgataatcgaagaatatcttctaagaagttatatttcagcctccgaagctttgatcaagatccatgaaagattatcaaagaacaatgagaataatgtgtcatttggtcaattgaaaaacgaatttattgccttaataaatgccaaatatttaataaagcttccacacaatgaacaagaagataaacctgtaccaaaattagttttaaacgagaaagacatgcacatactcccacctatagatgtaaatttactcgtaaaagnnnnnnnnnnnnnnnnnnnnnnnnnnnnnnnnaaagatatttattggcaaataaactttgatagattccaccaggacatgagggataaaattatttttaccgcatttgcaaaaaaatttgatgaaaatgctggtgagctggttaaaatgttgttacaacagatgtatataagaactgaaccttgngcagatgtatctaatcctatcccctatttggaaatataagatatggtgaagaaacagaagaatttaagccagttaaatgctgtttttgacccatatattatgtaatttgagcagaccagagtaattaatcagaaaagcgggcaatggtacatttcaa

SEQ ID NO: 5850 - DNA, 466 bp, Diabrotica virgifera
ttcgttccgttcttcttttctgtgaaattaggaatgtagcaaagaatttctgacaagtgatgatttgttataactatgtttttttaacatttggagattatgcaaaaaggagaaaagtttatattttgtcaacaaaatattgaatggccatctcatctgcataatctttctacgcctgatcaatgtggcatgattactttggatgttgttgcgactgtgacattgctggttagcagttgaattgttgctaaaatgttcgcttagttttcgccggcttctgcaataattgtagtctataccaggaaagcatatatatttcaccaagttatttaattattgataaatagttacttgcccaaaaaattaatttgaggattcgagattttttttgggaaaacccacaatttcccaggaaaattttcgtcggagcaaatccgggaaaacatgcccctatgcacaattaaat

SEQ ID NO: 5851 - DNA, 389 bp, Diabrotica virgifera
atttagcgttattaaaagatctaaaagagaatataaggcgaaactataatagtcgttagagcaaaactaaatgtaactggggcacttccactaatagtggtctctacaataccaaaagcaagaaccctgctggcctctaattcactgagaaggctcagttttctgtcctctttaactgctgttgaatcgaaggttgcgttaaatattggcccttcctctacagttcgcgccaatggtacgaaactgctggcattagcaactgtactttcaaccataatgctgctgaactttgtactgggtcccactgagctgataccgcaagtactatcttgagaagatacacaagctacaagggagcccatcctctgggttttcttttgggctccgaa

SEQ ID NO: 5852 - DNA, 634 bp, Diabrotica virgifera
  misc_feature (131)..(131): n is a, c, g, or t
  misc_feature (190)..(190): n is a, c, g, or t
  misc_feature (193)..(193): n is a, c, g, or t
tatttatagagatgggtgttaaagaaccatgaatattagtggaaaaaggtttattttatgttttataagcgattctggtggtattggggctttattttcttaggatattttatgttgaaaaaagtgggaanctggtgagtaagttggttgaatagagaatggattagaaaagtgagaaaaggagaaaatnaantgagttagtactatagccaagcccgaagaagaaaaactactttaaagtgctaaaccctccgcgaaaagtttttattatagaacgaaatggacatcgtcgtgaaaggaaaatatccagtggaaaatgggaaagaaaaagcgcacaacggaaactctcaaaaagtgaaggaggagctagaggaatgataaagtcatacagccaagctatgattaaagaccacgtagatcgtacgtaatcaggagtccgctattgaaatggaaagcagccaatttcatataaaacaaaggggatgaaaagaaacactgagattcgaaaacatccaaagcattatggcttcgagcttctttaaaaatcaatataatgttcatatagctagtaggcttatggttcaactccatgtctccaacagccttccttttggaggcctctttccctattttc

SEQ ID NO: 5853 - DNA, 803 bp, Diabrotica virgifera
  misc_feature (743)..(743): n is a, c, g, or t
  misc_feature (765)..(765): n is a, c, g, or t
  misc_feature (785)..(785): n is a, c, g, or t
ggatcacatgggcgagaagctgatgtttggggattaggttgtctcctgtatactctactggtgggggaatccccgttcgaatcacctggtgttaaaagtactttaacgaagattgttatggagagctataatttgccgagttatttaacttcagacgcgaaagatcttataaattgtttattgcaaaagaatccaaacgatcggatgaagttggatcaaatattggagcatcctttcatgaaaaagggacggcatatgatgtatcaagtcagccatgatagtggaaattatacaatgtcaagcaaacgggatagtacattcgacaacatatcacttccacattctcaaaatgtgtatgctaccaatggtcatgttagaaaagcaaatagtaactgtttacctctgcagaataattatgctgacaatcagttaccttcagacatggaaaggcttcgtgtccgaagttatgaaggccttcccacatacagggacctcagacccacagaacaaatttcaagatgttctcaacattcccattgttgttgcaatagacccgcaacaagtttgagaagttgtagtcaagagcgagctatacctgttgatccaggagggtatcaatatcaacctaagtataacaacggatccttacattcccatcactcggatcccccgttgagctcgaacgcaggaagccacgtcaaccattcagtatctggaggctacattcattcacctcaccttcnaacagagaaacatatcgctcanagagaccatagttctagaanaatcgaaagaaaaagtac

SEQ ID NO: 5854 - DNA, 823 bp, Diabrotica virgifera
  misc_feature (605)..(625): n is a, c, g, or t
aggaagagatggcattcgaagagtaggaagacacgggcgaagaagaacgtagttcgaaggggaacgacgaagaaaatagtgggccgaatgacgaagatggaacgtagtgggcgatgggcgtacgaagaagaagagagacagacgacgcatcaataaatgcgggtggccgtcaaaaccctcgagaaacttctcactcggcggactcatctcagtggcaaagtctacgtgttaaccctcgtggacatccttcactttcattcttcaattaagtcgttcgttcagtggcagccttcaaacagccagagatcggttccacagtcagccaacagttagttatcaactctcattcataataataacaccatccattcgacacattccttcatcattttaatccacaggctaaccacgtgacctttggccgtcaggagctagggcttcttcagtggaccgtgagaaactcgcacgtagacccgcaggtacctgactaatttctaacttaataacgtatcccctttcgatttgtaaaaatgtccatttttgtgtaaagatagatataaatttagtttaagttggtctcagaaataacaaatacgatttttggnnnnnnnnnnnnnnnnnnnnnatttaactaattggacaaaaagagaacaggcataaggaggcatatcctggcacgtcacacccgggagtcttgaaaataaaaatggatacataatggctttagattggtgatcatcattacgtataagatttcacaaatatttttgagagggagaagaaagcaataagcgttatggaggtaaatagaatagtctatctg

SEQ ID NO: 5855 - DNA, 815 bp, Diabrotica virgifera
  misc_feature (133)..(148): n is a, c, g, or t
  misc_feature (435)..(452): n is a, c, g, or t
ccgagtggttgcaagataaacccatacgaaagctcgttcggtcctctagcaaaaggtgaagaacccatcgtgcagtaacatcgccgaaacccatattatcgtgtaaaaagtttatcgtacgatactacgggtnnnnnnnnnnnnnnnngaaaaattcgacgattttctctaatcaaacttttcacctacgccacattcccgtctattaatcgcattaccaacgcacctagctcgatcgagtggtcgcggattatcaataatctgtcttccacacttaaattttcgagaccccgctttgaccgttggataagcaaaaacaagcgtttaaatggcactaactcgcattcgtatatgaatttgcaatggttttcaaacttcagtacactaatattgaatggaccggatgctgatgaatgggaccattattaagtcacnnnnnnnnnnnnnnnnnncaaatacaaataacaggaactggatcaatgtgacgtttaaaaatacataataactaacatggcagaaatgtcacttgagtgattacaatggctttcaggtctaaccgggccaaagttgcatttcaatttaacaagtgtagataaataaagagggatgtctttggtatggtatccttcaagtgtcttcatggcatgcctaattaaattgggttaagaaaattatttgtaaaagctcaggggacaaggaagaagaaggtcgggaggtgaattcagatgattttcatttgtgctagctctgggagagttggaaaactctttcaggaattttttgggtctttctttagcaaacgcgtggctctatac

SEQ ID NO: 5856 - DNA, 945 bp, Diabrotica virgifera
  misc_feature (241)..(258): n is a, c, g, or t
  misc_feature (611)..(628): n is a, c, g, or t
  misc_feature (852)..(852): n is a, c, g, or t
  misc_feature (866)..(866): n is a, c, g, or t
agtaaattaaaaatactaagtaaacaaaaaattgatacatttaaatattcataataattttcccattgtgacataccaatttttatcgcttttgttgactttgaaaaagcctttgacagcgttaagcatcgggttattaaaaagctcactacacagtagtagaacagactaccgatacacagaattaatagacaacatctacagaaatgctacaaccagaataaaactgcacgaatatacnnnnnnnnnnnnnnnnnnaaaagagaaataatatagggtaacaccataccaccaaagttattgaatcaggtattagaagacgtatgcaagaaattacaacgggaaaataaaggaatcaaaataaatcattgagacaccttagatacgccgatgatatcgtcctaatagccaacagtaaagaagaacaggaatatatgctcgaaggattagaacaccaggcaaaaacagtaggtttaacaattaatctaggcaaaacaaagacgatgacaaacacagaacaagatattgctatcccaattcgaggaagtgaaatagaacaagaacgagaatgtatgtaattgggcaagtaataaaagcgagcagagaaaatnnnnnnnnnnnnnnnnnngacgtataagattggcatgggcggcatttggcaaattgagctacatcctgaagaataaaaaatttgcgcaacatcttaagtctaaagtcttcaaccagtgtgtgttaccagtaatcacgtatggagcgcaaacttggacactaaccaaaaataatatgaataaacttataaaaacacagagagcaatggaaacacagatattgcaaatacgcttgaagcacaanaacgaaccgaattnaaatcgaatgttacaaagttgaaagacataaagagaagaagtagccgaatctaaatagaaatttgcgaaagacaacatc

SEQ ID NO: 5857 - DNA, 136 bp, Diabrotica virgifera
gcgttcccagtttaagtcccccccaaccacctgaaaaataaaaaaaggctgaaaaataatctcgtccctaagctgtttaatttcaactcaaaatcacaccgacgaaaaacccccaaaatctctccccccaaaaagc

SEQ ID NO: 5858 - DNA, 788 bp, Diabrotica virgifera
  misc_feature (125)..(142): n is a, c, g, or t
  misc_feature (177)..(199): n is a, c, g, or t
  misc_feature (203)..(273): n is a, c, g, or t
  misc_feature (289)..(787): n is a, c, g, or t
agatttttcatttatctttcaaaatcaatcaaaatctctcttttcagtaaatagtaatagaaaaaatctttctcttcatcgatcagttaattcagtatccgtcgagatgaatcactttcactttnnnnnnnnnnnnnnnnnncattttttcggtaccttcgcgtatccagggattcnnnnnnnnnnnnnnnnnnnnnnnctcnnnnnnnnnnnnnnnnnnnnnnnnnnnnnnnnnnnnnnnnnnnnnnnnnnnnnnnnnnnnnnnnnnnnnnntaatgaaacgttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 5859 - DNA, 400 bp, Diabrotica virgifera
gcggcccggaactccctgccgccccctaccccgcgcccgactcacatatcttatatcatcaaataacttttgtcgtattcccagcgtcagagtgctactatggctattatacctgtaatttaattacatgacaccttgaacgagccatctcaacggatcctattatctgacgacaatatgtgtgaatggtattggagttggtagaagtcgatagttgctgtttacgaggggaagtattcaataaacaaattgagcggggagcagctgctgaatatcaatagttagcgactttgaggataatcacataacgcacaattcgagtgtaaacataaatttcttggatgaaatacaactttattttcgggtgaaatgtaggatgatattcgagcatgttttaacg

SEQ ID NO: 5860 - DNA, 232 bp, Diabrotica virgifera
  misc_feature (219)..(219): n is a, c, g, or t
gaaattttacagaattgacggtagatatctgcctcttattaacaagcaggggttgataagcaactttataggataatgctactgtcttagccacgttaatggagagtaaattacagtcataccaggtttttatcgtaagaagatcacaagtcataattgcatgaagagttgcaatagttgactcgctctaatattgatgtaaggctcggagataaatanctgctggctttca

SEQ ID NO: 5861 - DNA, 76 bp, Diabrotica virgifera
tttcgttcatgttctaaaagtgacaaagtctttccattttccatttaactaaatgtgttccacaatggcttccggt

SEQ ID NO: 5862 - DNA, 160 bp, Diabrotica virgifera
  misc_feature (21)..(21): n is a, c, g, or t
  misc_feature (46)..(47): n is a, c, g, or t
agatattcaccagggggattntttggcaatattatacgagtatatnnttagcatcatcatcttcattggctcacagccaaaatgggccccgaactgtttcaataatcccaaatatttaatcctatttccaaacttccgtgtccgaattccaatttccaat

SEQ ID NO: 5863 - DNA, 419 bp, Diabrotica virgifera
  misc_feature (180)..(180): n is a, c, g, or t
acaaatataatttatttgttacgaaaattgaattaaccctcaacaaacattacttttcacatttatgttttttacccgattctggatatgcgcttgtcacatggagtcacctgacatcgagggactccggacccctatatacatacaagcccggatcctccaggtaggtccaaactccancacggtcccggaacgatatagaccctgctgtgtgcatgggttcggtgctgacacgtgtgcgggccttgctctccacttctcactcaggcggagactcgctgcttgtgcgccatgacataagctaccgggccaaacctgaccatatatcgtgcaacccctgcatttattatggaaaaaacatgccgtctgccactgccctgactggcgacgtgccctcccagcatttaatgtgtcccgtc

SEQ ID NO: 5864 - DNA, 302 bp, Diabrotica virgifera
  misc_feature (215)..(215): n is a, c, g, or t
cggtgaacgtgacataccagtcagcgtggataacttggagacagcagacaccgctatgattgattatgatgtgtgcatggccgtagtagatccatcgatggattacaaatttcctgatttggcccaaacattgtcctgcactggagattttactggacgcgaagatttgtgttttgtcagtaacggatctccaaccatccaagatagagtcgtantacgtatttatcattctccaaccttagcgtgtggagtaatgggatcagctatgttaactctcaagactggaccttatgtctcgtgga

SEQ ID NO: 5865 - DNA, 166 bp, Diabrotica virgifera
  misc_feature (115)..(139): n is a, c, g, or t
tgtttgactctatcctggtcgggacccttactttcttgcaacgatatgaggtaccaacgccgaggatctgatgcgcgaactatcccttctccttattagaccatgaataggaggnnnnnnnnnnnnnnnnnnnnnnnnncactattcttccggtaaatttttctgt

SEQ ID NO: 5866 - DNA, 279 bp, Diabrotica virgifera
  misc_feature (265)..(265): n is a, c, g, or t
cgcttatagatagtgtgactacgactatgtctaaaatagtacttcttttgtttacgattggagctatggcagttttttccgccgcaaagcaagaacccacagtatgttattcctgtacaatttatgacggagatttgtgcaatgacctgaacctatctaaccgtacgaaagtaagatgcccagatatgccccagataataagacaacctcaggtgtagcttgttatactatttatcgtaccttgtatggtactacgttaactganagatgatgcaccta

SEQ ID NO: 5867 - DNA, 330 bp, Diabrotica virgifera
actatataaatcgcttctggcttattttgactaactatatcgtacactactgttgtgaatgtgtctgcagctaaattgttctctaattttgccgcaggtgtatctattttttcaggatttacagacatgtgttcagttggaatttcctgtaatatgtcttctgtattttgcaatattgttacagacttctctacttctataaatgtggtattaacatcaagagtgtctcgtatttcttgatttgtattctcatctcttttgagatcagtcttttgctgaatagctgcaacagtatcattttggtgggacggttgaaatgtcatcttcccc

SEQ ID NO: 5868 - DNA, 339 bp, Diabrotica virgifera
  misc_feature (263)..(263): n is a, c, g, or t
  misc_feature (274)..(274): n is a, c, g, or t
gtcatcattggtaacaataattttacagtatttttgaacgataaacaaaatagtagtgctgttaaggaacatttggaatccgaggttgaaaatagtagctacaagattgaaaactacgataatatcgagaagaaaatagaagaattgaccaataaagtcgaaggatatatatggttttcggagcactccagctttgctctgacagatcttgtccccaagaaacaccgattgctgaccgatataacacctgtttgcttgatganaggcgttcaanacgataatgatatccaaagcatgcgcaactgccacattaaagatgctgctgctctgtgctgctac

SEQ ID NO: 5869 - DNA, 126 bp, Diabrotica virgifera
  misc_feature (54)..(73): n is a, c, g, or t
ctcgatggcataacatatgcgcaattaacaaagataattcctatcccgttttgnnnnnnnnnnnnnnnnnnnnggaccaacaacaatgaaaaatgtgatataaatgtataataaactaataatagt

SEQ ID NO: 5870 - DNA, 256 bp, Diabrotica virgifera
gaagaattaacgaaatacgatggtacccaaccagatggaagatttcttgtagctgttaatggaaacgtttttgatgttaccaaaggaaaacgcttctacggtccaggtggtccatattcaccttttggaggcagagatgcttctacatgtttggctacttttgaggttaatgctgttagtgagaactacgatgacctgagcgatttaagcaccatggacatggattcgataaacgaatgggagtcacaatttcatg

SEQ ID NO: 5871 - DNA, 303 bp, Diabrotica virgifera
tacgcaccggagagagtctctttaggagtggaaagcagtgattccgatggggttgttgctagagtgatgggtcaagactacgtctacaactatggcgttaatcttgatctacggtacgatcagaggcaggctttgctagattatttgagagatgttagatcaattcaggatatccgggaggattttgtgaagagtgattctgtctgctgcgttgtgattcgagagtatacagatcatgctgtggtgaagtggaggccacgcgcaaacaaggatggatgtgatcccgccagatcttgggatcac

SEQ ID NO: 5872 - DNA, 362 bp, Diabrotica virgifera
  misc_feature (12)..(32): n is a, c, g, or t
tgcacaaaaaannnnnnnnnnnnnnnnnnnnnctcaagattattgtgattacgataaggtttctaaatacaatatgattagcaacagcaatcattatcctttcaagggtctaataattataaaactgactggacattgatattttaatttgaccctgtcaaattaaaagatgtcatccacttgttttattcaacatagataaccctaggggtaatcaaaacaatcgataatatctgctatctacatcgacacaataaatagtaaaagtaaaacatctactaactgaacaaaatgaatcaatcagctggataaagacaggtgattgtccctgtcctattaaacactgatctcactgttcaatc

SEQ ID NO: 5873 - DNA, 243 bp, Diabrotica virgifera
atccgaatccagtttgcggattatattccccgccgccgccgcttgcccccggtgtagtggagtcatatttctcgtacatcgattgagttttatcatatcccagtatacacgattctacataattcttcgccaactgctctgccatatctaaagctatggaattgttagtgttcttaagccctaagatgacgatctcttgtaaaggatgccaagcattcggcaagttccattgctcaccgctgt

SEQ ID NO: 5874 - DNA, 120 bp, Diabrotica virgifera
ttcgtgccgactgcagcacgaacggatgtacgtcttgaccttgattaactttaccgagtctcatatcgcaagttgtggatctacagctacgactgatatgactcctggtatctatacata

SEQ ID NO: 5875 - DNA, 206 bp, Diabrotica virgifera
ctcctgcctaattcggctccatgtgcccagttctgccaagctcgtgccgtattctgcacgatctgcccactgatttatttcaatagccacggtatgatgaccgtgctaaggtctcattatcattaatttatatattgatagctggattgaagggttggattatatataaactatcattatatcctttatagtgatttttattttta

SEQ ID NO: 5876 - DNA, 333 bp, Diabrotica virgifera
  misc_feature (226)..(226): n is a, c, g, or t
gtcacatataattcaggcggagccttctttcacttaagtgtcgtatatgggcagttggtgtatcatttgttaattctgaattttatacttataaactgttcagcactaatgtcagagttatatcatttctcctctcttgtttgcttattgtcgaagaagcattgcaaatttttccactgcttagtttttatcaatatattcgtgataaactgtcgtaaacatttanaaattcattagaatctagggacacattgataaattctattttgttgttatcttttaatctagtttcgtcgtgactagtctttatatcaatatgtaatgatcaacgtg

SEQ ID NO: 5877 - DNA, 299 bp, Diabrotica virgifera
cagctcgtgcccagttcggcgggagggacaaggtcctcgaatcatactgtttcaacttcaagagcaccatggaggatgacataatcaaggatcagatctgcgaaagtgacgacgctaccgtcatggagaaatgcgacgaggttcttgcttggttggatgcgcgtcatttagacgacgacgatgattatgacccctcccaacaggagctcgaacacatctgcgaccccctcatcgtcaacttgtacctaagtgccggtggagctccaagtggcaggtccggtggtttctcatgtggagca

SEQ ID NO: 5878 - DNA, 115 bp, Diabrotica virgifera
tgctagttggagtgtgacaaacttgcatgaagtttgtttattcaaacttgatacaaacttgctgaaggtttgtttttgttttgttgcatgaagtttgttttcacaaacttgatac

SEQ ID NO: 5879 - DNA, 412 bp, Diabrotica virgifera
  misc_feature (25)..(43): n is a, c, g, or t
  misc_feature (154)..(171): n is a, c, g, or t
  misc_feature (271)..(271): n is a, c, g, or t
  misc_feature (297)..(297): n is a, c, g, or t
  misc_feature (301)..(301): n is a, c, g, or t
aataaatataatattgtagtttcgnnnnnnnnnnnnnnnnnnncaaatgtccgcctatggattttttgtcaaaaaagttgacgttttttaattctctagtagtttttatgtcaacgtcaacctgtttgacaagtaatcataggcggaattttgnnnnnnnnnnnnnnnnnngcgaaactacaattttatatttatttcatttgttcatcaaaattagcttaaactcaaacaaaattagtatgactgaataggtattttcaatacctttcanacgaagtatcacttgccataaggtcncatntaaaattatcggtcacagtggctctgtaacgtcatctgtcactattacgtcacctgtcatgactagttaagatgcttacgtccggttaatttcttcctccaaatttcacta

SEQ ID NO: 5880 - DNA, 116 bp, Diabrotica virgifera
  misc_feature (5)..(35): n is a, c, g, or t
  misc_feature (111)..(111): n is a, c, g, or t
tctcnnnnnnnnnnnnnnnnnnnnnnnnnnnnnnngggtttccccaatttcataaaaaatatacatatataaacaataagtaaaagtaagagtagtagtaaagtccagtanaacag

SEQ ID NO: 5881 - DNA, 458 bp, Diabrotica virgifera
  misc_feature (14)..(31): n is a, c, g, or t
  misc_feature (251)..(251): n is a, c, g, or t
  misc_feature (286)..(286): n is a, c, g, or t
  misc_feature (302)..(302): n is a, c, g, or t
  misc_feature (307)..(307): n is a, c, g, or t
  misc_feature (345)..(345): n is a, c, g, or t
  misc_feature (348)..(348): n is a, c, g, or t
  misc_feature (374)..(374): n is a, c, g, or t
  misc_feature (416)..(416): n is a, c, g, or t
ccgattcaagtacnnnnnnnnnnnnnnnnnnaaaaaaaggattgatatggtaagagtaataagtaataatatacccttatatttttatcattttatagaaaattgtagactaaatatattttagtttaatgattcctaaaatttataaaactcaaacaactttcaagctgattatctcagaactataaaaactgcacttaaatcgttttacgtctgatcccctcaaatagtctctcgtcgttttggaatanaatccaatcaacgttttaggtttttcatttctcanaaaaatgtggagagtnctatntgctattgctattgtcactactttgagttttcgatatnctntctaatgtcttcttcggtgctttcanagtctcactcttcaaaaaccccttgatcttcaatatactgtntactactcacagtctaattgtcaaaatcttaactaatgtgtg

SEQ ID NO: 5882 - DNA, 367 bp, Diabrotica virgifera
  misc_feature (274)..(274): n is a, c, g, or t
  misc_feature (294)..(294): n is a, c, g, or t
  misc_feature (303)..(303): n is a, c, g, or t
  misc_feature (307)..(307): n is a, c, g, or t
  misc_feature (334)..(359): n is a, c, g, or t
cttgacggtactgtaggtgcatcaaaagcttggggatctcatggtctaaaacccgacacatttggaggtagagtggactattcccacaagccatctggatcttcagcttttgtaaatgctgacagaactcccggttacggaacagatgttacagctggtggaaaatacaatttcgcaggaggtaaaaattggggtgctgacgctagtgctggatataacaggcattttggaggacccggtggtaccggaaaaccccaagtgggcgctggagtanatgttcacggcaatttttanagaataatntatnttgtattattaaactatttataaatannnnnnnnnnnnnnnnnnnnnnnnnngaaggggg

SEQ ID NO: 5883 - DNA, 302 bp, Diabrotica virgifera
  misc_feature (106)..(106): n is a, c, g, or t
  misc_feature (138)..(138): n is a, c, g, or t
  misc_feature (235)..(235): n is a, c, g, or t
  misc_feature (239)..(239): n is a, c, g, or t
  misc_feature (244)..(244): n is a, c, g, or t
gaccggtaaattatatgacaaagtgacacaataattgtctgaaaaagcatacaaaatccttcaaagtgagagcttgtacagtaatttttgctaatgtgtttgctanattattggaaacatagtttcaaagtcgatttnttgaaaatcattaataacttttctaaaaatgcacaaaacctttaattttgcctgagaatagagaaaatatcacaagtaggtattcagctataaaatntcanatttnttttcacttaatagttactgcaaaattgaaataattaggcaacaagttaacaaaaata

SEQ ID NO: 5884 - DNA, 236 bp, Diabrotica virgifera
  misc_feature (92)..(114): n is a, c, g, or t
cggaactctttacacttatcccgaaaatttccgggccgcaaaaactctgattgccgcacaatatgccaaggcaaacgtcaaagtagcacccnnnnnnnnnnnnnnnnnnnnnnntaaaactaaagagttcaccaagaaatttccaagtggaaaggttcctgcttttgaatcaaacgatggcaagtaccttcaagacagcaacgccatcgcttactatgtttccaatgaacaactaa

SEQ ID NO: 5885 - DNA, 346 bp, Diabrotica virgifera
  misc_feature (32)..(56): n is a, c, g, or t
  misc_feature (84)..(109): n is a, c, g, or t
  misc_feature (161)..(161): n is a, c, g, or t
  misc_feature (211)..(211): n is a, c, g, or t
  misc_feature (289)..(289): n is a, c, g, or t
  misc_feature (294)..(294): n is a, c, g, or t
  misc_feature (300)..(300): n is a, c, g, or t
  misc_feature (316)..(316): n is a, c, g, or t
  misc_feature (329)..(329): n is a, c, g, or t
atctactatattaaccgtatttttgaccaagnnnnnnnnnnnnnnnnnnnnnnnnnccttttaaaatgataacaaactctttgnnnnnnnnnnnnnnnnnnnnnnnnnnaaagtggatacatttttacttaacataccacacatactatcctgttaatttnttgtttaggggagattggggcaaatagttcctcaacattttttagatcanaaataacaaaaaaacgatatactcaagttcaatttaatcaaccagtaagtggggtaactatagcagatcatttttctntgatnaatctncatcaaatctcctatnttctttctttttntaacacttttcctgctt

SEQ ID NO: 5886 - DNA, 250 bp, Diabrotica virgifera
  misc_feature (31)..(96): n is a, c, g, or t
  misc_feature (122)..(136): n is a, c, g, or t
  misc_feature (204)..(204): n is a, c, g, or t
  misc_feature (233)..(233): n is a, c, g, or t
cttggagaaactaacatcgttgacaaccatnnnnnnnnnnnnnnnnnnnnnnnnnnnnnnnnnnnnnnnnnnnnnnnnnnnnnnnnnnnnnnnnnntgcccccgccgaaaccaggtcctccnnnnnnnnnnnnnnnaagaaagccaaaaggtctggttccaatgtcttctccatgttttcgcaatctcaagtagctgaattcanagaagctttccaacttatggaacacgacnaagatggcatcatctct

SEQ ID NO: 5887 - DNA, 387 bp, Diabrotica virgifera
  misc_feature (14)..(27): n is a, c, g, or t
  misc_feature (29)..(41): n is a, c, g, or t
  misc_feature (100)..(100): n is a, c, g, or t
  misc_feature (121)..(121): n is a, c, g, or t
  misc_feature (173)..(173): n is a, c, g, or t
  misc_feature (187)..(187): n is a, c, g, or t
  misc_feature (191)..(191): n is a, c, g, or t
  misc_feature (194)..(194): n is a, c, g, or t
  misc_feature (245)..(245): n is a, c, g, or t
  misc_feature (256)..(257): n is a, c, g, or t
  misc_feature (362)..(379): n is a, c, g, or t
gtgacgtctagctnnnnnnnnnnnnnncnnnnnnnnnnnnnccaaagtgattattgttcgttcttaaattgtcttcgatatgaacctccaatcggaatanaaaataagttttaagtgcatnttaagggcaaataactgaaaaacaacggtaaaaattgatgtttttttttcanacttgcgaaatttntcanatntttgattttttagccgatttgaggtttatatcgaagagaaacttgtaatanacgaaaaaatnnttggatttttgaatttatgcggaaattacgaactctacatgtcacgcaagcgacatgttcgtgcggcgaatttcacgggttgcggcctacacctaacaatgctcnnnnnnnnnnnnnnnnnncttaaaaa

SEQ ID NO: 5888 - DNA, 354 bp, Diabrotica virgifera
  misc_feature (102)..(102): n is a, c, g, or t
  misc_feature (260)..(260): n is a, c, g, or t
  misc_feature (294)..(295): n is a, c, g, or t
  misc_feature (297)..(297): n is a, c, g, or t
  misc_feature (299)..(299): n is a, c, g, or t
attcggcacgagacggagcagaaactctcacgctcacaaaaacaacagcactaaaaatgcgagtggcataaaggcgcatcaaaagatcgattgtcggcgtcncaaaaaagatggaccagaaaactaattgactggcgcccaacgcagcagacgacgaccaccaacacgctggatggacgacaagaatgttcaagaaatggcaccaagacgcacagaaccgtgaagagtggcgaaaaatgggagatacctatatccaccantggaaagacgaagttgcatgatgatgacacttannananaactatactaaaatcagataagctatgtaattgatgttaacataagttaacagcg

SEQ ID NO: 5889 - DNA, 281 bp, Diabrotica virgifera
  misc_feature (263)..(263): n is a, c, g, or t
tggcggtcgctctagatctagtaggatctcccatggctgcgggagctcggctccagggggggcgcctgtccacttctggaccatggataattgctacaacaaaacattggccgtcctattatatcgtcttgattgggaaaaccgatcgtaaatcggattactcggcttgcagctcctctgccattcaccatctggcttggtaccaagtaggcgcgcgtcgatcgcccttcacaccattggcggaggttgaatggcgaatgganaatcgtaagcgttaagat

SEQ ID NO: 5890 - DNA, 333 bp, Diabrotica virgifera
  misc_feature (225)..(252): n is a, c, g, or t
  misc_feature (279)..(279): n is a, c, g, or t
  misc_feature (302)..(302): n is a, c, g, or t
  misc_feature (309)..(309): n is a, c, g, or t
  misc_feature (314)..(314): n is a, c, g, or t
  misc_feature (319)..(319): n is a, c, g, or t
  misc_feature (325)..(325): n is a, c, g, or t
cttaccatagacaccgatggaaacttatggttaacagcaatctttggttcaactctagtcaaaattaacccagatgatggcaaacttctggaaaaaattgttatgtctaccccacaacctacttcaatttcatttggcggcaagaatctaaacgaaatgtttgttaccactgcaagaattccagttgatggcaagattccgcctaatcctgcaggaacaacatannnnnnnnnnnnnnnnnnnnnnnnnnnnttcaaaggggatagaatacaatcgtanactataccgtgtaatagtgtctnttatatnatatntaatntaatanactatgtg

SEQ ID NO: 5891 - DNA, 385 bp, Diabrotica virgifera
  misc_feature (31)..(48): n is a, c, g, or t
  misc_feature (196)..(196): n is a, c, g, or t
  misc_feature (203)..(203): n is a, c, g, or t
  misc_feature (360)..(360): n is a, c, g, or t
  misc_feature (379)..(379): n is a, c, g, or t
cttacgttgttaacattgtatcgttggtgcnnnnnnnnnnnnnnnnnncaccatattctacctagttggctatgactttgacactaaactttcttaaacattagacattatactatttttatagttccagttgcttgttaccattgctaatatgaatttatctaatggggaactgattagtatggtattgatctangacctangagagtataacaaaaatgtagtactagcactaataatttatcatctgccattccctgatagacgacaaccaagatacttttttagaatagtttcgacgtattgacatttagattacgagaacgttcgtactaatatgcagattctcaatgacactancgattacattttaatcatntataat

SEQ ID NO: 5892 - DNA, 336 bp, Diabrotica virgifera
  misc_feature (164)..(164): n is a, c, g, or t
  misc_feature (249)..(249): n is a, c, g, or t
  misc_feature (252)..(252): n is a, c, g, or t
gacagaaagtggaaatgtcaaaaaagaggagacgaccccctttcataatgaccgattcaattatatataaattcaactgttaattctgacactattaatttgtacggcatgtaagacagtgtagcttcgctaacatgtttgattggttgcgatacaataatatntgatgagttgttactgtgacagaattatgtcaccttactgttttcagctcccggactaacaggcgccgaaagtgttttacaaaanctntttttatacaatgatttatgtggttgattgatttatgagggaccctaatttaaagaaagatctctaccgagttgtttacatata

SEQ ID NO: 5893 - DNA, 346 bp, Diabrotica virgifera
  misc_feature (211)..(211): n is a, c, g, or t
gtttcatcatccgacgacggccagtggtcagagggtctaatatcagctgccaggttagttgcagctgcaacacacagtcttgtagagagtgcaaatgctctagttcaaggactgggcagtgaaaaaaagctaatagcggccgctaaacaagtggcgagctctactgctcaacttttagtcgcatgtaagggtaaagcagaaggtgatacanaagcaaccaaaaaattgcacgctgctggtaatgctgtaataagatctaccgataatttggtaagggccgctcaacaagcgaaaagtgtggaaaaaaaagatacttaattttgaataaaaaaatggttggtggaat

SEQ ID NO: 5894 - DNA, 477 bp, Diabrotica virgifera
  misc_feature (12)..(29): n is a, c, g, or t
  misc_feature (242)..(242): n is a, c, g, or t
  misc_feature (304)..(304): n is a, c, g, or t
  misc_feature (330)..(330): n is a, c, g, or t
  misc_feature (356)..(356): n is a, c, g, or t
  misc_feature (363)..(363): n is a, c, g, or t
catttaatatcnnnnnnnnnnnnnnnnnncaacaattaatgttcacttgaataaattagatttatcaacaatgtcttcttcttatcttcaatatcttcttattcttcgatatcttcttattcttcaatatcttcttattcttcaatatcttcttgttttcgttcagaaagccgactctgtatttttcgattgatagataccgaagtaccttaattataattaaatcaatttattagtaattnacactgctgaaagcagcttcggctagtccacccataggaacttgacttcttatcagtgccanaaaacttgactatgactggtattatnttactgttagtagttaaaatataatnttattanaactaggttagattaataatgtatggatcttactttcaatattctttttaaatttacactgtaagtttcttaactcacttatttaaactttgcaaataatttggtgatttttct

SEQ ID NO: 5895 - DNA, 243 bp, Diabrotica virgifera
  misc_feature (214)..(214): n is a, c, g, or t
tgtattaatattatatctgtgtattaagattatcttaaacttaatataacatataatcaacagcagaagatgcaaataaatatcaataagtaatggttggaggtctaccatattccatatcccacctgtcccaaactaaaatctagtcagcattcggaacacataccacttttagatctttattaatttcaaaaaatatcacgtttgcaagatntataacaacagattatgcaggccagctga

SEQ ID NO: 5896 - DNA, 327 bp, Diabrotica virgifera
  misc_feature (149)..(150): n is a, c, g, or t
  misc_feature (159)..(160): n is a, c, g, or t
  misc_feature (166)..(166): n is a, c, g, or t
  misc_feature (246)..(246): n is a, c, g, or t
  misc_feature (272)..(274): n is a, c, g, or t
gtttaatagttaaaattgcagcaaagaaaacatgctgattaaagaataccgtgtgaccctacccctcacagtcgaagagtaccaagtggctcaactattcagcgtggcagaggcttccaaagacaacactggcggcggagaagggatannaatattgannaatgancccttcaccaatttccccttactcgggggtaaatacaacagcggacagtacacttacaaaatctaccatttggccagcanagtaccggcgttcataaggctcctgnnncacgaagggagtttggagatacacaaaaatgcttggtatgcttacccatattg

SEQ ID NO: 5897 - DNA, 393 bp, Diabrotica virgifera
ttgggctgtagtgccattggatggatggatggtatgtgacttaacaaaaaccgacgtgcgactacgttgaaactcgtcgccaaactcgaaaccaacttttgacggtcgccatcatgtacaggattatcagcatccaaaataagagcaacacatattcatttaatttttaaatgtcttacaaaataaatatcacgtttgttgttggataatgaggtggcatcgattgctcaacacgagtgcactagtttcaataacgctttgtcagctattcaatatcattcttaattcacggccaaaccgagtcagcattataaacatcaacacttctctagttttattataattacaaaataacatcgcggatcattctattatcaatgatcattcgtgatg

SEQ ID NO: 5898 - DNA, 285 bp, Diabrotica virgifera
agtggaaccacaggtaggccaggttgagagtagtagaacctctttgagccacgagttcccggtatctgattgcagtatcgaaaaaggttgaacacagcatcaccacagaagcaggaaacgagagctatacgagctagtttcagaggagaacattactggagaccatgacgacgtttagattgcagcccaggataccaggaagagggtctcgtgtgaagacattctcagttcaccagacaaaggtcagtctcgtatgtttggacatgaatgtatggaattttcgta

SEQ ID NO: 5899 - DNA, 270 bp, Diabrotica virgifera
gtcgtgtccaatccagctcgaggtatggtaccaatccacttacttattgcaccaagaccggttatcccaccagaactgatccgttatcacacaagaactcatcctcttgtagagagagtcctaccagtatgtagaaaaacttccgcctatcttgattcctccatccgtctatcgactcacctactgcgaacactagaatccactgttccgcaagaatagatttcccattcctccaccattggtttcccattacttcaccaggttcaaccc

SEQ ID NO: 5900 - DNA, 155 bp, Diabrotica virgifera
  misc_feature (29)..(44): n is a, c, g, or t
  misc_feature (61)..(78): n is a, c, g, or t
  misc_feature (118)..(118): n is a, c, g, or t
  misc_feature (122)..(122): n is a, c, g, or t
tgagaatagtacgtggtaaaaaccagtgnnnnnnnnnnnnnnnngccgattatcccctccnnnnnnnnnnnnnnnnnncatgccttacaatataatgaaacatacacaaaatattatnactnacggaatgtgaatgataaaataaaaacataaga

SEQ ID NO: 5901 - DNA, 189 bp, Diabrotica virgifera
gtcgtgcccaggtcagcgcgatggctaacactcgttcccggtatagccactatgttcacctgatcgattcacgttgtgtatctgaacgatttacattctgtcgtcctacacttatttcgccgacgagatgactgtcgctcgccgaatacatgatcgccgccatatcaatcgtcttacacctaccttaca

SEQ ID NO: 5902 - DNA, 187 bp, Diabrotica virgifera
tggaaactccatcagaaaattccacaagagaagacaactccaccacaggagaagatatggatacaactaatgaagattgtgatcccggcaacgaaaaaccgacgcaagttaacttggaatccgaggaaagttctactaaaaaaagcatggatagtgaatcaatcgaagacgatgatgatatggatga

SEQ ID NO: 5903 - DNA, 185 bp, Diabrotica virgifera
  misc_feature (54)..(75): n is a, c, g, or t
  misc_feature (115)..(116): n is a, c, g, or t
  misc_feature (119)..(119): n is a, c, g, or t
  misc_feature (123)..(123): n is a, c, g, or t
  misc_feature (139)..(175): n is a, c, g, or t
cttgtcttctccaaaccaggagatgagaaatagatatatgtccttgtatattgnnnnnnnnnnnnnnnnnnnnnnctttgtttatttgaataaaatattcgaggatgaaaaaatnngtntatntgaatattatattccnnnnnnnnnnnnnnnnnnnnnnnnnnnnnnnnnnnnncatattcttc

SEQ ID NO: 5904 - DNA, 182 bp, Diabrotica virgifera
  misc_feature (84)..(107): n is a, c, g, or t
  misc_feature (114)..(137): n is a, c, g, or t
gatgaaaacttgtgtggtattaacctcatgaactcttaccctaaattgtaaatgatttaatgcaaatgaaacaccaaatagaannnnnnnnnnnnnnnnnnnnnnnncctaccnnnnnnnnnnnnnnnnnnnnnnnncttcaacacctctatactcataaaaaaaaactactttctcctctc

SEQ ID NO: 5905 - DNA, 358 bp, Diabrotica virgifera
ctcggggcggattccggacaacttcgtcccgagtgcggcccaaggcccccaggctgcgtgggggggaaatttttcttacttttctagggttttcggctattatcaacgctgctccaaagttcaaatcagacataaagagctgctacaaagaatcgtgcccagaggataccttcgcatgtgaaaagactagtaaaatttcaccagaccgaaaacatattttacacgagattcattgtctcggactgaaggatgattcttaaaaaatataaccagttctgtgccaaattcctttggccacgcattatctacgcaagttatcaatacagtggtactattgaataattcacaccattacccg

SEQ ID NO: 5906 - DNA, 338 bp, Diabrotica virgifera
gttttatgaaaaacagacgggaatttctataacaggtacagccaatctcaaatcagtcgatatcagcaacagttcagacaaaaaatggagtttgcatttaagttatgtaaaagtataccaatatttgaacagtaataacccggcatactatgatgtagacagatcaattgatcaagatactcaaaatatgccatatgaacctccacccacaacgatcacagaatcaacaaccagtactatgacaactagtactacaacaactagtactgtaacggaaagtacaactgaagatactgggaccactaagagttctacacctacaatggaaagtacaactg

SEQ ID NO: 5907 - DNA, 201 bp, Diabrotica virgifera
ctcgtgcccaatccagaaccaggactcgggtgttttatgtgtaataaggagggtttttaatactttattctataaccacaccccccacactaatctgtcaactcaaggaggaggaattttcttttggaaacacaaatctgttgaaacccgtactccaccaaccccgtggaaggttaatagtccttggattttaaaggcgtt

SEQ ID NO: 5908 - DNA, 609 bp, Diabrotica virgifera
  misc_feature (157)..(172): n is a, c, g, or t
  misc_feature (536)..(555): n is a, c, g, or t
agattttactaatatttcaccactcgttgccggtattatgaaaacggaaaatgaagaaattcgacgtattattgaaaactatatgaaatcaaataatattgtgttggatatcaaagaagaaccagaagagaccgatgatgaaatggacgtcgaattnnnnnnnnnnnnnnnnaaaacagaaaagcgagagttttcaccagaagaactggaggaactttacgagggtatccacagtttaacaccgcagtgtttggacacagtttcaagtattttggacatacacgataattggaaaaatctggctcaattattggaaatggaacatttagttgatagtggtatgatcaaatccgaagcgaaagcaattttgactcatgcaatcgaggccaaccacgattggacaaatccaacctgtatctttgcgttacgtaaactttttggaaaacttggacgagatcgaaactgttgaggtatggacaaaatggtttttgaacttaaaaaatagacataactcattattgatgtacataaatggnnnnnnnnnnnnnnnnnnnntagatatcaacgtaccttataatctaatgtattttttaataaaagattatttac

SEQ ID NO: 5909 - DNA, 164 bp, Diabrotica virgifera
ctcgcgccgcacaccgcacgcgttaacggaacgcaccccgaacattatggctagggataccgtggcgtgaatcttataagcgtatggataggacattagaggtaaatgtatttgacagttttgagaaaagttattaacccaggggggggcccagaacccctttg

SEQ ID NO: 5910 - DNA, 403 bp, Diabrotica virgifera
  misc_feature (13)..(48): n is a, c, g, or t
  misc_feature (50)..(93): n is a, c, g, or t
  misc_feature (156)..(179): n is a, c, g, or t
  misc_feature (206)..(223): n is a, c, g, or t
  misc_feature (272)..(302): n is a, c, g, or t
  misc_feature (312)..(359): n is a, c, g, or t
  misc_feature (362)..(382): n is a, c, g, or t
ggaactagtctcnnnnnnnnnnnnnnnnnnnnnnnnnnnnnnnnnnnntnnnnnnnnnnnnnnnnnnnnnnnnnnnnnnnnnnnnnnnnnnnnatttttaatacaaaaaaaagcgggcgaaaaaaaaccacaacgggggggggcgaaaatgcttcnnnnnnnnnnnnnnnnnnnnnnnnaaaaaaacggggggacaccccccttannnnnnnnnnnnnnnnnngccggttttgggagggggaaaaacccccttaaaaaaaccccccctctgnnnnnnnnnnnnnnnnnnnnnnnnnnnnnnncttggggggnnnnnnnnnnnnnnnnnnnnnnnnnnnnnnnnnnnnnnnnnnnnnnnngcnnnnnnnnnnnnnnnnnnnnnggggaacccgggggggccccc

SEQ ID NO: 5911 - DNA, 82 bp, Diabrotica virgifera
aatcagagtaataacaaaatagttggagactattcgttgacaagatgaattcaagtattttgggagttttaatggggttggg

SEQ ID NO: 5912 - DNA, 324 bp, Diabrotica virgifera
gtcctgcctactgtcgatggatgtccggtcttctgtcttaggttgatctgtacacctgcctcattacagccagaaaccgaactcttgagaggtagaaacaaatctatggcgacgtcaacacgtctacatattctggacgactcgtatacagcttctggatggactggaacatggacccaatggatataaactggtgacccaatgggtctagattggtgctggaggcaatcctcgctaccactgtatgcagtacgctctcactctctctctcgttctcactctcgctctaactctcactctcactctcactctggatcaatctct

SEQ ID NO: 5913 - DNA, 164 bp, Diabrotica virgifera
atcatgtccatacggatgtaaactaagtgcaaatggaggtcccattttgatcgatggaggtaccgctgagatcgatggatctcatgctgaaatcggcgctttttctttccatattggtgaatatacaatcgattgcggcgaaattgatctacaacgcgacatta

SEQ ID NO: 5914 - DNA, 114 bp, Diabrotica virgifera
  misc_feature (9)..(38): n is a, c, g, or t
  misc_feature (41)..(67): n is a, c, g, or t
  misc_feature (78)..(96): n is a, c, g, or t
ctagtctcnnnnnnnnnnnnnnnnnnnnnnnnnnnnnnccnnnnnnnnnnnnnnnnnnnnnnnnnnnggccctttcgnnnnnnnnnnnnnnnnnnnctcaaaaacaaaaccccc

SEQ ID NO: 5915 - DNA, 157 bp, Diabrotica virgifera
taaattgaatcttaatgaggggtttgcctcatcttgaccaaaaaaacacattagtaactctaacacatggattcagtctttgatttatgataaaaaggtcaaaatgtcgtcacacatcgtactcccctagaaacatatccctaatgtccaagggggg

SEQ ID NO: 5916 - DNA, 373 bp, Diabrotica virgifera
  misc_feature (211)..(211): n is a, c, g, or t
  misc_feature (292)..(292): n is a, c, g, or t
  misc_feature (306)..(306): n is a, c, g, or t
tcgacacgtgccgtttcatacaagtataaatatgaattttttgcatgtagctttattttctcatttcttatattgtttctgtagaactaaaagtacattaaatgtactcggaggtaaactacactatgtcatttcgagcaactgtgtttagcgtatgtttgcaacaaagtttagaacacttgggatgttaataaaaatctgatataaaatnggttgaaagacaatataaccatattttaatgataatatataactgatttgtataatccaactaataaaataagtggattanagaaactcgttcanaacaacaccatgtcaacatagtgtagttagcctccgaggcccaaatttttgttccaaacttatcgta

SEQ ID NO: 5917 - DNA, 232 bp, Diabrotica virgifera
gtgattcaaaatgtgagtgaacgtggtccatcatatacacaactttttgtggcaaattgtttccttttaaatgtcttatgacttctggtacaaatttgactgactacagataatacagtggactctctctgtaacgaacacggatactaccaggtttcacttatgacgaagtacagtatatttctcatgaaattcctattgatctataacaactctgtaacgaagcatattt

SEQ ID NO: 5918 - DNA, 300 bp, Diabrotica virgifera
  misc_feature (14)..(90): n is a, c, g, or t
  misc_feature (95)..(154): n is a, c, g, or t
  misc_feature (181)..(223): n is a, c, g, or t
  misc_feature (225)..(266): n is a, c, g, or t
attcggcacgagcnnnnnnnnnnnnnnnnnnnnnnnnnnnnnnnnnnnnnnnnnnnnnnnnnnnnnnnnnnnnnnnnnnnnnnnnnnnnnggaannnnnnnnnnnnnnnnnnnnnnnnnnnnnnnnnnnnnnnnnnnnnnnnnnnnnnnnnnnnccctgttttccgggggtttataactannnnnnnnnnnnnnnnnnnnnnnnnnnnnnnnnnnnnnnnnnncnnnnnnnnnnnnnnnnnnnnnnnnnnnnnnnnnnnnnnnnnngggtagaaaatttttcccccttaaaataaccccc

SEQ ID NO: 5919 - DNA, 89 bp, Diabrotica virgifera
ctcaaaatacattaccagatatcttttgatacaattcgcagaagtttccgtgacaggatcctatactacatcatggcctcttcttctgt

SEQ ID NO: 5920 - DNA, 248 bp, Diabrotica virgifera
gacatgtccaccccgtatgatctccttacatccagttgtagtaacttttatttgggcttctttggatgcttcttccatcttggtagattcataaccttccatatctgcgttgctaccatcgatatggtctctttctgtgatcaatactcgtccaccacatgctcttggtgattgtgcataatctttgcccacatctccgtatctctctacgatactgaccttaccatcgagcattacatctgtcgctc

SEQ ID NO: 5921 - DNA, 348 bp, Diabrotica virgifera
  misc_feature (9)..(53): n is a, c, g, or t
  misc_feature (66)..(86): n is a, c, g, or t
  misc_feature (90)..(110): n is a, c, g, or t
  misc_feature (229)..(249): n is a, c, g, or t
  misc_feature (266)..(320): n is a, c, g, or t
ctagtctcnnnnnnnnnnnnnnnnnnnnnnnnnnnnnnnnnnnnnnnnnnnnnctggggaaaaccnnnnnnnnnnnnnnnnnnnnnccannnnnnnnnnnnnnnnnnnnnccccattttggattaaattttaaaatggggtttccccccaaattattaatttctttccaattttaaaattttaccaaaaccaattttaaaccggttttaacccgggggggtcccacccnnnnnnnnnnnnnnnnnnnnnccccaaagggagcaccnnnnnnnnnnnnnnnnnnnnnnnnnnnnnnnnnnnnnnnnnnnnnnnnnnnnnnntcgggggggggccgggtcccactccccc

SEQ ID NO: 5922 - DNA, 268 bp, Diabrotica virgifera
  misc_feature (233)..(259): n is a, c, g, or t
aaatgagctatcgacctgttagtaggactaagaacttgcatccatttaaatgctataatccttcttccacgcgaacagaagataaggtttctttaggattacaatttttaagtgtgacatttaatttaatatttactttattccataaaatgcttagagcttcagagattgtctcacaggccaaatgaaatgtcaatgaaaattgacatgtgacagaacataaaacacttatnnnnnnnnnnnnnnnnnnnnnnnnnnncaggggggg

SEQ ID NO: 5923 - DNA, 272 bp, Diabrotica virgifera
gtaaatatggatactcttgatatattcttgttgctttttttcatatgttctataattaattacgtaataagtgttttcatcaattactggaccctgaaaaccattcctcctgaacaaacacggagcaagtattatatatttaattgtttgagtaacgccagtaccacttactgtatccacgaccacctccaaaagatagttaagcttctaagtattcttgcaaggcaaaatactactgcttggatatcaccactggattcccagttaaaact

SEQ ID NO: 5924 - DNA, 309 bp, Diabrotica virgifera
  misc_feature (290)..(290): n is a, c, g, or t
atttaaaggtactcacatcattttggagggttccaacgtcgagaaactcgacggtaaacctaagatgaacggacaagttgtcaatgctagcagcaaggaagatatttataatcaaacctttcaatgggaaattgtatgcatagagtgttgagtctgcaatgtcagataagtctcacattgactgtggatcagtacgacgcaacgattcccataggagatccatttccggagccagcaaaagtattgaacaatctgatattgaaagtatctctttagctagtcccgatgcnttttcattattttaattct

SEQ ID NO: 5925 - DNA, 280 bp, Diabrotica virgifera
  misc_feature (41)..(69): n is a, c, g, or t
  misc_feature (75)..(97): n is a, c, g, or t
ctaggtagccagtttttgtttatatcatttatcctaaatgnnnnnnnnnnnnnnnnnnnnnnnnnnnnnacgtannnnnnnnnnnnnnnnnnnnnnncatataaaccatcctggctcactccgatttatactcagatcatgtcaaatctgaaaagtcgaactgacttattaatatctctgctactccaattataaattttaatcccacatcgatgtcacaatctatttcatcgatatgatctctatagtaaaatcaagctgtgatccctatggtaattta

SEQ ID NO: 5926 - DNA, 251 bp, Diabrotica virgifera
  misc_feature (4)..(30): n is a, c, g, or t
  misc_feature (32)..(48): n is a, c, g, or t
  misc_feature (137)..(156): n is a, c, g, or t
ctcnnnnnnnnnnnnnnnnnnnnnnnnnnntnnnnnnnnnnnnnnnnnctttgaaatttaacccgaattcccaattaatttgtccccaaaaatttcaaaaagggtggtttttccaaggggaaacccccccgcaatcnnnnnnnnnnnnnnnnnnnngggggaaaccatttatccctggaaaaatcccccatttgaaccgggaaagccatgccccccccccctagtaattcctcaatttccgccaaggggaa

SEQ ID NO: 5927 - DNA, 272 bp, Diabrotica virgifera
  misc_feature (24)..(66): n is a, c, g, or t
ctcgtgccgattcggacaccagcnnnnnnnnnnnnnnnnnnnnnnnnnnnnnnnnnnnnnnnnnnnccttggtttcccccaaattttttctaattttggggcctccccctttccccccacgggggtcaaaatctaaaaaggggcctaaaatttttaaattccccccccaaaacaaatgccttggaattccccaattaaaaattcccacctaaaaccccctccccctttaccaaaaccttttcgggaacggaacattccggtttgggaacccc

SEQ ID NO: 5928 - DNA, 272 bp, Diabrotica virgifera
gtcctacctatcccttgcgtcgcctcctgagtcccggacgatgtgagctatgtcgactccgtccccgcatgcgctccaactgatgcgagctatgtggacacgttgacctgttcctccccatctggagctatctatgcagacgactctgaccgaccgaacttctttggccctcactacatcatatcctccgagtggcggggcttcgccacccatcttgccatctaagacttagactgaccacgcttcgacacacttttcggtggcttgtctga

SEQ ID NO: 5929 - DNA, 355 bp, Diabrotica virgifera
cacaggactccccgcggtggcggtcgctctataacgaatcgcatcccgcgggctgaatgaagcccgaattagctaaaacataacaagtatgtcctgatctgataatcatcagcttggaacgtcgatagttaccaccccgtgtcaagcaacatctttcgtgacgtgtagcactactacaacccagtattgtccagataatcttggctgacctcaccgaggaggtgcccccgtgcacatgtccacccatccatgctcccaatttttcgtcgggggcggcgtggtaaacgcgcatttctggttccctcagtttgatcggtgttgtgtcacctacagcgccaaatgcgcggtgtattgt

SEQ ID NO: 5930 - DNA, 238 bp, Diabrotica virgifera
aatgaagtccgaactaggagaatattcgtgttgatatcacattcgcaacatttcttaaacggagtatgcacaaacataatacacataaataaaaaaaggctcaaatattataccggcaataatgacaccattgtcaagactagaatggaacttttggaagatcatatgatacagtattattgggatcaagatcgtatctcccatatgaagaactatattgcacgatctggtcacagat

SEQ ID NO: 5931 - DNA, 218 bp, Diabrotica virgifera
  misc_feature (191)..(191): n is a, c, g, or t
ctcgagttttttttgttgtctatgttaattcgatgtaaagttaacttaaatgaatctacataaagtagatttctagtttctgggcaccaaaaaggtccttccgcatgctgtactgctgtggttactttttcaatgacatacgtgtagcaacagttaaaaaacaaagtatataatataatagtagttatttntaaaagccgcataatgttggtctgggt

SEQ ID NO: 5932 - DNA, 209 bp, Diabrotica virgifera
  misc_feature (157)..(157): n is a, c, g, or t
  misc_feature (174)..(174): n is a, c, g, or t
ggaatgtgtggctcttgttggacctttagtacaactgggtcagtagaaggagctcattttcttaaaactggaaatctggtatccttaagtgaacaaaatctagtagattgcgcaaaagacacttgctatgggtgtggaggtggctggatggacaaanctctggaatatatcganaaaggaagaataatgtctgagaaagattatcctta

SEQ ID NO: 5933 - DNA, 187 bp, Diabrotica virgifera
gtatagtaactttttttattcgtagacattttattcatagattttacctaaaataacgtaaaatcaacaatagtaagtgtcaatacacattaataagtagtatatggaggtcttgcatatttcctatacaaattgttccaaaacacaattttgtcagaattgggaagacctttcaccgtaagatcat

SEQ ID NO: 5934 - DNA, 238 bp, Diabrotica virgifera
  misc_feature (154)..(154): n is a, c, g, or t
  misc_feature (168)..(168): n is a, c, g, or t
  misc_feature (220)..(220): n is a, c, g, or t
gatttggttacagcagtggttaccgagcttgctattctgccttgtacaagtgtaccagtagttttgagaattatcgctacagaaactacctaaagactttttactgttttattgtattaaccgagtttattttttctgattaaatgtgtaatanaaaacgaagtttanataaaactggatggattgcgtacttgattggacaattatctctcctccagtnatccatcctcaatatctc

SEQ ID NO: 5935 - DNA, 150 bp, Diabrotica virgifera
tgtaattctgaactttacgtcatgtaagtactcacttaacgtaaaggatacagcgtaccccccaataataaataactaatagatgttccatgggccaaaatattcactgacgaaaatctaacttaccatgaccgtcgtatccagaaaatc

SEQ ID NO: 5936 - DNA, 251 bp, Diabrotica virgifera
  misc_feature (51)..(68): n is a, c, g, or t
  misc_feature (87)..(104): n is a, c, g, or t
  misc_feature (111)..(115): n is a, c, g, or t
  misc_feature (117)..(117): n is a, c, g, or t
  misc_feature (119)..(119): n is a, c, g, or t
  misc_feature (121)..(150): n is a, c, g, or t
  misc_feature (152)..(152): n is a, c, g, or t
  misc_feature (155)..(156): n is a, c, g, or t
  misc_feature (158)..(159): n is a, c, g, or t
  misc_feature (161)..(161): n is a, c, g, or t
  misc_feature (164)..(249): n is a, c, g, or t
ctggaaaggactcttacgaactcagatacttccagatcgacagtcgagaannnnnnnnnnnnnnnnnnaatgaataatttattcagnnnnnnnnnnnnnnnnnngattatnnnnnanancnnnnnnnnnnnnnnnnnnnnnnnnnnnnnncnccnncnncnccnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 5937 - DNA, 237 bp, Diabrotica virgifera
aatgtaactttgtaccttttttttcacatatcaataatgatataaatatgttacatatggatatggcgattataataaacgaacgaatgtttaattttgtgatcttccttttgtaatacgtacgtgcatttacaaattatttttttaagtgcaattgttcaaagagaactactgttaattaagttatttaagattgcacgaaacgcaggatatgttattaatacatcatgattattg

SEQ ID NO: 5938 - DNA, 380 bp, Diabrotica virgifera
  misc_feature (3)..(35): n is a, c, g, or t
  misc_feature (67)..(92): n is a, c, g, or t
  misc_feature (107)..(134): n is a, c, g, or t
  misc_feature (233)..(281): n is a, c, g, or t
  misc_feature (347)..(368): n is a, c, g, or t
tcnnnnnnnnnnnnnnnnnnnnnnnnnnnnnnnnncccccccaaattttcccccttaaaatttgggnnnnnnnnnnnnnnnnnnnnnnnnnnccaccccggaatttnnnnnnnnnnnnnnnnnnnnnnnnnnnncccttccccaaattcccctattttttccaaaaaataacccccccccgggtgaaataccccccccctttataaaaactttttgggggggaaaaatccccnnnnnnnnnnnnnnnnnnnnnnnnnnnnnnnnnnnnnnnnnnnnnnnnngtcttttttccccttcacaaacttggccaagggtaaagggcccctccaaaaattttggggcccggnnnnnnnnnnnnnnnnnnnnnnccccgttttggg

SEQ ID NO: 5939 - DNA, 62 bp, Diabrotica virgifera
ccccggcctgaaggattccggaccaagcttcttcccaaatccggaccaagtttttttttttt

SEQ ID NO: 5940 - DNA, 263 bp, Diabrotica virgifera
  misc_feature (244)..(244): n is a, c, g, or t
gaagatttgcagataaatgtagtttcagatacatgttggcttcatgtactgctttggctgttaggatgtagctggtttgatgtaagcttcataatgtaagctgaagttgtatttttcaggtatatgctgtcatcttcatggtccaatgcgtagtgtaccacgtggtttgcgtgtcccaccaaaaaaaaggtcaagacggattcaaatcaaaacaggagacattgtgctagcgacagtataaatnttaatagcatagaatatgg

SEQ ID NO: 5941 - DNA, 122 bp, Diabrotica virgifera
  misc_feature (50)..(73): n is a, c, g, or t
  misc_feature (93)..(120): n is a, c, g, or t
caggcgatgtcgattttttaaaggaattgcgcaaacaaagactaaatggnnnnnnnnnnnnnnnnnnnnnnnngtgtttctctcgttttagcnnnnnnnnnnnnnnnnnnnnnnnnnnnnca

SEQ ID NO: 5942 - DNA, 218 bp, Diabrotica virgifera
  misc_feature (63)..(127): n is a, c, g, or t
gtgaatccaaaattgagtcaaccgtgttcaacaaaaggcgcaacttttgggggcaaagggctnnnnnnnnnnnnnnnnnnnnnnnnnnnnnnnnnnnnnnnnnnnnnnnnnnnnnnnnnnnnnnnnnctctgtaacgaacacggatattacgagggttcgcttatgacgatgcacactatatttctcatgaaagtcctattgaactataacacctctg

SEQ ID NO: 5943 - DNA, 238 bp, Diabrotica virgifera
cccatcgaaaaatcgatgttaagacactatgaaacagagctagaagtataaatatacgacggatatgctaggtggagagcatcacacactgggtcagaaatagaggactagaatgaaacgatcacatgggcggaatgacaacaaatagacaatttcccaatagaaagacgatcagggggtagaccacgaaaacgatgggacgacgacttactgaaagcacatcgaaaaccagtcacct

SEQ ID NO: 5944 - DNA, 401 bp, Diabrotica virgifera
  misc_feature (372)..(396): n is a, c, g, or t
gcaaaaatggaaaataagcttttcctttgaccgccgaaagatccatagtcggaaatgactctcgctttatcaattaacatttgagaaagaggtgcgtgcgctattcacattaaacggaactctgatcttttcggtttgattcacttgtaaacactgaccatcgtatcatgccgcagtcttatttaataatagatgattggaaatctctcagtgactgcataatctgacggaattagaaaaacactgtgggtgcatgtgtacattcttttattaattacgtaaatgttgcgcttgtgatgtgatggacgcttaagctcttaagccggtgctttcttttggagctttgccctcagcctcagatacaatactcannnnnnnnnnnnnnnnnnnnnnnnnttata

SEQ ID NO: 5945 - DNA, 209 bp, Diabrotica virgifera
  misc_feature (186)..(208): n is a, c, g, or t
tgaaggtatcgatgtaagttcaggaaacaatcacgatgacaaagccaaaggtccgtacatgtacgaattattcagtattatgatacactctggaagcgcttcaggtggtcattattatgcctatagcacagatttcgataagaatctttggtactgctttaacgaccaaagtgttacagggattannnnnnnnnnnnnnnnnnnnnnng

SEQ ID NO: 5946 - DNA, 121 bp, Diabrotica virgifera
gtcctgaatccagcacgatcctgcgaggtgctaccgtctattgtagaaaacaaaccctaccacgcaattcattgctgtaaaagtgtcccagatccaccaatccgtatttgcgaattgggtt

SEQ ID NO: 5947 - DNA, 194 bp, Diabrotica virgifera
actcgtgccgaacgtattttacagaattaccaccactttatcaaacggtattattccagtttgaaaaaatttcttactattttagaagtgatttcttaaagcaattgatgtatttcttataattaactcaataatattatttcaaatatgatacaagtatactattgactgagcctattcctttttgacaccca

SEQ ID NO: 5948 - DNA, 283 bp, Diabrotica virgifera
  misc_feature (85)..(131): n is a, c, g, or t
gaaaaatgataaatttgacgatatcgtaaaatctttagccggtagtaaaaagaaacacacgaagaagatcagtctggtagaaatnnnnnnnnnnnnnnnnnnnnnnnnnnnnnnnnnnnnnnnnnnnnnnnacaagtcagagctcaccaaaagatagcgaaaactgaaacagagcttcttatacgtcagctaccgagtaaagatactaaaagtcgatagttggacagaataatgtccagttattgagaaaagtaaatctcctggccaaagtccttttttagac

SEQ ID NO: 5949 - DNA, 303 bp, Diabrotica virgifera
gtcgtgcacactgctggaactatcgtgcacaggtaggatcatcctggtaaattacgaaaaatcgtgtactctgaaagaactttctcgataaggatcatcgactttgatggtgtgctcacatcactctggtgtgatcagatcgtcctctacgtgtaaaccttgtacactttccgagagctttgagagtttccgaatgcggtaagtgctatatagtcatgtatccggcaaacatcactaagtcacgcgaccctctcaagggggggccgggaaccccggggggggccgggtaccccctccccccaa

SEQ ID NO: 5950 - DNA, 208 bp, Diabrotica virgifera
  misc_feature (136)..(136): n is a, c, g, or t
  misc_feature (160)..(160): n is a, c, g, or t
acatgacgatgagaacacaaatgatgaccgaacaaggagttccacaaacaatgaacgataaaatggtggccctcaaaatgatgattaataataacataatgagagataaaatgatgaaacgtgacatgatgaactnaaaatgttggaagaacaatgatancccacaattagtgatgacaagaaaatgatggctcaaaaacaagtaccc

SEQ ID NO: 5951 - DNA, 165 bp, Diabrotica virgifera
  misc_feature (9)..(29): n is a, c, g, or t
caatcaaannnnnnnnnnnnnnnnnnnnnaaacttgagtgttatacagtttttttaacaactcacagcttataacccttattgactgtgataaaccactatgtgataaggatcaaaataacttttgaatgtcttgatttgtgtttagagtcttcaacatggataa

SEQ ID NO: 5952 - DNA, 306 bp, Diabrotica virgifera
  misc_feature (219)..(219): n is a, c, g, or t
  misc_feature (290)..(290): n is a, c, g, or t
cggtgtcagtagtgacagccgccatggggctctgcatattcgtcacaacctcatcctatcccttcatggaagagatgttaggaatacattggtgcgtttggatttactgctgcgtctgcttcatcggtgctacctttatatactttatgatacccgaaactaggggataaatataccaaagttacaagagtacctgagaactagaaaaatgtgattatnatgtttcgtattcggcaatttgtacttttgtataaattttgttttagtacttaaaaaccgacgataatatntatgtagatatacgtc

SEQ ID NO: 5953 - DNA, 241 bp, Diabrotica virgifera
  misc_feature (5)..(47): n is a, c, g, or t
  misc_feature (125)..(142): n is a, c, g, or t
ccccnnnnnnnnnnnnnnnnnnnnnnnnnnnnnnnnnnnnnnnnnnnatagccgggggggcacccccccttaaataaggggtggaaacacccgaactccccaaaatttcccccccccccgaatgnnnnnnnnnnnnnnnnnnttcccccccatctggggggagaattttttccccccaatttaaaaaaaggggggtttttcctttttcttccaaaaaaatgacccccaaaatttttttttc

SEQ ID NO: 5954 - DNA, 143 bp, Diabrotica virgifera
  misc_feature (30)..(52): n is a, c, g, or t
  misc_feature (135)..(135): n is a, c, g, or t
tgtgaaatatgttttgtgtcttataagagnnnnnnnnnnnnnnnnnnnnnnnctcttctggtttcataaaaggtatttttgacaaaatgaaggtagctgtaattggagcatgtgcatctggagtttcctcagcanaacacatc

SEQ ID NO: 5955 - DNA, 266 bp, Diabrotica virgifera
  misc_feature (161)..(161): n is a, c, g, or t
  misc_feature (177)..(177): n is a, c, g, or t
aaactgttatacatgccaaagctaattagatcactaataagaagtattcataattttctttaccgaaagtttcagggaggattcttcatcgatcatctgcttttctttaagatgttctaataaagaatttaaggtattcacttttttaataagccttctanttcgttgttgcaacantttgatttgtttagttttcttgtgaatgaatttgtttactactactttatatccttggtcaggaccgcgtgtaagtcaattgacgccct

SEQ ID NO: 5956 - DNA, 344 bp, Diabrotica virgifera
  misc_feature (15)..(40): n is a, c, g, or t
  misc_feature (42)..(64): n is a, c, g, or t
  misc_feature (98)..(117): n is a, c, g, or t
  misc_feature (207)..(226): n is a, c, g, or t
  misc_feature (279)..(296): n is a, c, g, or t
gttttatttcttgtnnnnnnnnnnnnnnnnnnnnnnnnnncnnnnnnnnnnnnnnnnnnnnnnncactgatccctttgaatcttaggttctaataagnnnnnnnnnnnnnnnnnnnncattttatttccatatgtagatataaataaaaatatacatatacaaaacttatagttagagtatttaaaggtcttgttgtacggacaggnnnnnnnnnnnnnnnnnnnncaaaaatttttcgaaactatcaaatgtgtgcactatagtcaaaactttcgcannnnnnnnnnnnnnnnnngtggtgttcacgaatttaaaacttcaccttattttaaatggcttactt

SEQ ID NO: 5957 - DNA, 274 bp, Diabrotica virgifera
  misc_feature (2)..(25): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (208)..(208): n is a, c, g, or t
annnnnnnnnnnnnnnnnnnnnnnntaaattcattgttttatctattgttacgataggagacctcatatattcttacctagaccggctctgaccatcctacttatcattaaactacctcacttctgacaccagtgttacgtttttactanatntatntaacagtggtgtcaaaattggagtcgtttactgtcaagtcaggattgtcanagcagacccagttaagatcatgtgcggttgactatcgtaacactactttcgcccacaaaaatactg

SEQ ID NO: 5958 - DNA, 214 bp, Diabrotica virgifera
  misc_feature (146)..(146): n is a, c, g, or t
agtgcattgaagacagttcgtcgacaagggtactacgcttattcggttaacgataaattgaagattattggattaaacaataatgtctgctataattttaattggtggttgttattaaaaacggagtatctaaatgagcagctacnatttctgatccaagaactacaagaatcagagcagaaaggggcattcgtacacatccttggtcatgtat

SEQ ID NO: 5959 - DNA, 289 bp, Diabrotica virgifera
tgatggttgacccaatgtgtttggagcttcacgaagatatgaacaatgtcacgaccgcccaaaaacaaaaatatatgtatctaacaccgaaagagataaaggagagtggtaagaaatatcatggaatagtgcatatgtaacgataggaagaatcctcatacgtcgtggagagtgatcgttaccgacagcaataaatggagcgcacagatgagtgggacaatcgttgaattggaaaacattactgaatttatggcttatacatttttcggcatgtatgtgtggtccaaca

SEQ ID NO: 5960 - DNA, 189 bp, Diabrotica virgifera
ggaactgggagaaaaagccacgctgtgcacaaatgtctatgtgataaatctaggtgaacatatcgctgcaggaacacttacaggtcatgtgtgaaaagtatggtacaattaccacctacaagataatgagtaacgaacatcgtacatctcaaggatttggtttcgtacccattgacagttcacaagcag

SEQ ID NO: 5961 - DNA, 209 bp, Diabrotica virgifera
  misc_feature (9)..(33): n is a, c, g, or t
  misc_feature (53)..(75): n is a, c, g, or t
ctagtctcnnnnnnnnnnnnnnnnnnnnnnnnnaaaatttacgggaaatggannnnnnnnnnnnnnnnnnnnnnncccatttttaattcaataagggattttatttatggaaaattttccttttccggcggttccttgggctataattaccacctatggctgggataacattatcccctacaattttgaccatactaccagggtaggat

SEQ ID NO: 5962 - DNA, 227 bp, Diabrotica virgifera
tcaagttttctctatttttttttaaccggtttaccactttaatttaaaaaattggcttaaaatacaattaatttaaacaacattccttttacccctaaaataaaaaaacaatttggttccccctactttccccaaacaacctatttatctttcttggctccacccaaacttgggtctgcatccccggaaataccctttgggttcccggtcggtcccgcctaaaaccc

SEQ ID NO: 5963 - DNA, 324 bp, Diabrotica virgifera
  misc_feature (310)..(310): n is a, c, g, or t
gatatgatgatatattggtatgaaactaccacgttgccacgtcataaaaaaggcaaaaataaaagaataagacggcataaacacatagtcctgatggtaggtttgtaagctgaaagcgctcagctaggaatttcaaaataacttaaaaaatacgattatatcccattctttctctttttattattttaaagtaataatctacctaacaataaaacactgaaaacttttgttttctatacttccacaaaatttattataactatgtgactacagctgtttcggcagagtggcattctcaagtgatttagtntatctcgatggggg

SEQ ID NO: 5964 - DNA, 195 bp, Diabrotica virgifera
catatccaaggatattgaaaaggcctgccagggtatctaccccctacatgatgtgtacatccgtaaagtgaaagtattgaaaaagcctcgttttgaactctccaaattgttggaattgcatggtgatggaggcaaaagtggtgctggtgactccactggtgaagctggttctaaagtcgacaggcctgatggata

SEQ ID NO: 5965 - DNA, 281 bp, Diabrotica virgifera
  misc_feature (35)..(54): n is a, c, g, or t
  misc_feature (225)..(225): n is a, c, g, or t
  misc_feature (242)..(242): n is a, c, g, or t
  misc_feature (250)..(275): n is a, c, g, or t
agggtatctaccccctacatgatgtgtacatccgnnnnnnnnnnnnnnnnnnnnagcctcgttttgaactctccaaattgttggaattgcatggtgatggaggcaaaggtggtgctggtgactccactggtgaagctggttctaaagtcgacaggcctgagggatacaaaccaccagtacaagaatccgtttaaaattttgttattttgtaaatgaaaagattanaaaagagtataaatacnacgtatcnnnnnnnnnnnnnnnnnnnnnnnnnnaagggg

SEQ ID NO: 5966 - DNA, 229 bp, Diabrotica virgifera
gacaaaaaggctgttgcaggatctcaggaaattagaaacgttaatggtgacaaagggtcgcttagaaaaggttcctagtgatactttccaaaacaatcaagaaataacgatcttagaattggatgattcttccataacaacaattgaacctggaacttttgacaatctccaaaaattagatcggctcgacctcagatccacaggtctccaaagtcctttcgacgtaaac

SEQ ID NO: 5967 - DNA, 206 bp, Diabrotica virgifera
  misc_feature (203)..(204): n is a, c, g, or t
gaagtatcaggctaaaattgcaatgactaataattccgaaaaaaatcaaaatcagacttccgagaataattctcaggaagaaaaaaaggttaatacatactccgaaaaagatcatggaccttttgtagtatatcttgaatctacaaatataccgaatataaaaattggcacattcaatacaattaaaatagctcgaggaaganncg

SEQ ID NO: 5968 - DNA, 240 bp, Diabrotica virgifera
  misc_feature (185)..(185): n is a, c, g, or t
caacgagagagataactgcaagacaataccgaatacagatcaggccgacagagatggtgacggcataggagatgtttgtgataactgccctagtgcgtataaccctggttctgaagataaagacgacaataatgttggtgatgtgtgcgattctccaataaatactgataatgatggtgttccanacaatcatgacaattgcagacttatacccaatcccaatcaacttgacactgatag

SEQ ID NO: 5969 - DNA, 166 bp, Diabrotica virgifera
cacctgccgaatgcggcacgagctcgtgcccaatacggcactatcggcactaggaacctattattccggttcaagacctctatctctcacatctctcatataacctttatcccgcatttggtcgaaatctgaagtctcgttcataagtcatcgtgctattggtcac

SEQ ID NO: 5970 - DNA, 237 bp, Diabrotica virgifera
  misc_feature (175)..(195): n is a, c, g, or t
aatgtaactttttaccttttttttcacatatcaataatgatataaatatgttacatattgatatggcaattataataaacgaacgaatgtttaattttgtgatcttccttttttaatacgtacatgcatttacaaattattttttcaagtaaaattgttcacagagaactactgnnnnnnnnnnnnnnnnnnnnngcacgacacgcataatatgttattaataaattatgattattg

SEQ ID NO: 5971 - DNA, 207 bp, Diabrotica virgifera
ctcaattaaaaatgaattcagtccattttccacgtattatcaagtcctgcaatttcatagcaaggaggtttataggagtaacacagtctaggctcaaatccttcgtggtacaagatgaccaagattttttataataggtagagaagagcatggatccattaattgtggatttcttcacaaactggtgtggtccatgcgaggcattgg

SEQ ID NO: 5972 - DNA, 275 bp, Diabrotica virgifera
  misc_feature (142)..(142): n is a, c, g, or t
  misc_feature (242)..(273): n is a, c, g, or t
agtttgtaaagggagtatcacactatctgcgggctttgtatacctatattggtaataaataggatcttataatttgattccagcaatggaattgctggtgaataacctttctttgtactttactaattagaccagtggttcncaaccttttatgtctggcgacccactttctgatgtcttttcatattcgcgaaccattgctcactcatgatgatacgctattctgtactctgtacgccacnnnnnnnnnnnnnnnnnnnnnnnnnnnnnnnnct

SEQ ID NO: 5973 - DNA, 227 bp, Diabrotica virgifera
  misc_feature (6)..(31): n is a, c, g, or t
  misc_feature (103)..(121): n is a, c, g, or t
ctcgtnnnnnnnnnnnnnnnnnnnnnnnnnngggttttggttttattccccaaaaaatttaaaaccccccaaatttaaaaacccaaaacctttttttttgggnnnnnnnnnnnnnnnnnnnccatttccccggaaaattaaggggttttccccaaaaaagggtgtcccccccccaaaatttctccccccatttcccgggccgggggttaaaaaccgccaaaattttt

SEQ ID NO: 5974 - DNA, 216 bp, Diabrotica virgifera
  misc_feature (131)..(131): n is a, c, g, or t
  misc_feature (158)..(158): n is a, c, g, or t
  misc_feature (173)..(173): n is a, c, g, or t
cagcaaccctcttattccgaggttgtacggtttacccaagatacataaagttggaattcctatacgtcctgtcgtcagtttcattaacactccagtttctattttatcaaaatacatactcaacaccttanaaaatttaatcaacttcacaccccgtnttactgtatcaaatncataccaattatttgataaacttcaactcatcaatctcaatcc

SEQ ID NO: 5975 - DNA, 200 bp, Diabrotica virgifera
  misc_feature (76)..(152): n is a, c, g, or t
  misc_feature (157)..(185): n is a, c, g, or t
cgggaaatgagcttcttttatatgtaaaagaaagaacaaattaattatattatatgtttaagcaacataataaacnnnnnnnnnnnnnnnnnnnnnnnnnnnnnnnnnnnnnnnnnnnnnnnnnnnnnnnnnnnnnnnnnnnnnnnnnnnnncccannnnnnnnnnnnnnnnnnnnnnnnnnnnnccccgggcccccttt

SEQ ID NO: 5976 - DNA, 318 bp, Diabrotica virgifera
  misc_feature (104)..(124): n is a, c, g, or t
  misc_feature (243)..(270): n is a, c, g, or t
  misc_feature (289)..(310): n is a, c, g, or t
gttgattaattcatttggctgttatacttggaagtttctggagtttttattttatagttttttaatgtactaaaagccaaatatcagttgctaagattttatannnnnnnnnnnnnnnnnnnnncaatttctgctacgcacttgaaacgtgatgtatatggttagttatatgaaaaatccgatatagtcagatcaatgaagagtctatttgtatattgcttatgattcggtgtgattttgacnnnnnnnnnnnnnnnnnnnnnnnnnnnngaatataatgtgagcgtgnnnnnnnnnnnnnnnnnnnnnnaagggggg

SEQ ID NO: 5977 - DNA, 160 bp, Diabrotica virgifera
atcatgtctatttctgctctcgcgtgtcgtctacagcgatacataacctctatgcagatctttgtaggccctgtctaccgattacgaattatttagtatatgtaataacttgtctgtccatattcatcgactaatgatttgtagatgtgaggtcagcccc

SEQ ID NO: 5978 - DNA, 215 bp, Diabrotica virgifera
cccctatctaattcccgccttctatgctaactctggacaactttcgggtgaattcgctccttctgctgctgcctaggttattataagattttatgaccttcttgtgctgcggcctaaatgattaacatatgttatgaccttttgcacccccgggggggggcagggtccccattcccccctaaatgtattcttttggggggccccgggcccccttt

SEQ ID NO: 5979 - DNA, 108 bp, Diabrotica virgifera
  misc_feature (35)..(56): n is a, c, g, or t
  misc_feature (59)..(65): n is a, c, g, or t
  misc_feature (88)..(107): n is a, c, g, or t
gagagagagagaagagagaactagtctcaagttgnnnnnnnnnnnnnnnnnnnnnnttnnnnnnntttttaaaactttttaaaacccnnnnnnnnnnnnnnnnnnnng

SEQ ID NO: 5980 - DNA, 175 bp, Diabrotica virgifera
  misc_feature (144)..(168): n is a, c, g, or t
agaaggcatatgtaaggttagctagagattatgatgctctagatgttgccaacaagattggcatcatataaattaatatcttaccttgttttattttttttgacatctaataaaataagttgagaataaagttttttagtttgnnnnnnnnnnnnnnnnnnnnnnnnnggggggg

SEQ ID NO: 5981 - DNA, 66 bp, Diabrotica virgifera
ctcgttcctaaatcagcacgacccgcacgggctctctctctctgtctctgggtctttttatctctc

SEQ ID NO: 5982 - DNA, 106 bp, Diabrotica virgifera
  misc_feature (66)..(94): n is a, c, g, or t
caaaaggggccctttttgctttgggaaaatttagggcccaccctaaaagaatttgccccccagggnnnnnnnnnnnnnnnnnnnnnnnnnnnnnaaaaaacggccc

SEQ ID NO: 5983 - DNA, 414 bp, Diabrotica virgifera
cctaatttgatctggctctccgtccaattttcagcactattcttcacttataaacaacccctgggacctgctaacctatctaatccacgaaacgtcgaactgctcctcagcgatgcccataacataatgacttctttttcaaactccctcaatcattcaaaccacttttccccttccaaattgccaagactcagaaacatttctcttttccattcgacaaaacaaacagtcattttcaaaattattccgaccatccaattactttcggggaaccctataacatttactctgggggaaacaaagatattaaaattccaaactttcttttaaaccatttttctagaaaatgataattacctctacctgtggaatctataggtccccgaataaacaaactttccattttaaacctaa

SEQ ID NO: 5984 - DNA, 394 bp, Diabrotica virgifera
  misc_feature (274)..(274): n is a, c, g, or t
  misc_feature (379)..(379): n is a, c, g, or t
gttacttgtatgcccacctccaattacccaccttcacaaataaatttaggtattaatatccttgtctccagatttacacatacgcctttgcgatgtttgaaataggtccattaaactttttctgtcttctaagtttttatccaaaatggttacctcgttagcaatgttgtaaacttttgaatattatgttcaaatttagttacacatagtttcaataaaaaattcatgatcggtcgggccttctcgaacctgcacatacacctcttatatattntttatttacataatacctaccggaagtgcaaaacctagccgttagttaatttaagtcgaactcgataaaaacaataaatcggccctttatgtaacacctatattnttatttcactaaaat

SEQ ID NO: 5985 - DNA, 368 bp, Diabrotica virgifera
  misc_feature (310)..(310): n is a, c, g, or t
tccaggctggatggagcaaagttgttcatggacccaatagagccaaaccaacatggcatgtaggtggtagcttcagattctcacgatccccaaagccagaatgggaagtaaatcctggagctaacgatgatggaaatggtaacactaatgctggtggagaagtcccaaggccagaatgggaagtaaatcctggagctaacggtgatggaaatggtaacactgatgctggtatagaagtaagaaataagggcaaagatcatggtttccaggctggatgggacatgcacatgccatggctatatggtatgtnaggtgcacatggaagttttaaatttgaataattggtatggataaaatgtataataatt

SEQ ID NO: 5986 - DNA, 268 bp, Diabrotica virgifera
  misc_feature (159)..(188): n is a, c, g, or t
  misc_feature (218)..(236): n is a, c, g, or t
aagctgattcaccgggggcggcgtctaaactagggatccccggctggagaattctgctcgaagaaacttccggtggaatcctggaaaccctaaatggctgttttcattatccccggagggggttttcccccaaaatgctcaaaatttattaaaaggatnnnnnnnnnnnnnnnnnnnnnnnnnnnnnncccacatttgcaagatatccctctataaannnnnnnnnnnnnnnnnnncaactttaccacataggaaatcctacagccaa

SEQ ID NO: 5987 - DNA, 193 bp, Diabrotica virgifera
actcttgcccatttccgccccaagccttgcggtgtttttttggaaaaatgcccggggtcttaagttaaaaaaatggtggtcaacggttttatttttgtcgcttgcctaactggtatatttccccaatgagcttggaaacatcgcccatggtcctccgctcatgggtctaagcctaaacccggaacatttaaac

SEQ ID NO: 5988 - DNA, 258 bp, Diabrotica virgifera
  misc_feature (4)..(25): n is a, c, g, or t
  misc_feature (111)..(130): n is a, c, g, or t
ctcnnnnnnnnnnnnnnnnnnnnnnttataggttaaaaggggtccttttcggaaaaaagttgcaatgccataaaagtggcccaataaaattccctataataagggttgggnnnnnnnnnnnnnnnnnnnncccccttgtggcaaaaaaccattagttgcaaaaaaccttaaaaaaccaggttttcgcatttccgtttttaacccttttttgctcccttaaaacctcttttttttcacccaaaaaaactttttgattta

SEQ ID NO: 5989 - DNA, 170 bp, Diabrotica virgifera
caggttttgagtaaacagggttgccgcaatcccttgattccttaaactaacatgctctttaaacaattgtagcaataagttgacgcacagagcgagataacatacctacagcattattcaatgaaattcggaactgctttcctgaatatttttgatctgacaatctgatg

SEQ ID NO: 5990 - DNA, 183 bp, Diabrotica virgifera
  misc_feature (9)..(43): n is a, c, g, or t
  misc_feature (61)..(88): n is a, c, g, or t
  misc_feature (90)..(108): n is a, c, g, or t
  misc_feature (121)..(138): n is a, c, g, or t
gtctcgagnnnnnnnnnnnnnnnnnnnnnnnnnnnnnnnnnnnccaaatttttggcctttnnnnnnnnnnnnnnnnnnnnnnnnnnnncnnnnnnnnnnnnnnnnnnnttttccctgggtnnnnnnnnnnnnnnnnnngccccccattcccccttatgggggggggtttaccaatccccggcc

SEQ ID NO: 5991 - DNA, 364 bp, Diabrotica virgifera
  misc_feature (222)..(222): n is a, c, g, or t
  misc_feature (298)..(298): n is a, c, g, or t
  misc_feature (330)..(354): n is a, c, g, or t
caagcctttctaacttattgggaattagggtcccatttccaaatcagcggtattccatgaaaatgtgtactgctgagcacaggggctgccgctggaagtttcctcatgtcagttatggtcatagtaatgttcttattgacctctagttttccaattattgctgccactattggaacccactggctgtctggttgttcagtttcagttgttttttaggatcanttttcatttatagatatttaccagagacaagtggtaaaaagtttgtacaaattcaagacatgttaaaaactattangtttatatatcgttataaataaaacgttacgnnnnnnnnnnnnnnnnnnnnnnnnnggggggggcc

SEQ ID NO: 5992 - DNA, 309 bp, Diabrotica virgifera
  misc_feature (78)..(78): n is a, c, g, or t
ctacacttttttcatgctgattttggggtctctggtagggacattatttatgtttaatttgacctaacaatatcattntcttctctaggtttataattccgttgtctgggtattattgcaaagtcttctgtgtttcttacatcgttgctgataccaaatccaagatcgttccaggcatgggaatttcgaccaattcgtagtattacatgttttacatcttgatgccttataccttgtgggtttagaatatcgtcaaagcttcttggctccttgtctaactggaccatgaagagatccttgtattgatca

SEQ ID NO: 5993 - DNA, 342 bp, Diabrotica virgifera
gaataggaccaaagaagtgatagaactatctgagaagaatgatattaaagtaagaggatacatatcatgcgttgttggttgcccttatgatggaatgattgaaccagcagccgttgcaaagctcacagaatctctactaagcatgggttgctacgaaatatctttgggagacaccattggagtagggacacgagattcagttaataagatgttaaaagatgtgctagctgtagcatcagctgataccttagctatccattgtcatgatacatatggccaagcattactgaatattttcacagccttggaaaatggtatatcagtggtggattcatcagtagc

SEQ ID NO: 5994 - DNA, 211 bp, Diabrotica virgifera
  misc_feature (3)..(22): n is a, c, g, or t
  misc_feature (108)..(157): n is a, c, g, or t
ccnnnnnnnnnnnnnnnnnnnntgaatctgaatcagaagacgacgacatgggctttgctctattcgactagactcattagttgtaagatcaaccttgttttgtacctnnnnnnnnnnnnnnnnnnnnnnnnnnnnnnnnnnnnnnnnnnnnnnnnnnctggggggggggccggcccccattcccccttaagggggggggtttaaaattccc

SEQ ID NO: 5995 - DNA, 165 bp, Diabrotica virgifera
  misc_feature (27)..(44): n is a, c, g, or t
  misc_feature (131)..(162): n is a, c, g, or t
gaaaggctcatcaaacaattattaacnnnnnnnnnnnnnnnnnngtcaagggtatatagtggtattgttaagtatattacaatataacttattccatcgaaatcttccgaaatccataatcttcttccatnnnnnnnnnnnnnnnnnnnnnnnnnnnnnnnntgg

SEQ ID NO: 5996 - DNA, 274 bp, Diabrotica virgifera
  misc_feature (187)..(205): n is a, c, g, or t
  misc_feature (242)..(267): n is a, c, g, or t
aaaagtagtagttagtagctatagatatttataggtattttatttgaaatgctttggttgtcttttttagattttcggtttggtttcgaaatcctaaaatagatggcttaagcatttcaccagcatgttgcaaacaatttactgttgcatttatttaaagattgtattcgatacactactttgaacnnnnnnnnnnnnnnnnnnnctaaatttttgtagaataaagactgaatttctacagnnnnnnnnnnnnnnnnnnnnnnnnnnggggggg

SEQ ID NO: 5997 - DNA, 81 bp, Diabrotica virgifera
ggtctatctctctctctgtggggctctatctcaatcaccccacacccacaaacggtaaaaaagacagacccaccaaccaaa

SEQ ID NO: 5998 - DNA, 238 bp, Diabrotica virgifera
  misc_feature (121)..(147): n is a, c, g, or t
  misc_feature (209)..(229): n is a, c, g, or t
gtaatgcctatacataaattacacagaatatgtatattaccatggaactcatcaaaaaacatgcgtgagtagaagaggctgtgaaatagtcccgtatctagagaaatgtacaattattagnnnnnnnnnnnnnnnnnnnnnnnnnnnaagggggggccccggtcccaatttccccttatgggggggggtttaaaaattaattgcccgcnnnnnnnnnnnnnnnnnnnnncagggggcc

SEQ ID NO: 5999 - DNA, 148 bp, Diabrotica virgifera
gcagattaacaacagatgcacttatcattataaggcagttgatggaaaaatcatctttgcttctatccatgtcgctcttccttattgcaatacatatcctattactttatgccaagcctttattgggggaagattataaggctggaca

SEQ ID NO: 6000 - DNA, 99 bp, Diabrotica virgifera
taggaattatgatgaatacaatcagaaatgcatacgatacagaacagagtttgacctacacataatcttttcaaaaacataatacattggtgtatagcc

SEQ ID NO: 6001 - DNA, 57 bp, Diabrotica virgifera
cggcacgagctcatgccgtattctggacgagctcgtgccgcattaggcgcgacctgg

SEQ ID NO: 6002 - DNA, 122 bp, Diabrotica virgifera
attctgcacgaggttaaatgcttttaacaatatgattgtcccattagcacagatgcccatctccatatcctcattcatgggcctccgtcagatgacagatgttccatctgacagtttgagca

SEQ ID NO: 6003 - DNA, 330 bp, Diabrotica virgifera
  misc_feature (129)..(248): n is a, c, g, or t
gcagtacttaatacatttgtttgtaaaattttgagttttgctgttaatcattgtatatatgataaatatattattttacagagtccttgaggtcaattttgttagcccaggactaacctgagggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccattttgggggggggagaaaaattgggccccccgttttataaaccttgattttgggggtaccaaattctggggggggg

SEQ ID NO: 6004 - DNA, 401 bp, Diabrotica virgifera
  misc_feature (353)..(393): n is a, c, g, or t
cagcaatgcgtgaataaccatgaaatacctaaagaatggaaagagtcacatctgagcactatccacaaaaagggagataaatcaaaacctgaaaactatagaggaattgcagtcactagtagtatcagcagaatatatggaaaacttattaaaaatcgaatagaagaagaataccaaaatatggaagccgaagaacaggctggttttcgcgcaggtcgatctacaatagatcatgttttctccattactcagataattgaaaagaaagttgctcgtggccaagaagtccatctgatgtttgtagaccttagaaaagcgtatgatagtgtcccgctggttaaattatgggaggnnnnnnnnnnnnnnnnnnnnnnnnnnnnnnnnnnnnnnnnngggggggg

SEQ ID NO: 6005 - DNA, 345 bp, Diabrotica virgifera
gttttgtatcaattttaaaatattgttggaagatggttgtaggtgtagcatattttctatttctagtaattttaatgggagtcgccaatacagaggcggttgtcacaaatgaagatatcagggcagcaattttacaacttgtcaatatagttcgggcgaccgatgacaaagtataaagacacgagtaccgcgagagaattctcggcgagcaattaaagaaaggcatgataaacatcgattagaggatcaaaatgttagatccgctcaaaggaaccgtccggagaatggacgaaagattgacggcactcgaaacgatgttaatgcaaacgaatgaaaaagaaaaat

SEQ ID NO: 6006 - DNA, 282 bp, Diabrotica virgifera
  misc_feature (275)..(275): n is a, c, g, or t
gtcaaagagataacatctcaaattccttatgagatcccaaaactgccagaaagtgatgtagcctcctcaatagttaaagaaagctggaataaaggtgttttagttactttcaaattcctgtctgatctgcctgacaccacaagagagttaacagccaaaggtattgacgcaataaaacaaaatgaagaggttaaaaaacttttaaattcaacttcatcttcgtgatttgaaagaaatcatagttattgtgttagataatttattaataaacattntctctta

SEQ ID NO: 6007 - DNA, 213 bp, Diabrotica virgifera
  misc_feature (160)..(201): n is a, c, g, or t
ggaatggaaattctactcagcaaatgtgaagcacctaattttttgcatattgaatttgttttaagaattgtttaactattgaatatgctggcatactgatttataagttttaataaatgttaatactattttattctttcttgctgtaaaatatattacnnnnnnnnnnnnnnnnnnnnnnnnnnnnnnnnnnnnnnnnnncttcgggggggg

SEQ ID NO: 6008 - DNA, 115 bp, Diabrotica virgifera
gcaagagatcttgacacggccggtatgctcagtctatgttgatatgggatacattccatataagcttatattaccatgccctgatcgtaccttccgtgcgcccaggactaacctg

SEQ ID NO: 6009 - DNA, 374 bp, Diabrotica virgifera
  misc_feature (16)..(51): n is a, c, g, or t
  misc_feature (149)..(179): n is a, c, g, or t
  misc_feature (342)..(366): n is a, c, g, or t
gagagaactagtctcnnnnnnnnnnnnnnnnnnnnnnnnnnnnnnnnnnnngtgggccacccttttaaaattttggggaatttttcattttccaggggccctttttttggaagggggccaaattttttgggattattttttaccccccnnnnnnnnnnnnnnnnnnnnnnnnnnnnnnncttaaggggcccggggtttccccaaggggtccccccgggggaaaccagccttttttttggggttaaaattaaaccccgggggggcttttggccccccccttttgaacccccccaatttgggggtccccaattttgggggggggccccggccccaattcccccnnnnnnnnnnnnnnnnnnnnnnnnnggggccgg

SEQ ID NO: 6010 - DNA, 287 bp, Diabrotica virgifera
  misc_feature (227)..(227): n is a, c, g, or t
ctaaacatacgtgaaagaaaacttcattgggcaatatgtaaattaagacatttcatttccacagatcaaataaaaggggctctggacagaagtaatacatataccatcgtgtttgtaagcgtgggagactcgaattggtgtcctctacagggtaattgattagtagggtaaagctcaatagctccgctatagtaatagatagcaataaaagttaataacaaaaattntagccacctttgagcttcacattacaaaattagttagaatgttacagggtgttggataac

SEQ ID NO: 6011 - DNA, 650 bp, Diabrotica virgifera
  misc_feature (185)..(206): n is a, c, g, or t
  misc_feature (260)..(278): n is a, c, g, or t
  misc_feature (328)..(328): n is a, c, g, or t
  misc_feature (333)..(333): n is a, c, g, or t
  misc_feature (360)..(360): n is a, c, g, or t
  misc_feature (395)..(396): n is a, c, g, or t
  misc_feature (436)..(436): n is a, c, g, or t
  misc_feature (438)..(438): n is a, c, g, or t
  misc_feature (444)..(444): n is a, c, g, or t
  misc_feature (530)..(531): n is a, c, g, or t
  misc_feature (612)..(612): n is a, c, g, or t
ccaacaatcgttttttccgattataatgccatctatccataattcgaaaaaatatttcgaataaaagttacttatttttacttaaggaatccaaatctgcaataaaaaatgagggttcccatttaagattttaaagtaaccccacaccccacctccgtgggggtcgtgtttggtgccattcgatnnnnnnnnnnnnnnnnnnnnnnaagtgtattttatagtttttcgatccgatgtccatttcgcgaaataccgtgggnnnnnnnnnnnnnnnnnnncccccacccctctttgtgggaagtcgtgtttggtatcattcgatagattntgaanaaatattaagcacatattttttagttnttcgatctgtcatttatttcgcgaaatatgcgctnntttctagtgaagctttgggactcgcccatttccttacgcncngctganatcgtcagatttttaaatacactcttttgcatgtacttaacttaccttatgttaatatgacaatttcgagtttttaaggacatatnntttttttcggccccccttaacgaactcccctgtgttaagagccaatatatggtagaggtacatctacagggtaccaggttntctcccatatgataatctgacgcgctcgagggggggcc

SEQ ID NO: 6012 - DNA, 355 bp, Diabrotica virgifera
  misc_feature (280)..(327): n is a, c, g, or t
attctctggttttactctgtataataaacatgtttttaagtttttgtcttgaatgttttcatttttttcactttccgttggttcggatttgccgaacgttcggattagcggggttcagatttgcggggttctactgtatattaaaactttttctcactaaagctcagaacttatctaaacacaaaatactattgactaactacttattttataaaggtttattagatttaggtgaaacctaccggtgatattttcgactgtaattgcctaaataggctcnnnnnnnnnnnnnnnnnnnnnnnnnnnnnnnnnnnnnnnnnnnnnnnntcttttacccttcactatccttctatct

SEQ ID NO: 6013 - DNA, 250 bp, Diabrotica virgifera
gttcttttggctctagtagccgtagttgtcttagcaacaaccgaagtcagcgcaaagtccgttaaaggaacttccttcaaggcagtggcactggcaacacttggaaaaactcttggagaagacgtctgcgactgtgacgaatgcaccaaaacttgtgtaactgaagatccttccagcgttggaggagtttgttatgaagacgagtgttattgtggatacttaaattgattacatttttaatatctttagc

SEQ ID NO: 6014 - DNA, 406 bp, Diabrotica virgifera
caggtgccaaattcagcacgagctcatgccgaattcttcactagatttgaggcggattagcagaagataatgcaactttaactcgattctatacatatcattctattataccttctattatacatggcttttataattattcatcttctattagtacatcagacaggatcacgaaatctctctgggaacataaggaagtattgataagattccatatcatacttatattactatcaacgatatccttggatgcttaatattattattatgataaacaacattaactctataagacccatatttattcggagactctgataatttcacccctgcagatcctatacgtacaccagttcatatgcatccagaactgatatattttgttggcatatgcgcatttacgctc

SEQ ID NO: 6015 - DNA, 385 bp, Diabrotica virgifera
ctagtgccaaatcaggaccgaattattgaagcatatggtttacctaataaaggatttacgaaattatataaaagatcttccaaaatataaagttcttcaactgaaacatctgggatttatactggtcaagcttcaattgatggtaatcaaaataccaatgattgatagcttgaataaaattgagtactgaattgttaaaaatgagttattaaaggtttaatatttataataacaggtgaaatttttaaagcaacaactggtactaattaagccggtactgctcctaaattattttgaactgatcgtaaaaatgcctatgcctgaaaatgaactgattcaggttaaatattaactggggtgacttaatgattttctagggttaaat

SEQ ID NO: 6016 - DNA, 130 bp, Diabrotica virgifera
  misc_feature (4)..(27): n is a, c, g, or t
  misc_feature (86)..(104): n is a, c, g, or t
cagnnnnnnnnnnnnnnnnnnnnnnnnatctctctatctctggatctatatagctctctcgggggctctctctctctctctatatnnnnnnnnnnnnnnnnnnnctgaaactacgcacgagagagaagag

SEQ ID NO: 6017 - DNA, 338 bp, Diabrotica virgifera
  misc_feature (17)..(29): n is a, c, g, or t
  misc_feature (32)..(57): n is a, c, g, or t
caaaaaatagggggggnnnnnnnnnnnnnggnnnnnnnnnnnnnnnnnnnnnnnnnnacccaaagggaccgggttaatttcacattttaccttccaaattgtttgtccaaatttgaaccttatttttattcctaatttgggaccaatttgccagaaccagtttcccaaaaattttttttggctgaaacctttttaatgaaaaaccccccttttttttcccgggaccattggccaaatttgggtccttcaaatttaaattacccattttgttggacccccaaaaaaaattccttttaaaaaccttttttgggggggggccaaaacccacctttttcaaa

SEQ ID NO: 6018 - DNA, 434 bp, Diabrotica virgifera
  misc_feature (297)..(314): n is a, c, g, or t
  misc_feature (377)..(390): n is a, c, g, or t
  misc_feature (393)..(426): n is a, c, g, or t
gtctcgagtttttttttaatggtgctgctagttaaattctatcttcaaggattgatctaaaactttcccagtctgttagtttatttgttagtattgggttgcaatcctttctgataatcgtgtcactcacagtgagtattatgggtgaatgatctgaattcatatataatatgtataattaatttagaatagtgatccatttgctctaaaatacttatttcgtcttttaaaatacctttttctaaaccagagtaggtacacttaaaaagtttatctagaaatgaccctaaaatgcannnnnnnnnnnnnnnnnncatttatgtaataggtaataagttttatatgtttgcattaataatgtaatgttaagttttgannnnnnnnnnnnnnagnnnnnnnnnnnnnnnnnnnnnnnnnnnnnnnnnngggggggg

SEQ ID NO: 6019 - DNA, 102 bp, Diabrotica virgifera
  misc_feature (21)..(38): n is a, c, g, or t
  misc_feature (51)..(71): n is a, c, g, or t
gaagaagtgagactggtacannnnnnnnnnnnnnnnnnttacagtaaacgnnnnnnnnnnnnnnnnnnnnntgccgtagaaatgaaaaataatccctattct

SEQ ID NO: 6020 - DNA, 582 bp, Diabrotica virgifera
tttacttcaaatcatattggaaggtaaagtgaagggcaaaagatcagaaggaagacgccagatctcgtggcttaagaacctgagaaaacatttttcgtgccgcagtttccaaagctacagttgccatttggatcgccaaccttcgaaaggagactgcgcaatcagaacaagtgcacatagacaatcttttacacaaggcttttgaaagactcatttaactagtaagtactcgtagttaatagtagattttgtttctcttgatcaactagtgttgtatctatttgttttgtatgcaagtttatcttttaatctcctaatatttgtactccattttgtatttgtgctataaaaaattgtcagtacccttcgtaaatgctctttttgaaccaatagtgttaaaacactctcctattacaggtaatatcctcatatttttgaggtccgtgaacctggccccccgaaatgcgaatattcgtgtgaaaatttgcgcatcgtttgcccatcgtttgaccatgtttgcccactaattactttttttgcccacctttacaataagagatacatacatgacataaaaaacat

SEQ ID NO: 6021 - DNA, 385 bp, Diabrotica virgifera
  misc_feature (263)..(365): n is a, c, g, or t
agaaggacacagaaattccaaagggctattgtaggtgcttctttaaatgatatcatggccaagagaaaccaaaggcctgaagtaaggaaggcccaaagggagcaagccattcgtgccgctaaggaacagaaaaagagcacaaagacagccaagaaggctacagcccccgccaaggccaaacctgctcctaaacagaaagtaaccaagaatcaacccaaagctgcacctagagtaggaggaaaacgttaatattgtataaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttcccttttgggggg

SEQ ID NO: 6022 - DNA, 281 bp, Diabrotica virgifera
  misc_feature (2)..(40): n is a, c, g, or t
  misc_feature (86)..(116): n is a, c, g, or t
  misc_feature (251)..(279): n is a, c, g, or t
cnnnnnnnnnnnnnnnnnnnnnnnnnnnnnnnnnnnnnnnccttggggataacagcgaaattttatgggaaagtccaaatcgatannnnnnnnnnnnnnnnnnnnnnnnnnnnnnngtttataatgggggtaccaccttttttataaagtctgtccaactttaaaaatttcccatgatctgagttaaacccggggtaacccaggtgggtttctatcttaaattaatcaatattttttagtccaaagggccnnnnnnnnnnnnnnnnnnnnnnnnnnnnnat

SEQ ID NO: 6023 - DNA, 456 bp, Diabrotica virgifera
gctttctgcgccgctaagctgcgttatcaacgaaggcagcaccattgaggttgagttcggcagcatcgtcagcaagcaattcgtcatcaaggggcaaccgccaaaacgttatgccatcaaaaacgttgatattgcctaccactgtgatgataacgcggtgggaaacacagaccggataaagctcacgctgaccgcagatcaagccgtcgcagacagcagtacgccgtacattgcaaaacttctggacagggaccacctcggtgtgcgtgtatatgatgaacacagacagaacgtaacgctggacgggacctatgagtttgcggtgaccatggaccctcagggaaacggtgtggtcaaaaatcatgctgtaccggtcagtacgaccaatgccttttcagccccgggccgctttgaaggtaacgtgacggtgaagatggatctttcgttaccgaacta

SEQ ID NO: 6024 - DNA, 458 bp, Diabrotica virgifera
  misc_feature (102)..(119): n is a, c, g, or t
ctggtgcctaatgctgaccgtggacgtcatggtagcttaccctcgacgacccgtgctcatacttgcgagccttattgcctactcaatatgacattacatctnnnnnnnnnnnnnnnnnncgacggcgcctttcaagcgcattgtcgactcggatcgataagtatcttcactgcaattgccatgagcagcaccggcctgtaccataatgagtaccgtgctgttatacaatcaggagccggcttctctgtaaacaggatctgaccaggccgttcttagactctcacctgtctgctatgctacacgacactatttacacttcgacctcatcagtgatctacatcatcttgcacaatgcgcttcacaagctggcgtagtttgagacatactcgagaatctgtagcctcatactgatgtatatgaacagtcctatggtgatccatgaactgatcatggatgaa

SEQ ID NO: 6025 - DNA, 298 bp, Diabrotica virgifera
ggactccacgcggtggcggggctgtagactagaggattggcatggcctggggagacgagtacagctcatgtgaaactccgttggaaatgtcacgggatagtccccgtcaactatgacgatcgcgacctcaatgtcggattcaagtttatatatgttgtgccaactattgtaatacctctgtactactcacaaaattgtaggtcatccgagttaagtacggtgtaaaccagctcggtctccaactccactggaatcatctcttccatccagatatgatccaatattgataatatttttt

SEQ ID NO: 6026 - DNA, 563 bp, Diabrotica virgifera
  misc_feature (71)..(93): n is a, c, g, or t
  misc_feature (95)..(120): n is a, c, g, or t
  misc_feature (152)..(225): n is a, c, g, or t
  misc_feature (309)..(321): n is a, c, g, or t
  misc_feature (324)..(338): n is a, c, g, or t
ctaccaaaaccactgaaaaactagaatgaacacacaaataaacatagtataaacaatgggaaaaaagaatnnnnnnnnnnnnnnnnnnnnnnngnnnnnnnnnnnnnnnnnnnnnnnnnnctgagtgtgtttcaaggatctacatcttatgnnnnnnnnnnnnnnnnnnnnnnnnnnnnnnnnnnnnnnnnnnnnnnnnnnnnnnnnnnnnnnnnnnnnnnnnnnacctgagtcaaatgcccgaaaagcaaagtgttaatttatatctgtaatatgtacaagtttgatattgtatctgaaccgaactgnnnnnnnnnnnnngannnnnnnnnnnnnnngagcaatatttttgcttttcgaccacttttgtgtaggggtggggagttcgtggatttttaccaaatttgggtatattactgtaggtaccttgggaaggtagcctatagctattttttagtcctctaggtgacccttaacctgagatatgcctctcgacagggtcaaaaatagccctttaaatgctctatttgaagagccatatctctgagcccagaggaccgatt

SEQ ID NO: 6027 - DNA, 547 bp, Diabrotica virgifera
  misc_feature (58)..(159): n is a, c, g, or t
  misc_feature (164)..(220): n is a, c, g, or t
  misc_feature (245)..(268): n is a, c, g, or t
  misc_feature (270)..(293): n is a, c, g, or t
  misc_feature (359)..(388): n is a, c, g, or t
  misc_feature (419)..(461): n is a, c, g, or t
  misc_feature (499)..(517): n is a, c, g, or t
attccctgcaaggaagttcgcattgaaagcttaggttgtattctgttaaataaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaannnnnnnnnnnnnnnnnnnnnnnnnnnnnnnnnnnnnnnnnnnnnnnnnnnnnnnnngaaggggatttttaaactcaatccnnnnnnnnnnnnnnnnnnnnnnnncnnnnnnnnnnnnnnnnnnnnnnnncgcgaataaatacattaaattgaattcttaaaaaaacagatatatttaaaaaccaataacatttcnnnnnnnnnnnnnnnnnnnnnnnnnnnnnnctacaataaaaattttaaactactagctccnnnnnnnnnnnnnnnnnnnnnnnnnnnnnnnnnnnnnnnnnnnccctgatacacaatggaccaaaaaataaactatactcnnnnnnnnnnnnnnnnnnnctgttacaaaacttaataacctatcattta

SEQ ID NO: 6028 - DNA, 467 bp, Diabrotica virgifera
gggaacaaggccataacaggtttttcaataaattcaatggaagggtttgtgttggtggccacccacattttaatccactttaaccattggattaacagttataaagggcatttcaatagccgggggaccaaacataccttttccacaatttttcctaaaattggctatcttttaaaacttcggataaacattttctttaattccctggtaatcctttaaaaggtggccggaataaacagttttgggttttaggtggggggcccaatattttgggcaaaattaaacctggaattcggccattttgtccacgtggccatttaaaaggttggacccatatggaattcccatggtggaaacggggttttggcctttacggttttttttaacataggtccgggacacatgaaatccaggttttaaactacgtatccaaaaagcctcccttcgaaaaatagggtttttttttc

SEQ ID NO: 6029 - DNA, 623 bp, Diabrotica virgifera
  misc_feature (514)..(514): n is a, c, g, or t
atctccatttggcttgtgcaattttttctatgacatctgtcactttggtcctctctctcactatcctatttggtaccatatctcttcttgttatttctaaaattgctctttccatttttttaggttattctcaatttatttgcagaatgtttagtcaaagttatgaaaccatatgttattaccggcagcatgcacacaacacccgtttatatcctgtacattacattttgttctaatttcgtcactttttattcggtctctcagagttttttttgtaattcttctcagtattcttgtttctgctgtttccagccttctctctattttagctgtatcgggtcttgtttctgatgcatacctcattattggtcttatattcataagattcttcatttcatctcacagttaagatgtcggttacgccatatagtgtcaattctgctaatctatttgctctttgtacttggacatatcttgaccatcatatatagacaaataccattcttgacgaaanatgtacattatatacccctttttcgttatctaattatctaagagatttacccttaaacttgtacataacaccttgagacgtgaatctacgatcatatcacacacatctg

SEQ ID NO: 6030 - DNA, 621 bp, Diabrotica virgifera
  misc_feature (352)..(376): n is a, c, g, or t
  misc_feature (400)..(417): n is a, c, g, or t
  misc_feature (455)..(542): n is a, c, g, or t
  misc_feature (555)..(575): n is a, c, g, or t
cagcgccatcttcgccatcggcctgaccgtacctgttctgacaggtccaggtccagctttccaagttaccgatggagaatgtgagaatgtctcaacagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccnnnnnnnnnnnnnnnnnnnnnnnnncattaatcgccctaaaccacttgnnnnnnnnnnnnnnnnnnggtaataactaaataaaggagagagagaactagtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaaatcgannnnnnnnnnnnnnnnnnnnntccgggctttttttttaacccaagttttgtttggaaaaatcttttt

SEQ ID NO: 6031 - DNA, 559 bp, Diabrotica virgifera
ctatgttgacggattctgtctttggcgcaattgtttatctacggtgcgtttagacaaacaaaatggcttgctttttagatgaacttgtgctagaagataattgcccttttaatgctgtagcatttttgggacaatatgacagccaggacgttagtaaggagagtgtaacaccgaatatcgtgggtatgcctatgtccatggtggagttggtagctaacaatgagtatgttcgcaaaacgattgacgagaaggaaagttacaagatggaaggtgtcgatttggttgtagggagacaaaagttgcgtgataggtttgcgcaacttcgttgggcgaacattattaacagcaccctcaagaggattttaatagaagccgatccagacttctttttgaatggagctattacaaagtttgaggaaggtgagtatagacaatcattgtctattttcaggagtatacgtagtttacaacctgcgaaggatttaataacaaagaaactttgtgaaagtaatactgggggaacatcatttgcttgttataggagattgttggacaaggc

SEQ ID NO: 6032 - DNA, 578 bp, Diabrotica virgifera
  misc_feature (562)..(562): n is a, c, g, or t
attcagtccggcacgcttcaccgcgtgccaaggccgcctaccgactaaactcaccccctctttctccagccgacgagtctggaaccgcacttagcgtgcatgtctgatccgccgaccttactcttaactcacctccggcactctccgcgtgcattccaagggttgggcggccatccagcccccccacccgcacgagcattgcaccagaccggtcggtgaagcgaccgtccggcgcaatccatgcgcgggcgagacgactggggtgccctcccaccacgatggaactagcaaaacagaaccagttggtaattacgagtaacgccaatcattcctactctcatcaattcatacacactcttcatactgccctcttttgcgatccgggccccccgatatttggctttagcttatttagtgttgaggtccttccctccgccttccgacatgcttcttgtatgtgttgcccgaagctaagtctattgtcaaaggtgcctaggtacctgactgtcctttggggtcttatttcgggagcctgatattcgaatactatgtcttctctttntctcgtatccacttag

SEQ ID NO: 6033 - DNA, 309 bp, Diabrotica virgifera
cggtggcggtcgatctagatataagtggatggcccggggtagcacgaattcaggatgatgtgaatccacattggtactgtcccgctctcttctacgtgatatatgataatctttatcttataatcgaagtcaatatatgatatgttgtgcttagtaatgtcactcctctataattttcacaaattggttggtctccctatttatgtattgttatgacctgtccgatcttccagtcctctggcatcttctcttccttccatatagatttcaaaagtgatagtatcttttccttcagttccttttctccat

SEQ ID NO: 6034 - DNA, 279 bp, Diabrotica virgifera
actatctctctctgtctctctcactctctctgtctcgacgcgcgcgcaaagtaacgcacggggggggagaaagagagacaaagagagagagagagaataaagacgaatataagaggacataaacagacagagaacagcggaatactaggggagaggacaaatcgacaaaagagacggcgaacagaatggcagaccaaagtggatagacgaggaagcaaggagagcaacaagacgggaagaacgttaaaacaagacaaaaagaaagattaaaccaggggg

SEQ ID NO: 6035 - DNA, 282 bp, Diabrotica virgifera
gtgaatccacattggtactgtcgcgctctcttctccgtgatctttgacaaacttttacttattatcgaagtcaatatgatatatgttgtgcgtaatagtgttattcctctataattttcacaaatatgttggtatccctttttatgtattgttattacctgccctatcttccagtcctctggcatcttctcttccttccatataattttcaatactgatattattttatccttcagttcatttcctccacatcatataagttccatgtcaagttcgtctctt

SEQ ID NO: 6036 - DNA, 446 bp, Diabrotica virgifera
ctgatgccgaattagatgatactcaagcgcaagacaagactggacaaaagacgtgttacacagatgtacaatcgacaaaagggtactgaacaaaactatggctcctagatttcttcagagagttgagcctgtggttgccgtataaggcatgccagataccatagatctgaaccgtggatggaagtccattgcctgatatcattcggtacactgacgagaaattgatacacgtcactggatgagcatacgttcacattgtggaaaatgccgctagcttgtgatttggtatacgtgagccttgagatgtagctctttatccatgtaaaggatcgaactgagcttgagcatgcacatctacagcgaagcttggcatcttactaaactaatacactggcgaagctacacactctggcaaacccttacaacctcgaatcattgaagagact

SEQ ID NO: 6037 - DNA, 127 bp, Diabrotica virgifera
  misc_feature (51)..(51): n is a, c, g, or t
tggtaatatctgcacagggacaaattcctgtggaaaggtgtccaaatgtanacgtagttacaaatttcaatggaaatgcatatttgggtgactggtacaaacaacccaaatacccacctttactgga

SEQ ID NO: 6038 - DNA, 679 bp, Diabrotica virgifera
ggggttttattatatggttctccttttcctctcaaatcagagtgaacaatgccagcagtagaagcattcttatttttgattacgtctgacacaaacatatttgtgacatcaaaagtggtcataaagcacgccttacagatgtttacattctctccgttaatgtaaagggagtaaaaatgtgtaatcattcgatttttatgtttcttgccgtcaatcttccttttcaatacgtttttttctttgcttgatattaatccggctatataggctacccttttactataatcaccaataccccacagctctttaaaaacttcttcccttttggtaacgttaattctctctttgcatttgattctacagtttgcaaggtccttaaattgtgttgctcttatctcgtgaacactagtataagtttacttatacttctgtatttaccttggtacgtattgcgccaaacaagttatattaagttatactacttttcacgtttatttagatacctatttcccagtgataatagattatgtcgacttaacctagtacttccaacaattacgaataaaaacggacttatgagccacgtttcttacatcgacgttcttggatatactgaactataatacttttcccaacaaagtaacttacagacaatgtcagatatgcacttatcgaattt

SEQ ID NO: 6039 - DNA, 285 bp, Diabrotica virgifera
  misc_feature (93)..(238): n is a, c, g, or t
  misc_feature (254)..(278): n is a, c, g, or t
aagaggcgtcactggcgtagaaccaagctaaagttgtaaattgtttttatattcaattgacctttatttactttagttaataaacattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaccacaccaaaannnnnnnnnnnnnnnnnnnnnnnnnggggggg

SEQ ID NO: 6040 - DNA, 181 bp, Diabrotica virgifera
  misc_feature (69)..(111): n is a, c, g, or t
gaatttaggttaccgtttttcttttaatataaaagctagactctattgagcctaggaagtatttgaatnnnnnnnnnnnnnnnnnnnnnnnnnnnnnnnnnnnnnnnnnnngaaaactacttgggccccttgggcccaaattgggcccaaccttggccccttgggccaaattcggcccagg

SEQ ID NO: 6041 - DNA, 582 bp, Diabrotica virgifera
ggatcaccaagatatcctgacgaaattgaagaacccgatgatgttaacgtaaggaaaccaccgaagagactttcggacatacctttattggaatcagaagatgttaccaactttagcagaataacagaaatctcagacactaaagtagttactgatatcgataaagtagaaacaacagacgagagtctcttgagcgttaatagaaagatcaatttgttcctagacactgctgataaactcaccaaaactggtaaaggcccatctggtccagctcctaaagtagaacgacccgaattggaagttacacaagatctggaatcagatgagtgtcttttgagcgtgtcagaaaaggttaacaagttcataaacactgctgatcaatttatgaatgttcgggatttgccagagagaccaaaaagtcctaggtgtaagtttaataacgataaaatttcttctaataactttattaccaccgaacaaaagacaattcagaaagaaaacctaactaatgagactcgaaaagtatctttagaaaatttaaacactgtcgatacctatagaaaatctgcgcccactgatatt

SEQ ID NO: 6042 - DNA, 176 bp, Diabrotica virgifera
cgacagactggactccactccccgcggggcgggcgatctataagattggatggccggggagctgagttcaggtgagtggtactatctgcacggggactaatacctgtccaacggtgtccacacgttgaagtatggtaaatatcgacgcaaatgcttttgtgggtgactggtgtcaa

SEQ ID NO: 6043 - DNA, 98 bp, Diabrotica virgifera
attcagccttaaggaaaataaaagtcttaattatttaagtgaactaattagtatgttaacatgtttctctaataaacatcttcgtttttctagacagc

SEQ ID NO: 6044 - DNA, 522 bp, Diabrotica virgifera
  misc_feature (4)..(35): n is a, c, g, or t
  misc_feature (49)..(83): n is a, c, g, or t
  misc_feature (97)..(147): n is a, c, g, or t
  misc_feature (178)..(214): n is a, c, g, or t
  misc_feature (216)..(271): n is a, c, g, or t
  misc_feature (274)..(318): n is a, c, g, or t
  misc_feature (321)..(349): n is a, c, g, or t
  misc_feature (353)..(417): n is a, c, g, or t
  misc_feature (419)..(431): n is a, c, g, or t
ctcnnnnnnnnnnnnnnnnnnnnnnnnnnnnnnnntgggtttccggggnnnnnnnnnnnnnnnnnnnnnnnnnnnnnnnnnnnatttaaaaagcccnnnnnnnnnnnnnnnnnnnnnnnnnnnnnnnnnnnnnnnnnnnnnnnnnnnaataaaatggtttcccgttttaaaaatttcnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnggnnnnnnnnnnnnnnnnnnnnnnnnnnnnngtcnnnnnnnnnnnnnnnnnnnnnnnnnnnnnnnnnnnnnnnnnnnnnnnnnnnnnnnnnnnnnnnnncnnnnnnnnnnnnngattgggggcatactgagctttcaaaatatggtttttttttaaaatctttttggggtaaaaaagggatttgggccctttttttctccccct

SEQ ID NO: 6045 - DNA, 206 bp, Diabrotica virgifera
  misc_feature (190)..(204): n is a, c, g, or t
gagaagccctataactaccgacattccgaggcctacacgcattgtcacagatacgggtacacatccatcttctgagaagacacctgcagcaaccactttagtgccatccagtactggtgcagcttattcacgatttatagcttcggaatgccttcttccattactaatgatagttattgcattgaattgnnnnnnnnnnnnnnnca

SEQ ID NO: 6046 - DNA, 439 bp, Diabrotica virgifera
  misc_feature (15)..(35): n is a, c, g, or t
  misc_feature (65)..(89): n is a, c, g, or t
  misc_feature (112)..(130): n is a, c, g, or t
cggcacgaggtctcnnnnnnnnnnnnnnnnnnnnnaattccatatgggttattaaaaagagtccnnnnnnnnnnnnnnnnnnnnnnnnnctaggcctttatatataccgccnnnnnnnnnnnnnnnnnnnaagggatcccagttctttggataatgggatgtgggaattgccgatgccattatggggccaaggtttacgaccccggccccaaaagagctgcccaaataaagaggggggttccacttttccccgttgggtagccaaccgatccttacaggacaatggccttctgggttgaaaatgcccataaatggtggctggtaaaatttaatccattcaattttggttccattgaccccagtctgtttctaaaggttctttgtgagcgtggttatactctgcggaggacaagggtcgttcgacaatttttggggccga

SEQ ID NO: 6047 - DNA, 196 bp, Diabrotica virgifera
atgtgttctaaaaaagcctggattcgtccacctccgtaggtctatccgacaagtgatgatttgacatgctcctatccatcactgcatgtgtgataaacaagcttgctatcatctgctgtggtctcctagtgggcatcacttattttatgaatgctagggtaccgctgaagtggatccctggaatgtgtatatcctc

SEQ ID NO: 6048 - DNA, 114 bp, Diabrotica virgifera
gaacaaggttacatcagagttgcccgtggtagcaacttatgtggtattaacctcatgaactcgtaccccaagttgtaaataacagttaatgaaaagtgatatatttataataat

SEQ ID NO: 6049 - DNA, 95 bp, Diabrotica virgifera
ctgtcattgaagtagattcaaatcgaaaggttaccagagaaaatcttgaacgtgtctattcagatcgagaagacagtacccgacattagaccact

SEQ ID NO: 6050 - DNA, 354 bp, Diabrotica virgifera
  misc_feature (307)..(319): n is a, c, g, or t
  misc_feature (322)..(346): n is a, c, g, or t
ccaaaaactacatttagaaaaattatttgtttggatcattgtgttggtattttgagatacattgcctgcgctgatggtcaaaaaccccttcgtcgagatggagatggacttttaggtaaacctcacacccattacgagagaagagtatttaaatcagaatggttacatttgggaggaaaattctgtgcaaatatacgcaatgaagtttctaccctagcgagcagaggcgttagcaatttagaaaaatatacatcagagcatgaactacacgtaaaatcaacgtgtaagaggagaggaaggtattagnnnnnnnnnnnnngcnnnnnnnnnnnnnnnnnnnnnnnnnggcccgag

SEQ ID NO: 6051 - DNA, 367 bp, Diabrotica virgifera
  misc_feature (318)..(353): n is a, c, g, or t
cttttaaaattaagattttattgtgaaagagagattgcaaatcaatggggggtaaactttatttgatctggatgcaaagttatgctctgttcgtattcttgtcccactttcccccaagcctaataatagtttaggctgcaacgtcgttggctatttgagtttatgcagacgtcctctacaagagcaccaagagtatcaaggagtatattcaagtgaccaataaacgtaaccatctggtccattcaaacttctatactaggcaagtatatattctttggtactacgtacaatcggattttcgtctataatctgtgtgannnnnnnnnnnnnnnnnnnnnnnnnnnnnnnnnnnncaactgataaattt

SEQ ID NO: 6052 - DNA, 515 bp, Diabrotica virgifera
  misc_feature (341)..(374): n is a, c, g, or t
  misc_feature (409)..(427): n is a, c, g, or t
gccaatttgcatgcctgccaaaggcagtagatcaaagtaaatagtggtgatgactaggaaataagatactgaaataagaatagatgtattgaaaatagataaagaagaataactgataaaaacaaaacataccatgggcgccagaagagagtatcgaccacacttccaggtatactacactgctgcaaaatatagtaaatatgtaaatacaaaaagaaggaaaaatgacataatacaatctttccaattaaatcttaattgtaaatttattaagtgaatttagtatcttttaattattccaatatctataagtaatagtcattcagggaaaatcctaatcnnnnnnnnnnnnnnnnnnnnnnnnnnnnnnnnnncttttgaatgcttccaacatcattaatatcccagnnnnnnnnnnnnnnnnnnntttgactttttcgtacacttggaaaattgaagaaaacgggaattgtttttaaccactcacgtgaaaacttaaaaaccttttaatacca

SEQ ID NO: 6053 - DNA, 498 bp, Diabrotica virgifera
  misc_feature (4)..(25): n is a, c, g, or t
  misc_feature (54)..(82): n is a, c, g, or t
  misc_feature (123)..(144): n is a, c, g, or t
  misc_feature (170)..(201): n is a, c, g, or t
  misc_feature (226)..(243): n is a, c, g, or t
  misc_feature (265)..(297): n is a, c, g, or t
  misc_feature (376)..(393): n is a, c, g, or t
  misc_feature (418)..(458): n is a, c, g, or t
ctcnnnnnnnnnnnnnnnnnnnnnngtgtggggctttttttaggggggtgggtnnnnnnnnnnnnnnnnnnnnnnnnnnnnnacccccccccaaagaacaagagggagccccccggcgagccnnnnnnnnnnnnnnnnnnnnnntccccccccggggggtcccttggggnnnnnnnnnnnnnnnnnnnnnnnnnnnnnnnntttaaagaacccccgggggagggcnnnnnnnnnnnnnnnnnncccccctggggggggaaaaccnnnnnnnnnnnnnnnnnnnnnnnnnnnnnnnnnaaatttttgggggggaaaaaccttttggggggaacaaagggccccaggttgttgcggggccacctgcgccccgcgggtnnnnnnnnnnnnnnnnnntttggggaaaccccccccccggggnnnnnnnnnnnnnnnnnnnnnnnnnnnnnnnnnnnnnnnnnggcgccccccccgtgagaaaccaaaaaataaccttgtttt

SEQ ID NO: 6054 - DNA, 93 bp, Diabrotica virgifera
accctccttgtcagggcatgggagcccctaatgtattcaccaatgtagccaactttgttgactggatcaatgaaaacatttcacaatagaatt

SEQ ID NO: 6055 - DNA, 307 bp, Diabrotica virgifera
  misc_feature (6)..(25): n is a, c, g, or t
  misc_feature (71)..(141): n is a, c, g, or t
ttttcnnnnnnnnnnnnnnnnnnnngttttcatgttaattttgattgttggtttcgaataaatgattatcnnnnnnnnnnnnnnnnnnnnnnnnnnnnnnnnnnnnnnnnnnnnnnnnnnnnnnnnnnnnnnnnnnnnnnntccccccaaagggggggcttaaaaaaaacccgggccccgttttaaaaaaacgagtgtctgggcaagagtctacgccggggttaaatcgtcaatcacagaccaggacctatacaatccaaataataacatgtcccaccaattagaagaaccccttttttggtaacct

SEQ ID NO: 6056 - DNA, 266 bp, Diabrotica virgifera
  misc_feature (145)..(159): n is a, c, g, or t
  misc_feature (161)..(195): n is a, c, g, or t
ctcgtgccggaaaatagtgatgttagtgaaaaagaaaggactgatactcgtcaagaattatgataaatagaataaattatgtacatattttttaaattgatttgtaagtgatatttacatttcttaagttgtatatgatttaagnnnnnnnnnnnnnnngnnnnnnnnnnnnnnnnnnnnnnnnnnnnnnnnnnnggggggggggccgggccccaattcccccttttggggggggttttaaaattccaggggcgggtttttaaaaa

SEQ ID NO: 6057 - DNA, 476 bp, Diabrotica virgifera
  misc_feature (181)..(202): n is a, c, g, or t
tttaggcacaaacttattaaaggaatggagcgtttggtggccagttgtggaggtctttggacaactccttccaatcctggtacacttttagttgatctcttatccgacgacaagaattcattaccgtagaggaagaaatgcaaaatagtattagagaacatagagacaacggccatgccgnnnnnnnnnnnnnnnnnnnnnntataattaggatacaaaaagttcaaaataaaaaattatgggaacggtatactcatagaaggaaagaagtttccgaagaaaacactaaccagtcatgcgaaagaatgctgttccatggttctccgttcatcaacgccattgtacaaaaaggttttgatgaaaggcacgcctacatcggaggaatgttcggcgcaggaatatattttgcagaacatttcgccaagagtaatcaatacgtgtatggaatatgaggaggcactggatgtcctacgcat

SEQ ID NO: 6058 - DNA, 256 bp, Diabrotica virgifera
gaaattcccgagtatattcgttccgataatagtccataaataacctgaatatcgtaaactctgttctggggcatttattgtatctatgaattgtctacatgcaagtggactgttacctgaatggtatgtcaccacttccacacatatcttggttccaaattagggcgttgttcactgtgtcccctggtaagatagtatcctacatgattaattcttcgagcccctagtacacttaccatctgtgctactacgtatt

SEQ ID NO: 6059 - DNA, 424 bp, Diabrotica virgifera
  misc_feature (2)..(20): n is a, c, g, or t
  misc_feature (94)..(115): n is a, c, g, or t
  misc_feature (151)..(171): n is a, c, g, or t
  misc_feature (214)..(249): n is a, c, g, or t
  misc_feature (276)..(316): n is a, c, g, or t
  misc_feature (320)..(352): n is a, c, g, or t
  misc_feature (358)..(414): n is a, c, g, or t
gnnnnnnnnnnnnnnnnnnntaattaaaggattccgccaccgtttttttaaccggttaataaaaaccaggccttttggaataaattataaggcnnnnnnnnnnnnnnnnnnnnnnggaagggccgcggaatttggaccgggctaaggtacnnnnnnnnnnnnnnnnnnnnnggaaagctgaattgaagggtggaatgaaaaaaaaactgctttnnnnnnnnnnnnnnnnnnnnnnnnnnnnnnnnnnnnaggctaaatttttttaaaaggaaagannnnnnnnnnnnnnnnnnnnnnnnnnnnnnnnnnnnnnnnnaagnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnntccatttttt

SEQ ID NO: 6060 - DNA, 244 bp, Diabrotica virgifera
tctcaatttattacattctatctgtatcattgaatgcactcaaattatgagtatcattatgtcgcggactggcggtgtcggtcactggcatacggcacaaagacaacaaatctgggactgcgtctccctctctggcacctccgaaggtagatgggtggagtacgtccatcatcaccacaagcacgatgtgctggctgcctatttagaatacgcgctccaggtacatgtacggcgcgtggatttt

SEQ ID NO: 6061 - DNA, 266 bp, Diabrotica virgifera
accaaaaccgccagaagtaatgggtggcttccaaaaaccgtatggagaaacaaatatttggccggggaaagcaaaataaaaggatacaataccacagtaagaactaatcctaacatatgcagcggagacaagggccggataccagaaagacgaaacaataaatcaacaatatcgaaatgaaagtattaagatcaatagcgggcatatcattaagaggacagacaaagcaacagaagtatacgaaaacgatgcaattacaggtggat

SEQ ID NO: 6062 - DNA, 316 bp, Diabrotica virgifera
  misc_feature (51)..(76): n is a, c, g, or t
  misc_feature (88)..(116): n is a, c, g, or t
tgaaatacaacgacatttttctggattttttgcaaatgtgtggggggcccnnnnnnnnnnnnnnnnnnnnnnnnnngagggaggccgnnnnnnnnnnnnnnnnnnnnnnnnnnnnnaaaaaaaccaaccctctttttcagggcccctttctttgaaattttttttggtaaaaacccccacttttattttggggggaccggggccgcaaaatacattttaaaaaaggtgtttttcttaaccaccgggtgcacaaaaaaaaaacctggatttttttacgggtacaaaaatcgaacccttgggcaattattccgagggg

SEQ ID NO: 6063 - DNA, 252 bp, Diabrotica virgifera
  misc_feature (144)..(159): n is a, c, g, or t
ggcgagttcagtacgacaataggcggaatccataaggagactatctgtgtgttggagcggctcgctctcggtgactcgcaatccggactctctcaggcgtgttgagtctctactgctaggtccaacatacgtaacggtgggaannnnnnnnnnnnnnnngcgatcgccgatgggttatcggtgtagtacatctatatatagtactagcacttagtgcgcgcgaccatattagacaacgcccaccatgtatct

SEQ ID NO: 6064 - DNA, 299 bp, Diabrotica virgifera
catggtcttcttggagtatcccctctccttaggaaccttaaccttcctaaaattttcaactctctcctgtaaatttaagtccaagccaatgaggaaatccttatccggtaatgggataattggtggtggccccggggcctccctttcttgacctttacctttccaattttggttttccaacctaaggttcctgggaccgtcctctctttcctttcggttttcctccgaatccttccaaccatggttttcaatggaattaataataataatcctaaggttgctcctggaccctttcctaa

SEQ ID NO: 6065 - DNA, 287 bp, Diabrotica virgifera
  misc_feature (241)..(241): n is a, c, g, or t
gaagaggcaatagccaaacgggacactcatacagttggagctcaacgctctcggttccgcgcaaaccggattctataataagtgttgagtaactagtgctaattctatttatgtctacgtgctcatagtgcatttattgagctatcgctagtagactttcggcgtccaagatatctatattgtaattgtgttgagtaaatagacttagtgaaaccgttcttttcgcatattacatttgtcncaaagctttgggtggtccttcgcataagtctaaagtaagtgaaacc

SEQ ID NO: 6066 - DNA, 129 bp, Diabrotica virgifera
  misc_feature (36)..(59): n is a, c, g, or t
aaaaacctaaagaataataatggtttaacggtaagnnnnnnnnnnnnnnnnnnnnnnnnacctaggttaggccctaatgggtggaatctaactttaaaaatcctggttaagttaacactctaaataact

SEQ ID NO: 6067 - DNA, 341 bp, Diabrotica virgifera
  misc_feature (26)..(56): n is a, c, g, or t
  misc_feature (289)..(311): n is a, c, g, or t
gagagagagtgagagaactagtctcnnnnnnnnnnnnnnnnnnnnnnnnnnnnnnngttcaatccagtgtgagaaatgatcaataactactaaataacttttcccagcgaattctaaaatatcagttccaattttgttaaatctaagtgtaggaactgagtgtggtaggagaggttctttgtaattggccggcatatatttttcacaaattcgacatgatttgataaacgaaactatatcatttgttagattaggccaataaaataatttccttgttcgattgataaannnnnnnnnnnnnnnnnnnnnnncatttattaggatacgttataacaatatac

SEQ ID NO: 6068 - DNA, 258 bp, Diabrotica virgifera
  misc_feature (12)..(41): n is a, c, g, or t
  misc_feature (43)..(75): n is a, c, g, or t
  misc_feature (86)..(111): n is a, c, g, or t
  misc_feature (122)..(141): n is a, c, g, or t
  misc_feature (152)..(209): n is a, c, g, or t
  misc_feature (212)..(248): n is a, c, g, or t
aatgaaagcttnnnnnnnnnnnnnnnnnnnnnnnnnnnnnncnnnnnnnnnnnnnnnnnnnnnnnnnnnnnnnnngtaaaaagccnnnnnnnnnnnnnnnnnnnnnnnnnnccttttaaagnnnnnnnnnnnnnnnnnnnngttttttaagnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnntccatttttt

SEQ ID NO: 6069 - DNA, 185 bp, Diabrotica virgifera
  misc_feature (32)..(60): n is a, c, g, or t
  misc_feature (79)..(99): n is a, c, g, or t
  misc_feature (127)..(140): n is a, c, g, or t
  misc_feature (142)..(173): n is a, c, g, or t
  misc_feature (181)..(181): n is a, c, g, or t
gagttctaattattttatccccccccccgtcnnnnnnnnnnnnnnnnnnnnnnnnnnnnnccccccccccgcgcgcggnnnnnnnnnnnnnnnnnnnnnctctctccgggagagaaaaaaattgtgnnnnnnnnnnnnnncnnnnnnnnnnnnnnnnnnnnnnnnnnnnnnnnaactttcngttt

SEQ ID NO: 6070 - DNA, 356 bp, Diabrotica virgifera
  misc_feature (328)..(351): n is a, c, g, or t
caacccattcttcggggttggaggttttaataatatttgaaccgcagtggtgggtaaaacaattattaaccaaaaccgtctattattattttttgataccttaatagtttatcaaaaaggtttcgtttatcaaaaaactttaatttaaaccagtacctttttgaataattaaccaaaccggtttttttttaatttctctaaaaacaattagaatcggctataaattaatataattatggtggctattcttcggcaaatgcttaattattgagtttcaaaagcaaagaacgggaaaactatgcctttttgaaaataactttttcaaacnnnnnnnnnnnnnnnnnnnnnnnntattt

SEQ ID NO: 6071 - DNA, 482 bp, Diabrotica virgifera
  misc_feature (418)..(419): n is a, c, g, or t
  misc_feature (426)..(471): n is a, c, g, or t
ataaaaggcagaataaggttggataataagttaagtccggttaataattgctggataaaccggtattttggtcacaatccaaatactttttggaccagaaaatttggtaaccattcaagtctaatcatttccttactatattgggaattctaagggattaatggtagaatatctttatttaaaaaattcacttgtggtttttggtaataagtaatattatttattttggaaaaagtatggtataaaaatttgaaggggtatttttgtgacggctttgtttcttataccccactattttatcacgaatgaagctgtacataaaggaatttgtatgaatacatcggcattgtcgaatttggtttttgatttttggcacacaaattttgtaaaaaaaccccaagtatgaataaaaatatannccttttnnnnnnnnnnnnnnnnnnnnnnnnnnnnnnnnnnnnnnnnnnnnnntgggggggggg

SEQ ID NO: 6072 - DNA, 195 bp, Diabrotica virgifera
caagaaaaaaaagggtggatagaatggaaccaaaaaccaagagcaatggcttttaaattaaaggattaatggaaaaaggatgccacctattggaagaagaaggactgcttcggttgtccctttctttcaattcaaaaaaataaaggtcttttgaatccgaaaataatgaatgttctaaaaccacaagtcttaggg

SEQ ID NO: 6073 - DNA, 308 bp, Diabrotica virgifera
  misc_feature (142)..(265): n is a, c, g, or t
ctcgtgcccgaattcggcccaaaattaataccaaaagaactggttttaataaaccaggggaaaaaatggtggccaatttctttattaaacctatttattttactaatttccattttttaattactatattaatcatcttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccaattcccctttaagggggggttttaaaactccccggg

SEQ ID NO: 6074 - DNA, 136 bp, Diabrotica virgifera
attccttattaaaattattaagggaatattggacctaattaccccaaatggtaaaatttttaataaggggtggtaattaataacctccaataaaaaatggggttggaaaatggcggttttattgaatcctaagaac

SEQ ID NO: 6075 - DNA, 108 bp, Diabrotica virgifera
aattaactcttttaaatatagggtccttaaaccgccaaatccttagaatggattttggatcctgtggttcttaaattaattgtaaaggtggaccattatttaaatttt

SEQ ID NO: 6076 - DNA, 390 bp, Diabrotica virgifera
  misc_feature (21)..(47): n is a, c, g, or t
  misc_feature (234)..(248): n is a, c, g, or t
ctcgtgcccgaatcggcccannnnnnnnnnnnnnnnnnnnnnnnnnnccccttttattacctaagtcccaacgaaaaaggggtttaagcgggggcaaaaaagcggcaaaaaaaaaataacctttcttttttaaaaaaaagtcccctcttttttggccctaatttaagccaaatcctttaaaagggcaaggggggaaaaatggttgggaaaaaattttataaatttaaccggccnnnnnnnnnnnnnnntggggggggtgggcccttaacacgggggacggggtcccccttttcggagggggcccttttttccccaactttgggcccaaataaagccttgggggggggcgaaaatggttccctccggccccccaacggggattttttcccg

SEQ ID NO: 6077 - DNA, 331 bp, Diabrotica virgifera
  misc_feature (164)..(177): n is a, c, g, or t
  misc_feature (180)..(192): n is a, c, g, or t
  misc_feature (216)..(233): n is a, c, g, or t
  misc_feature (294)..(314): n is a, c, g, or t
gtttgaacccttccacttttggaacctccaaaaaatttcgtggcccctttggcctaaaagggatccggccttaaagccgtcaagccttattccaacggtgggtaccttccacccttacccggttcaagtattaatgggggtacttaccccaccctcaactttcnnnnnnnnnnnnnnggnnnnnnnnnnnnnggcttataaaaaaataccggctgnnnnnnnnnnnnnnnnnnttaagaatggatggatcttttggctctccttctcataaaaatataaaaaacgggtttttcnnnnnnnnnnnnnnnnnnnnnggggggccacacccctt

SEQ ID NO: 6078 - DNA, 113 bp, Diabrotica virgifera
  misc_feature (64)..(81): n is a, c, g, or t
caaaactttactataattttgagcccaccctatcttatctatttccccccccaattttctcctnnnnnnnnnnnnnnnnnnccccctgtggagggacccccctttctcccccc

SEQ ID NO: 6079 - DNA, 104 bp, Diabrotica virgifera
accaaccaaacttttacctgcttacttagcctatttcgaccttccaaagggccggccgtggaagttcctggttttgcttgcccccggttttactggccgggggg

SEQ ID NO: 6080 - DNA, 351 bp, Diabrotica virgifera
  misc_feature (107)..(208): n is a, c, g, or t
  misc_feature (224)..(288): n is a, c, g, or t
  misc_feature (303)..(324): n is a, c, g, or t
  misc_feature (327)..(347): n is a, c, g, or t
tttttgtaaccaaatcgtaatccctcctaaaattacctaattttttaccaaataaaccaattctctctattaacaatttttttactattaaatattcttattttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactaataaattctnnnnnnnnnnnnnnnnnnnnnnnnnnnnnnnnnnnnnnnnnnnnnnnnnnnnnnnnnnnnnnnnncagcattgatgaatnnnnnnnnnnnnnnnnnnnnnnttnnnnnnnnnnnnnnnnnnnnngtta

SEQ ID NO: 6081 - DNA, 157 bp, Diabrotica virgifera
  misc_feature (113)..(135): n is a, c, g, or t
ctcgtgcccatttcgcacgaaccacaacttaactttccaaaggtggccaaattctaccaaaaatggccccagccttaaccttcagaaggtatgtgatcgttggacttctggtnnnnnnnnnnnnnnnnnnnnnnntaaatactggacctactatatt

SEQ ID NO: 6082 - DNA, 161 bp, Diabrotica virgifera
ctcgtgcccgctcgtgcccaaatccggaccaaggccgaacctcccgttgcagaaagggctccaacttcggataatcttcttctaaccacaagaaaaaaggctgtactaaccccccttggtcaaataactcgctttcccaatgcgcccaaaatccgttggac

SEQ ID NO: 6083 - DNA, 306 bp, Diabrotica virgifera
  misc_feature (18)..(43): n is a, c, g, or t
  misc_feature (54)..(74): n is a, c, g, or t
  misc_feature (127)..(129): n is a, c, g, or t
  misc_feature (131)..(131): n is a, c, g, or t
  misc_feature (133)..(135): n is a, c, g, or t
  misc_feature (139)..(139): n is a, c, g, or t
aaaccattaccaatttannnnnnnnnnnnnnnnnnnnnnnnnnccgggaccccnnnnnnnnnnnnnnnnnnnnnaatttcccctttgggggggggttttaaaaatcccggggccgggttttaaaaannntngnnnatanatctttggacgattttcgtgggttgtgcaccggaaacaaatatccaattttgagagcaacttaaattagggtggaatacttttgttaggatgagttacacattactgacgagattgttgattaaatatttgcgatcttgtcgatattttctattaaaataaattaat

SEQ ID NO: 6084 - DNA, 184 bp, Diabrotica virgifera
gttaaccccttcatacagcatgccaaaaatgcatccacgatctagtaccactcatctatgcggccacctgatgaccctcgggtaagctgggtgacactagcagtgtgcagcgtcattatatcaactactgtccgtctgcaatgaaatctcatatattttcacgtcttcgtgcgacttggttgtg

SEQ ID NO: 6085 - DNA, 224 bp, Diabrotica virgifera
ccaacctctggccgattccggaccaaggagaacccaaaccggttggccggaaccaccttacccttcaccttcaataaaaccaaagccgcctcttgccttccaggaaccaccggtaaggggcctttaccaaaaaccaccggaaaatggcaggtggtggtgattattggggaattagtgggaaaaaaggccaccggaattataaatttgggggccattggggccaa

SEQ ID NO: 6086 - DNA, 373 bp, Diabrotica virgifera
  misc_feature (96)..(120): n is a, c, g, or t
  misc_feature (208)..(208): n is a, c, g, or t
  misc_feature (350)..(350): n is a, c, g, or t
  misc_feature (352)..(358): n is a, c, g, or t
  misc_feature (362)..(364): n is a, c, g, or t
  misc_feature (366)..(368): n is a, c, g, or t
  misc_feature (370)..(371): n is a, c, g, or t
attcggcacgaaaatttaatattttggaaaatattccatacctaatatcctaccttaattttggcctataatatggtattcaaggtatttcccatnnnnnnnnnnnnnnnnnnnnnnnnngtatatgtaggtatttaaggtaaaaaaaattggtttcactggatttttcagtgatttaatacgaaatctttacccatctcatattatnggatttttgggcatatataattaagtatattaacgtatttaaaggtttatatttctcatataacgcaataggacacaatgttataaataaacatcttgaaattacaaattataatacataataaataaatcaggtcaattantnnnnnnnaaannnannnannaa

SEQ ID NO: 6087 - DNA, 149 bp, Diabrotica virgifera
catctaccgaatactaacaggacgacactcgaggaataatcgggccattacttcaagagcgttgttttttacataatgaccttgaggactttttcatagatccttaaacacacacctctttttctgactaacacttcgacctcctaaaa

SEQ ID NO: 6088 - DNA, 367 bp, Diabrotica virgifera
gaagggtcaagggtttattggtttgactacctatttggaccggtgggtggaaggtaaccataaccccatggattcctttggcaaaaagcgccaaatattccaactaatcaataaactataaaattttttttacttccattagaccaccaaaaccaccaaaaaagaactcttgtttttcattatccaagtttaacaccctaaaatgccatttaataacaaatggagctaagaattgttaccactactgcatccgaaagcatactatctatatgttatagtcaaagcccgaatttcaggcactcctaggtttgactaggcaatcctcaggtctgactgacggtcttaagccacccgcacacacagctac

SEQ ID NO: 6089 - DNA, 676 bp, Diabrotica virgifera
  misc_feature (85)..(112): n is a, c, g, or t
  misc_feature (364)..(364): n is a, c, g, or t
  misc_feature (403)..(403): n is a, c, g, or t
  misc_feature (420)..(420): n is a, c, g, or t
  misc_feature (475)..(475): n is a, c, g, or t
  misc_feature (491)..(491): n is a, c, g, or t
  misc_feature (528)..(528): n is a, c, g, or t
  misc_feature (533)..(533): n is a, c, g, or t
ctcctggccaattccggacgaagcaccaaatttttcttggcggagggatccacttggagaaaccatttaaaagaagtttcggaannnnnnnnnnnnnnnnnnnnnnnnnnnnccttgaggcctaactggaggtaccttctttcaaaaaccaaaattcagtggtaaagaatttgataaccaccagattcgacctagttaaaaaaaaggtggagggtataattaacgacattaggcacagcaaaattaagataggtaactatatgaatattcatcgagaaacggcaaaactcttcgaagaaatttaccaatttggcgaagctcgcataatgtatgatgctgatagaattcgtattgatcaggtcanagagggagtctataacgacgtccacgatgaacaagtaanatctgaaaaagtagaanatccatttgaaaatgtagcttcaatggtaaaacattataaatccagatcttttanagcaagacttgtatgngagaaatgtccaagacctgggggtgtaggcatacctncttgngataataacaaaatctacgttgcagctactgacacccacaatatcctaattctagatcgctccaaaattaaactccttggacgaatcaacaatccagaaatgttatgtccaatgaatctagcgttttcgagaaagtttgacga

SEQ ID NO: 6090 - DNA, 133 bp, Diabrotica virgifera
  misc_feature (10)..(28): n is a, c, g, or t
  misc_feature (39)..(51): n is a, c, g, or t
  misc_feature (54)..(67): n is a, c, g, or t
gtcctctcgnnnnnnnnnnnnnnnnnnnccttttaaccnnnnnnnnnnnnnccnnnnnnnnnnnnnnaagaccggttttttttcattccacccttcatttcaactttcaaaaaaaaaacctcgaggggggccc

SEQ ID NO: 6091 - DNA, 247 bp, Diabrotica virgifera
  misc_feature (15)..(29): n is a, c, g, or t
  misc_feature (77)..(211): n is a, c, g, or t
  misc_feature (220)..(242): n is a, c, g, or t
ctccaccgcggtggnnnnnnnnnnnnnnnaactagtgggatcccccccggtgctgcagagaatttcgtccccggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccttnnnnnnnnnnnnnnnnnnnnnnnccata

SEQ ID NO: 6092 - DNA, 372 bp, Diabrotica virgifera
  misc_feature (81)..(127): n is a, c, g, or t
  misc_feature (289)..(307): n is a, c, g, or t
cattgggacccctaatgtattcccaatggtaacccactttggttaactggattcaatggaaaccttttcccaataaattgnnnnnnnnnnnnnnnnnnnnnnnnnnnnnnnnnnnnnnnnnnnnnnnggaaaacttatatcaaagaacaaaacttacttatttttgacatgataaaccaaacaaactccaactaattaaagaaaaagttgaaagaattatttaccgtgggtggggggggcgcacacaacatatgttattttggtgagtgttattcgagactccgcgccnnnnnnnnnnnnnnnnnnnccatttggcgaagcttgcataatgtattatgctgatacaattccgattgatcctgtcaaagaagg

SEQ ID NO: 6093 - DNA, 533 bp, Diabrotica virgifera
  misc_feature (2)..(22): n is a, c, g, or t
  misc_feature (37)..(53): n is a, c, g, or t
  misc_feature (56)..(96): n is a, c, g, or t
  misc_feature (99)..(117): n is a, c, g, or t
  misc_feature (135)..(199): n is a, c, g, or t
  misc_feature (206)..(261): n is a, c, g, or t
  misc_feature (276)..(293): n is a, c, g, or t
  misc_feature (377)..(401): n is a, c, g, or t
  misc_feature (470)..(490): n is a, c, g, or t
  misc_feature (504)..(531): n is a, c, g, or t
cnnnnnnnnnnnnnnnnnnnnncccggaatgaagggnnnnnnnnnnnnnnnnnggnnnnnnnnnnnnnnnnnnnnnnnnnnnnnnnnnnnnnnnnngcnnnnnnnnnnnnnnnnnnncaaaaaccccctttaggnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnccccaattttttggnnnnnnnnnnnnnnnnnncttggggaaacccgcgtatttttttggggaggtccaatccgataataaaattggcccccccggggggggttaaaggtttaaatnnnnnnnnnnnnnnnnnnnnnnnnncccggtccgcttttaaaaatttcccggggccggggttaaaccgggggggccccgggtggggtccaatcnnnnnnnnnnnnnnnnnnnnnggcccgaggggccnnnnnnnnnnnnnnnnnnnnnnnnnnnngt

SEQ ID NO: 6094 - DNA, 295 bp, Diabrotica virgifera
  misc_feature (262)..(284): n is a, c, g, or t
acttcgggatattaccaaaagaggtcatacccccaataccactggcattttggggaggggtatcattatcaagtcacttgggaacactggcccgattcaacgccattcgaatttaatatttataccgtggaggagggatggatgaagtggtatgccttatggaagacttgattaccttggattaagactggaagtattaattggttgggttttaagggtgataaatttcgaatttttttaaaccaataattattggtatatnnnnnnnnnnnnnnnnnnnnnnngggggggggcc

SEQ ID NO: 6095 - DNA, 282 bp, Diabrotica virgifera
  misc_feature (62)..(81): n is a, c, g, or t
  misc_feature (85)..(261): n is a, c, g, or t
atggtggtggacctggtcaagtctaattttaaaccaaataataagggtaccgttaataaggnnnnnnnnnnnnnnnnnnnntaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccccccggcggcgccg

SEQ ID NO: 6096 - DNA, 217 bp, Diabrotica virgifera
cttgagaatttcgccccaagaagaaatgggttcttgcttgactgcccggccctggtggagggttgaaaaggtccagggaggaaaacttctggttatttccttcacttccggaaccaaaaaactttttccacccacccgcttaccaagttaaccggccgctaacttagggaaaaaaccttcggaaccaaaatacgtccttcctttattggtccggccc

SEQ ID NO: 6097 - DNA, 297 bp, Diabrotica virgifera
aggaaaccttagggggaaaaaaacccaggggtggacttgcccttttctccactttcaaataaaaaaacctacggtaaagggttaattcaaaaataaaaatggggaaaatggtggataataaccccaatgcgggcctcaacaaaacggttttttagaattaccttactttcccctttccaaaggggaaagccccggctccccttttttgggttggcggatcaggaaaaaatgtcaaaggccaaactgggactttaaattttggtcccacctccccaaaaaaattccccggggggaact

SEQ ID NO: 6098 - DNA, 297 bp, Diabrotica virgifera
aatattcgaggttggatcctttggattttgatggagaaatggtaccttttggaaaccgagttttgaaataagtcttccctattggaccctccaaataatcgaccccttcgaaggtaaaaaaatggtcaacccttatattaaactaacatttaaaaatttttggtagtttttcttggtataggtttataaaaaaccgggagtaaaaaaaatatgcgtcggattgaaaaggttttgggaaatttcactttgtaccagtaatattgcaagcttttcttgtagcattgaacaatgaattac

SEQ ID NO: 6099 - DNA, 515 bp, Diabrotica virgifera
  misc_feature (41)..(61): n is a, c, g, or t
  misc_feature (261)..(317): n is a, c, g, or t
  misc_feature (322)..(355): n is a, c, g, or t
  misc_feature (424)..(451): n is a, c, g, or t
  misc_feature (474)..(474): n is a, c, g, or t
  misc_feature (484)..(509): n is a, c, g, or t
cctctggccgaattatttattatattgggccctttcgtccnnnnnnnnnnnnnnnnnnnnngaatgaaacccaccctgcttaaacgggttaaaactcaaatcttgaaaaatttaaaaggccaacaaactttattattatagctggtcccccaatattaaacttaatccacatcgaggcgcatcttatatcgatttgactctcaaataaaataccgctggttatcctaaaggaaattattcttaatatcaaaaaaatgggannnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnctaaaaaacttattaatatttataaactctatagggcttctcgtctttaaaaaatttaagcttttaacnnnnnnnnnnnnnnnnnnnnnnnnnnnngaccgttttttttcattcacccntcaattcaannnnnnnnnnnnnnnnnnnnnnnnnngggggg

SEQ ID NO: 6100 - DNA, 78 bp, Diabrotica virgifera
ctgcctggtgcccgaattcgcaccaacttcttgccaaattcggaccaaggtggccaaattcggaccaaggggggggcc

SEQ ID NO: 6101 - DNA, 354 bp, Diabrotica virgifera
  misc_feature (179)..(179): n is a, c, g, or t
  misc_feature (190)..(191): n is a, c, g, or t
ctctgttttgtgccgcatgtattatgttcgcagcttctggtttttgaaaccattctctcaggttctcagccagggatttctttcttcctggccccaaacctctttctacctttcaatccttgcctttcgacgataagctgtagcagactgtacttatcattacggaacacatggcccangtatgacgctnntcctccttttacagttggtaacaattccaactctttacccattcgtctcaataccctctgtgttggtcactctgtctgtccaaggaattctcaatatgcgtcgatacagccacatttctagagccgctaactctttatagttgctgctgttaacgtccaccct

SEQ ID NO: 6102 - DNA, 426 bp, Diabrotica virgifera
atgaaactttactcagaatctcatgatctcgacacaatatcgagagtacacagcgaattatatgagttaaaggatataatggtcaaaaatattgataacatttcaatgagaggggaaaggctagaactacttgtcaacaaagcagacgatcttaatcaaggctcggtgacgtttagaactacgagcagaaacctaaccagatcgttattctggaaaaatatgaagatgtacattattattggcgtcgctgttactgtgatcgtctattttattgtctccatttcttgcggaggcttattatggcaaggatgtatttcgaaaaaataattaccaacaaatatattagtgaacttaagatacatcatataattttagggaaaatactttctatttgtaatgtttaaatcatgattttattgaatttta

SEQ ID NO: 6103 - DNA, 441 bp, Diabrotica virgifera
  misc_feature (23)..(38): n is a, c, g, or t
  misc_feature (40)..(85): n is a, c, g, or t
  misc_feature (93)..(144): n is a, c, g, or t
  misc_feature (146)..(169): n is a, c, g, or t
  misc_feature (172)..(184): n is a, c, g, or t
  misc_feature (207)..(237): n is a, c, g, or t
  misc_feature (239)..(258): n is a, c, g, or t
  misc_feature (272)..(301): n is a, c, g, or t
  misc_feature (320)..(356): n is a, c, g, or t
  misc_feature (381)..(401): n is a, c, g, or t
  misc_feature (410)..(428): n is a, c, g, or t
taattattaccttttgttaaatnnnnnnnnnnnnnnnncnnnnnnnnnnnnnnnnnnnnnnnnnnnnnnnnnnnnnnnnnnnnnncctcatcnnnnnnnnnnnnnnnnnnnnnnnnnnnnnnnnnnnnnnnnnnnnnnnnnnnngnnnnnnnnnnnnnnnnnnnnnnnnctnnnnnnnnnnnnnatatttaaaaccgaatacatttnnnnnnnnnnnnnnnnnnnnnnnnnnnnnnncnnnnnnnnnnnnnnnnnnnnctcttttaaatcgnnnnnnnnnnnnnnnnnnnnnnnnnnnnnnccctgatacacaaggtacnnnnnnnnnnnnnnnnnnnnnnnnnnnnnnnnnnnnnctctcacaatactaattaactatcnnnnnnnnnnnnnnnnnnnnnacttttacnnnnnnnnnnnnnnnnnnngttaaaataaatt

SEQ ID NO: 6104 - DNA, 319 bp, Diabrotica virgifera
  misc_feature (12)..(29): n is a, c, g, or t
  misc_feature (188)..(205): n is a, c, g, or t
aaaaatggcatnnnnnnnnnnnnnnnnnncaatcaatgggaaacaggggaacgtatggtttttttagtgcaagtatcttctagattatggaaaaagcttttaaatgacgtatttcaaaatttgatatacagtagaactccaattattcggactccaattattcggatcgcaattatccggatcagatnnnnnnnnnnnnnnnnnnaagtttgtaaaaaaataattcattttactgtgagttaagattgtgtgtccatattacgtaatgtaaactttgtcatttacatattggtgggtatactgcattatttttcataat

SEQ ID NO: 6105 - DNA, 149 bp, Diabrotica virgifera
  misc_feature (10)..(35): n is a, c, g, or t
  misc_feature (49)..(78): n is a, c, g, or t
  misc_feature (87)..(87): n is a, c, g, or t
  misc_feature (111)..(143): n is a, c, g, or t
tggggtctannnnnnnnnnnnnnnnnnnnnnnnnngcgaaaggaccacnnnnnnnnnnnnnnnnnnnnnnnnnnnnnnggtgttctnccaaaaaaaaaaaccggggggtgnnnnnnnnnnnnnnnnnnnnnnnnnnnnnnnnngggggg

SEQ ID NO: 6106 - DNA, 191 bp, Diabrotica virgifera
  misc_feature (41)..(60): n is a, c, g, or t
tacattggtatggtagtactgcgtctaccctgatttttagnnnnnnnnnnnnnnnnnnnnctttttaaaacaaatattttaatgttataataactagaatttttacgctgaccgctgattatttgtgttttttattttgttttgatatttgtgctaaaatatctgcattataattatcttcagtttgatcc

SEQ ID NO: 6107 - DNA, 343 bp, Diabrotica virgifera
ggtgacgagacacaatttaacaaaattttgggattaattaaagaaggccaaaatcagggcgcccagttggtacatggtggtgaaaggcatggagacaagggatactttattcaacccactgtgtttgctgatgtacaagacgaccatgtcattgccaaggaagagatctttggacctgtacaacaacttctccgatttaaagacctggacgaattgatcgaaagagctaacaggacaaactatggtctagcttctgccattttctcgaatgatgtcaacaaaattaactacatttctcaaggtttgaaagctggcaccgtatgggtcaactgctacaacgttt

SEQ ID NO: 6108 - DNA, 280 bp, Diabrotica virgifera
  misc_feature (222)..(222): n is a, c, g, or t
cacttgcttatacatttggcgcactgtctgtcaacgtgttaagcaactggtacgcgaaggaaaagatagaagcttaaaacaagaaaaattgaatcttgactatctaacatctcacctgataaaacaatgtacagtgaacgcctacgcagaaatgcacagcacgttaagaagaagagtctgtgagagttgatgaagagttgatgaaaggatgatacgtgattntttcaagcatctttttttgcctttcttcatttcttggattttctgcatctcttgatta

SEQ ID NO: 6109 - DNA, 291 bp, Diabrotica virgifera
tttaaaccacgtgacattcgccggagattagcataaatatgctgaaatttatccacacttattctcttaaaagcataaaatctgtctgagtggtgtttcttaagctctttgaataggtgatggcattcttccagatactgcctttttgatttaaaggatgagccgaaaactggcgatttgaagaattacaaatgatccaccacttttcacttcaagacatgtaattactgtcgtcaatactggtgctcatgtacataagtgtgaacagccgtagcgcagcggcatgatact

SEQ ID NO: 6110 - DNA, 366 bp, Diabrotica virgifera
  misc_feature (91)..(110): n is a, c, g, or t
  misc_feature (246)..(246): n is a, c, g, or t
agtacttaaaatgtcaaataaaaaattaagtgatgctgaattacgtgaaatagccgagaatatgagtgaaaaggagtatgagtttattagnnnnnnnnnnnnnnnnnnnnctatggatatagatgatccaaatgatcaagattcgtgttcttcttcctctaatttagaaattaacagtgatgggccagagttagaattcgaatctgatctagaatctctcaacaacgattctgaacctgataattntttaaataatcctaatcctaatatcatcttatatataaaaatctattgctgtgcgttagtctcgctaaaactcgaaaatgtgtggaccgatttggctaattttgatggtgaaatatttgg

SEQ ID NO: 6111 - DNA, 166 bp, Diabrotica virgifera
  misc_feature (136)..(159): n is a, c, g, or t
acacaacaagaacgtttgtggcaaactcaaaacctttaccaaactctaccacgcgtgtattaaaaactgctttatttgtaatttgttgttaaaatgtttgttataattgttgaaaataaataaacatttgtttttnnnnnnnnnnnnnnnnnnnnnnnnggggggg

SEQ ID NO: 6112 - DNA, 313 bp, Diabrotica virgifera
  misc_feature (76)..(100): n is a, c, g, or t
  misc_feature (238)..(238): n is a, c, g, or t
  misc_feature (267)..(267): n is a, c, g, or t
tatgataataataatatgtctatgagattgacgcgatcttttttctttttttctgcgataagtgtttgtcttcctnnnnnnnnnnnnnnnnnnnnnnnnngcttgaaatatcttggaactactaacaagtttcgacattaattaatttatatcgagaagatgtttatattacaatgtaaagcattcacagccttataaaaaatactttcaacctttgccttttcattgtgggtggganaaaaaaaaacacgccgacccgtcttctgncggggggtcgttgttctagggataaaataattatactatatttttt

SEQ ID NO: 6113 - DNA, 354 bp, Diabrotica virgifera
  misc_feature (6)..(116): n is a, c, g, or t
  misc_feature (118)..(189): n is a, c, g, or t
  misc_feature (191)..(218): n is a, c, g, or t
  misc_feature (220)..(334): n is a, c, g, or t
ttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaattcggccacatttttt

SEQ ID NO: 6114 - DNA, 57 bp, Diabrotica virgifera
  misc_feature (30)..(52): n is a, c, g, or t
gggggttcccccacctttgtttaatccgannnnnnnnnnnnnnnnnnnnnnnggggg

SEQ ID NO: 6115 - DNA, 203 bp, Diabrotica virgifera
  misc_feature (192)..(192): n is a, c, g, or t
ttttaggaacaaagtactatttatgttgacattatttgttagagattttaaagataatgaaaaagtggttccgctatttactgatattttaccacaattagcactactgaaaattgtttacaaacatatcagacaactttgaatattaataggcaatattatatttttctttagaggaacttagactgactntattcacattt

SEQ ID NO: 6116 - DNA, 210 bp, Diabrotica virgifera
  misc_feature (4)..(31): n is a, c, g, or t
  misc_feature (41)..(70): n is a, c, g, or t
  misc_feature (85)..(104): n is a, c, g, or t
ctannnnnnnnnnnnnnnnnnnnnnnnnnnncacccccccnnnnnnnnnnnnnnnnnnnnnnnnnnnnnnatactcagaaaaccnnnnnnnnnnnnnnnnnnnntctattggggcttctcggctttaaaaaaaattaagcttttttacttataaataaagaatctttataaattaaataaagacaggggtttttttattcaaccccctca

SEQ ID NO: 6117 - DNA, 51 bp, Diabrotica virgifera
  misc_feature (17)..(43): n is a, c, g, or t
gactaatctaggattcnnnnnnnnnnnnnnnnnnnnnnnnnnngggggggg

SEQ ID NO: 6118 - DNA, 387 bp, Diabrotica virgifera
  misc_feature (341)..(361): n is a, c, g, or t
aaaaatttagtcaagtttgatcggacatgcagtgaaagtccgtttttttttggtctgtgccaaagttaggctcaaatggaatcttgagtagattctgtagtgaaagtagcaagagcgatgtgtttgtcgtaaatactttaccggtatattcttgtgtatctaatagtggcgtagagtatgcctttttcaagaataacttaattcaagcttcgcaaggacgtggtccccgaccttttaactaaaaatcaattgtttaaacaaaattttgctattatcaagtgagcaatgtttaaattattaaattgtgcaaatgattcaataataagcaattaggtagttannnnnnnnnnnnnnnnnnnnnatggaattttatttttcgtataaaaa

SEQ ID NO: 6119 - DNA, 308 bp, Diabrotica virgifera
  misc_feature (73)..(100): n is a, c, g, or t
  misc_feature (218)..(263): n is a, c, g, or t
gcccccgggtgccggggggttaaataaaaaggctctttttttttctcccccttaaaaacgccccaaatttacnnnnnnnnnnnnnnnnnnnnnnnnnnnngaacttctttggaaggaaagggctccccctttaaacactttccacactttttaaagaaaaaatcacattcttttttttccccccttatttttaatcaaccttctttctcttttcaccnnnnnnnnnnnnnnnnnnnnnnnnnnnnnnnnnnnnnnnnnnnnnntttactttttaaccacacatccgggttaaaactccccctttttca

SEQ ID NO: 6120 - DNA, 211 bp, Diabrotica virgifera
  misc_feature (139)..(171): n is a, c, g, or t
attggagggagggaaatttgcggggggcgtaggggtcaagacattttatgccccttccaaaaaaaacaaaaggagttgcgccttttaaaccagggcaattgttttttccaatttacaaaactctgtttaaaaacctctnnnnnnnnnnnnnnnnnnnnnnnnnnnnnnnnnggggggggggccggccccccaccaccccctttgggggggg

SEQ ID NO: 6121 - DNA, 242 bp, Diabrotica virgifera
  misc_feature (17)..(56): n is a, c, g, or t
  misc_feature (94)..(94): n is a, c, g, or t
  misc_feature (151)..(170): n is a, c, g, or t
  misc_feature (212)..(237): n is a, c, g, or t
tttatttcttataaatnnnnnnnnnnnnnnnnnnnnnnnnnnnnnnnnnnnnnnnnctataaaacaaaagtttaaatttattgttttaaatcancccccaacttaaataaaatgttattatattaagataaatttaatacttaaaaaaccnnnnnnnnnnnnnnnnnnnntctatagggtcttctcgtctttaaaaaaatttaagctttttnnnnnnnnnnnnnnnnnnnnnnnnnnggggg

SEQ ID NO: 6122 - DNA, 305 bp, Diabrotica virgifera
aaaatggctcaatcctgggtgaaaaaacgggggaaggggcgccgctaaaatctgttaaatttaaacggtacccttccaaaataggtttctgaagtgatgggttttaaggggccttggggcaaatttccccaatattttgggctttgacaccgaaaaaggtggaccattaaccccccaattgtttaaaagggagctttgttcttttttgtaaaatgttgtgggtaacaaataaaccccttagggaattttcccctggtttttcccaattttgatctggcccaaaatttggtgggtgagggaatttg

SEQ ID NO: 6123 - DNA, 473 bp, Diabrotica virgifera
  misc_feature (152)..(170): n is a, c, g, or t
cagcgttcacatacacatatgttcatgtaatattcaggggtgacatctttcagagtgcggtctttacttcgcctacataaaaggacttatccaaggtttcgttcatgacaactggaacgcactatatttgaatgtattaattctcactcacnnnnnnnnnnnnnnnnnnngtggggtgacattgtaccgatatattaattacactaagacattttttatacatcggccatttataatttttaatgttttttacaaaagtcgcttatcgcttagaactgataacttttaaagtcacttataattaataagcacatattggtgatataagtaacataaattctttaatacatgttatgtttaaacttatgtttaatgtaaatttacaattttctttctattttagtgatataaggcagcttgaaagccaaacagcactatggaatattttacagtaactgaaaattgaaaatttt

SEQ ID NO: 6124 - DNA, 358 bp, Diabrotica virgifera
  misc_feature (8)..(27): n is a, c, g, or t
  misc_feature (223)..(223): n is a, c, g, or t
  misc_feature (252)..(271): n is a, c, g, or t
ttataacnnnnnnnnnnnnnnnnnnnnctatcgataatacgtgtgaaaattgccaaaaatagcaaaattccaatcaaaaattaggttggagaaaatataaccctcaaagttcaaaatcggtataagttaaaaaaatgcagtttctcggcattccatggagcaatttccttcattctttttttgttcccaagtatctcaagtagagccatcgaactaacgcatntttaaatgtcaaacttgcctttgttttgnnnnnnnnnnnnnnnnnnnntattataacacaaaattttaatttgtctaaataaaaactgtttaaataactatacagctttccaatgagaatatttatatttttaac

SEQ ID NO: 6125 - DNA, 99 bp, Diabrotica virgifera
  misc_feature (48)..(65): n is a, c, g, or t
gcgacatctactaaaaaattgaagatatctcagatgcaaaatccaccnnnnnnnnnnnnnnnnnnggtagatagtattttagaactgagaattttcgtg

SEQ ID NO: 6126 - DNA, 415 bp, Diabrotica virgifera
  misc_feature (382)..(408): n is a, c, g, or t
gtgttcctaaatctggagaaggattcatagattttattggacaggtccacaaaactaaggagcagtttggacaagatggacctatcactgtgcactgcagtgctggagttggtagaactggtgtgtttatcacactaagtattgtgttggagagaatgcaatatgaaggagttgttgacgtgttccagaccgctagaatattgagaactcaacggcctgcaatggtccaaactgaggatcagtaccagttttgctacagagccgcactggagtacctcggctctttcgatcactacactaactaatcaatactcataagaaagaattaattttgaatcgtatttatgcatattgcatatttttactgccaaacaggatattnnnnnnnnnnnnnnnnnnnnnnnnnnnggggggg

SEQ ID NO: 6127 - DNA, 579 bp, Diabrotica virgifera
acctcctgcccaaattcgcacgaggaaaaaaaatatatttgggtttaaatgttaaaagagtcgataaaaaaagtgagttttttccttataaacaattataatatctttgtcatttttaagataaataatagggatgttcacaaaaaattaaaaagtcatttcaaacatgtaaaacgattaagaaacaccctaggaataattgtccaaaatttcaacaaaattggaaaagcctttctataaaaaatctttattagaaatctagcattattttaaatttcaagaacgcttctctattggcctgacgtcactagttgcataccgcaagcgcgcgctattctcatagtgtaactgtttacctgtttgacgtttcaggttattttattttgttctcttcttgtttatcagggttaaagtggagttttatagtgaatttgtttagtttacagtggatagactgtttgtaaggacatattttgggttttacaaaaataaacacataaaatggaagaaggttgtcagaaaaccgattcgtataaacgaccgactgtagtgtagatgtaacaatggtgtttgatttat

SEQ ID NO: 6128 - DNA, 480 bp, Diabrotica virgifera
  misc_feature (457)..(457): n is a, c, g, or t
cttcaaattagttagagcacgccatatgttctcgtagctaggcatgtttgtataacacttcttggtcaccatataaagcaaagatcgagaaccatcttctaatcgcagtacttttccaactttaggctgctgatttttaactcgttcaggcggccgaactttctattgaatacggacgagattcctttagtcatctcgactacttgggcaacacagtgggctaaagagacgttttctgaaacactaaacagatcttgctgaacttctatggtcacgccgaatctagcactccttttctctgcgtaattttacataaattccttaaaacttggctgtgcggcatcttttatctcctgttggaggactcgggcttcttctgtttcatttgagccagcatatggtgcaagatgatttatgtgaatatcttttggtttaccgtttggcaacttcttaattntggatattacgtcatttattttc

SEQ ID NO: 6129 - DNA, 566 bp, Diabrotica virgifera
  misc_feature (26)..(60): n is a, c, g, or t
  misc_feature (562)..(562): n is a, c, g, or t
gcggcttcgatgcgtccttgagttcnnnnnnnnnnnnnnnnnnnnnnnnnnnnnnnnnnnagacactctctaatctttctgttgctttcctcagtcgttcgtaatccacagttccttgtacggtaagaagctcgaccatgaagtccgcctcttgtacactctgctgcaccaactccaactgccgctcgaacctcttccacaaggccaatctgcttctcagaagagccaggatatcgccgcatctcttctccaaagctgtgtggtcatcctgtaatttggagatgtctctttcgacggtgagtggagacactgacaccttcagtctagttggaagaccgtgaagtagttgtctgatggccattaagtcttgccataaagttactagttcttctcctacttcgtagcattcggagactgacttctcgatcgagtcgctgcctagtttttccgagctttcacaaaggtctagtctcttactcatttctccatgtttccttctaactcgttcaatgctcttttgaatggcttgaattgctcttttactaaagttcctccttccagntctt

SEQ ID NO: 6130 - DNA, 336 bp, Diabrotica virgifera
ccaaatacaacactcccaattaccgggtgatcgtacgtatctccaacaagaacataacttgtctcattgctttctcccgtctcgagggagacaatatcgtgtgtgctgctcactcccatgaattgcccagatctggactcacaactggtctcacccactatgctgctgcctatgccactggtttacttctggtctccatgttgctgattatatgacctcactgcacgatgatgatccatacgcattccacatgcacttctctctatacatcactctgggaatcagtgctcaccaaattgtttatatgtacaacattgcccatactgacagtcgtgc

SEQ ID NO: 6131 - DNA, 423 bp, Diabrotica virgifera
  misc_feature (7)..(8): n is a, c, g, or t
  misc_feature (10)..(67): n is a, c, g, or t
  misc_feature (86)..(109): n is a, c, g, or t
  misc_feature (127)..(222): n is a, c, g, or t
  misc_feature (266)..(311): n is a, c, g, or t
  misc_feature (325)..(347): n is a, c, g, or t
  misc_feature (350)..(363): n is a, c, g, or t
  misc_feature (385)..(421): n is a, c, g, or t
tcgagtnnannnnnnnnnnnnnnnnnnnnnnnnnnnnnnnnnnnnnnnnnnnnnnnnnnnnnnnnnngggggggaacccccccccnnnnnnnnnnnnnnnnnnnnnnnncaaaaaccccccgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctggccgggggggggggacaactttttttttgtgcccgggnnnnnnnnnnnnnnnnnnnnnnnnnnnnnnnnnnnnnnnnnnnnnnaaagggggggccgnnnnnnnnnnnnnnnnnnnnnnnttnnnnnnnnnnnnnnacccccccatttttcggggggnnnnnnnnnnnnnnnnnnnnnnnnnnnnnnnnnnnnngg

SEQ ID NO: 6132 - DNA, 308 bp, Diabrotica virgifera
  misc_feature (83)..(95): n is a, c, g, or t
  misc_feature (98)..(115): n is a, c, g, or t
ctcctttgttgccctttaaaaaataactgaaaatttcctcaaccttctttttaggattttttttagaataaactaggttcagnnnnnnnnnnnnncannnnnnnnnnnnnnnnnngcccacattcaaaagggctttttctcctctcctttttttgtggaagaaaaccaaattgggcattttttcctgttttttttttgcgaatgttgcccaattttccaaactaatagtttggaacaaataaagaattaaacttcctttaacaattttttatatgaatctcgaaaatggggctttttcttttttaaaa

SEQ ID NO: 6133 - DNA, 212 bp, Diabrotica virgifera
cgttactagaagtgcaatcacataccgttcatatagatggccaacataacaatataaactgacgtgcaagacttggtgttctcacgattgttgataacatcataaatagtgcccacgcactagtggacaaatgaggtcatgttgcattcaacacacttgatacggtcatgataaagtaacaaccgatactggtcatcttagatgcgggttgc

SEQ ID NO: 6134 - DNA, 136 bp, Diabrotica virgifera
  misc_feature (25)..(85): n is a, c, g, or t
caacagctgcaccatacacttatgnnnnnnnnnnnnnnnnnnnnnnnnnnnnnnnnnnnnnnnnnnnnnnnnnnnnnnnnnnnnntccagctttgtaacgatagaatacaataaaatcgtatccattatttactag

SEQ ID NO: 6135 - DNA, 232 bp, Diabrotica virgifera
  misc_feature (73)..(93): n is a, c, g, or t
  misc_feature (95)..(119): n is a, c, g, or t
gtaatgcaccataaaagtcttaacaatagcaaaaatgtatttaacttatcatttatgtttgaaggacgttagnnnnnnnnnnnnnnnnnnnnnannnnnnnnnnnnnnnnnnnnnnnnncgccccatatgaaaaaagtaaaaaaatctgcaagggggggcccagcaaccgttgcaccctattctaattcatattactctcattggccgtcttgttacaccatctaaatcggg

SEQ ID NO: 6136 - DNA, 323 bp, Diabrotica virgifera
  misc_feature (203)..(234): n is a, c, g, or t
  misc_feature (253)..(253): n is a, c, g, or t
cagatttagttaacaaccttggtacaatcgcaaaatcaggaacaaaggcattcatggaggccctcctagctggagctgatattagtatgattggtcaatttggtgatggagaaaatgcttcccgtatggaagaagtaaattaaatgcattcgtttaaagagcatgtgttgtaatatgttcaaatgacaatttctctcattccnnnnnnnnnnnnnnnnnnnnnnnnnnnnnnnnacagagtattactagcatntgatagggtactggaatattctggctgtgtaaagtactaatgaccaattgtcgattcacaactgtactga

SEQ ID NO: 6137 - DNA, 614 bp, Diabrotica virgifera
  misc_feature (47)..(47): n is a, c, g, or t
  misc_feature (189)..(207): n is a, c, g, or t
  misc_feature (371)..(371): n is a, c, g, or t
  misc_feature (426)..(426): n is a, c, g, or t
  misc_feature (525)..(525): n is a, c, g, or t
  misc_feature (574)..(574): n is a, c, g, or t
  misc_feature (588)..(588): n is a, c, g, or t
agggatacaggagaggggagtctttcttttagctgaggccagcgcanctggtaacttgattacagaaagttatgttaaagatacactaaaaatggcagaagaatattcagatctagttgcaggagtcgtttgtcaaaatccgttatttttaaacagtcatggtctcatccatctatgcccgggagtccnnnnnnnnnnnnnnnnnnntaccttaggccaaaggtataactccccagaaacggtggtcctagaaaaaggtgcagatatcgctgtagtcggcagaggaatcacgcaagctccagatcccgcaactgcagctgaatcttacagacaactgttatggaacgcatatgaaaagaaaacttgaccanaaaagagattaaaaggaaatgttcaaaatatatttaggtaggttcaaaatatatntgcccatatcgaataatatgtctccaaatatatacatatttcaatatcttctcgtcaaattttaggaccattaaggctgataaaaggaattgaactctntatattccaatatatggatagttctagagacattccagaaaagtatatntttattatatgtanaaatggatgttatcaaataaatattt

SEQ ID NO: 6138 - DNA, 571 bp, Diabrotica virgifera
cagggggccaaatccgcaccaacccgagctaaaaaaatatggggaatgggcaactggaggaggacagagattcttggaggcagatgctgggggaggccagggtccgacttgggctgtagcgccataggaaagagagagataagctagttatcggagagaccttaaattaacatttcaaagacaaaggggatggcagttggaaagattaatatagatcaagatgtgtttcctcttaatggagaggagatggaacggcggatccaaccttgcaaggtgggggtaatgaaatgcaaattttctcgtgtctggcgtacgcaggatttttttcgggatgggctgttattttcttattcttcatgtaccgtgtcctttcagaacgttggttaacatcataggtatcttaattttatttattgccacctaaattaacgttcttcttcgtcctggactgcgtttgcctgctattttcacttgaataatattttgtagcaacctatatttgggacctctcattaaacgtcagaaataatccagctatctcttcttgatgcttcttataatcgcagtagtc

SEQ ID NO: 6139 - DNA, 645 bp, Diabrotica virgifera
  misc_feature (614)..(614): n is a, c, g, or t
gtaccccgtaacttcgtgtttagctgtatttaaagcctgtcggatcttcgacaaggtgttgtcccaatcgcggtgctcatctatatacgaccgaattgcggtaccaattgttttattggttcgctccacaaaattgcattggggcgaataaacggcactgtaccatatcttacggacgttatacctctcacagagatttctcaaaggggggccggtaaagttgtgggcattgtcacacattacgtattcaggaacgccaaatataaggaagacgttatcttctagatacgaagcgatatttgtggcggttgcattccttagtgggtgtaggagagtgtattttgaaaaccaatccgcaatcaccaagagccatgtgtaacctttcctggacctagttaacggacctatcaaatctacggcaatcacttgccacggacggtcggccgttttctcgcgacccatcattcccataagacccgtatttggtgctttttgtgcaccacatattaagcaggacctaacatattggagaatgtcacgcctcattttcggccaatagtatcgctcttgtactcgggacaaaattttataaaaacctaagtgagcacacctangcggatcgtgacatgacttattcacctcggg

SEQ ID NO: 6140 - DNA, 238 bp, Diabrotica virgifera
  misc_feature (60)..(78): n is a, c, g, or t
  misc_feature (194)..(194): n is a, c, g, or t
tttaaataaatttaagctttttagcttaaaaataaaattctttataaatgaaataaagannnnnnnnnnnnnnnnnnnccattcattcaagatttcaataaaaagactaatgattaagctaccttagcacggtcaaattaatgcggtcattcaaattaatcagtggaggtgcgagactttatatttgatactanctctcattccttatttatgtccatgggggggccggtttccattt

SEQ ID NO: 6141 - DNA, 237 bp, Diabrotica virgifera
  misc_feature (13)..(36): n is a, c, g, or t
  misc_feature (93)..(119): n is a, c, g, or t
  misc_feature (162)..(180): n is a, c, g, or t
gaactattctcgnnnnnnnnnnnnnnnnnnnnnnnnggaatctcaaagggggggggggtattatcattatatcaaacaaagggggggtcgttnnnnnnnnnnnnnnnnnnnnnnnnnnngtttcttcaaaaaaaccaactttttttaaataccctcatgatnnnnnnnnnnnnnnnnnnncatatgatccaccaacaataaaataaattaatctactttaactaataatcaaccaaa

SEQ ID NO: 6142 - DNA, 272 bp, Diabrotica virgifera
  misc_feature (2)..(19): n is a, c, g, or t
  misc_feature (25)..(25): n is a, c, g, or t
cnnnnnnnnnnnnnnnnnncatcanaggtcttttggctttctaccgtggattcttttacttagtgataagtttgtgagttacaaatgtgacgacattattggttccaaaatgggacgggccaaccttaagaagattattagtccattatgggcccggttacttcccaaatatattccaaagcgagcggtgcctattttctggacacgaatgataaacctccctatgcccagggttaaaatctgagattgtgtttatatttctcgtgccgaat

SEQ ID NO: 6143 - DNA, 568 bp, Diabrotica virgifera
ctcgagcactggtccacgtacgagaagagatcactggccacactcacgagtgacgattcagaaggaagctcataaccagtctactatgatggtcatcggagtatactctattggacaacgcagtctacaccatggacattggcattctcgcaccaggaccgtggtaccacgttgaacgctaacgacatgaaactttaatgcgcacgaatctacccctaaaagcgcaccactcttacgagaacacacttcggacaatacgcatatatagcgtggattacggacgagtatagcgcgattcagttggaagcacactactgtatagtagcacacactcgctcgttcaggatctgtcaagcgctcagtacgacagtgtcatacactcagctcatgaggactatactgacgccttatccatactacactgaggcgttgtctatgatggtgggagcttgcgttttctcgactgtgagattacatttaaaagagagtgagactatgtcgtatagtgagtgatacactactctattatgtagtttacatgacgttacgatttagaaaatattatgat

SEQ ID NO: 6144 - DNA, 465 bp, Diabrotica virgifera
  misc_feature (51)..(51): n is a, c, g, or t
  misc_feature (71)..(92): n is a, c, g, or t
gtaagtaccaattagtgaaattaaacacacagttgttataaatatgtattngcggttgagaagtcatcacnnnnnnnnnnnnnnnnnnnnnngtcattaatgtcactgaatgtattttttcgtagcaacgaagagcatctgacgtaatatgcttaacgacgggagattatcaaaaattatcaccttaatttgcatgtctgaagctttctattggtcagaatctcctatgaatgaaataatctttgtaatttctcactttttatgattgttgtaactctataatttttctaaataagttcgtcctagccacagagtttccaaaggaaaagggatgtcatcacgcgttcttagcagtagactaataagcaagacaatgcgcagtcttcattgagactcggaacccgatttttgtccacaacaattggtgtttattttgtaatgcaagaataggctagtttaaaatct

SEQ ID NO: 6145 - DNA, 630 bp, Diabrotica virgifera
  misc_feature (577)..(578): n is a, c, g, or t
  misc_feature (619)..(619): n is a, c, g, or t
ggctgacggcagaattgaataatgagcgaaggcgttagtccctggaagaccaaccaccatgacatcggcatgctaatgttgaaagacagaagagaaaagataacgaacgccggcaaatactccgatcgttacaaagacattttttcgcatgaagtgcccgacgaagaaaaattccccttaagtgctaagtgtcgcgataccatggaacactaccgtaaagtgtcaaaaggggggaagcccgaagactcccctaccgcggtgtcaaaactgaccacggagaaaatgaagcttacagtaggtaagaaaagtagcaacgctaccaatgacctaaataaacaagagaatgctttaataggattcaagcacgtaccggagggtacccacaagccgaaccaacccccattgccactaagttcaccgaacaccaccaagtggcagaagaggaacgtcaacgtttacagcgtcaacacaaacgttccaccttctagtcctaatcaaatcagagcacctccaggattccctcccaagaaacctccacctgtagctctaagcgcgatactcaacggaaacaacaacnnacaatatatcactaataacaacaaccactttcgatatactntatcgcatcta

SEQ ID NO: 6146 - DNA, 673 bp, Diabrotica virgifera
  misc_feature (195)..(211): n is a, c, g, or t
  misc_feature (626)..(626): n is a, c, g, or t
atttaaacttcttttctactaaagtattctaatttatggtgtacttagttcagaggtgtgtgaattaatgaaatcatatattaaatattgtcaatacaaaaatccttcatatgcgttgcatagtgaaggtttttagacttttgtgattatattcactaacaaaatctgaaaaacattgttaaaattatccggtannnnnnnnnnnnnnnnnacttttgatcaacattcattgaaattaccaacattgattgatctgcttaattaaatcagatctattgctcaatgatctattttagcttgctgtgtgctgttttggaaaatatttgcttacttttcaaaagcgcaattttgttcctgactgctgacgtggtccttagggccgtattgataaattcaacaatgaatattgatcaatgtatatattttgtaaatagtatttgtattttaacttattttttattgtgagttgatttttgggaggcgaatattgctcatcacaagattaaaattagtgtcataccggttcttgagttacctcattatttattaatcttcttgttcaacgaaatgttattttaaaatgcgcaatattggaatgtcccaaaacgttctttgaggaatagttntgttagcaataaatttttgttgtgattttgggacaggggaggatatg

SEQ ID NO: 6147 - DNA, 510 bp, Diabrotica virgifera
  misc_feature (264)..(264): n is a, c, g, or t
  misc_feature (408)..(408): n is a, c, g, or t
gaacttttattaaaataaaggtgtcctctaattttccttaaatacaggcattcttattaagatttattaaaagacaaaaataaaagacgcaatactgcgcatgcttatatgtcaaaataaaggatcttttattacaggtcgacttaaaagacgttggcaataactctctaatagctatctatttccagacttaatattctcttggggtgagttgtgtattctaattattttttcttgtaataacatttctacatctaacggctntttctaaaaaattttatatctaacctaacctcccatctaaaagcatggtttctgatattttagttttaaatatatctttttaatttacatataggcatgtgtagtaatcaaaattttaactatactcctgatcttaattccatntaatttatcccttgctatctgctactgtgtgaatacattttggcaaagggtaccttttcttcttgatgtcaaaacttatacatgcattactcttctagtttt

SEQ ID NO: 6148 - DNA, 553 bp, Diabrotica virgifera
  misc_feature (249)..(267): n is a, c, g, or t
  misc_feature (424)..(424): n is a, c, g, or t
cggacaatgccagttgtccttgcaagcaaagtgccgagatgtttccaaaattacatggagatgtgattgttttgggagcacgtgacactgcttttgactgcgccacttcagctttgagatgcggagccaagaaagtctttgtggtgtttaggagaggatttactaatattagagccgtaccagaggaggtgtcagtagcagttgaagagaaatgtgaattgataggatttttggctcctcattctgttnnnnnnnnnnnnnnnnnnnttgtttccgttacattcaattgaactgaagatactgaagatggcaagtgggtacaagatactgaacagctaaataccatcaaatcaagcttcttaatatcagcgtttggatcaggagtagaagatcaggaagtcatcgatgctttagctcctctganactaggacctaaaaacctgccagtagttgatgttaatactatgcagacatctcatccttcggtgtggggtggtggagatctcgctggagtcgctgaaactacagtggaagctgtgaatgatggaaaaat

SEQ ID NO: 6149 - DNA, 147 bp, Diabrotica virgifera
cagctccaccagacgcagagtatgatttaatctccccgggttttaccctttatttttgttactccattctctctgttacctgatcagtacaatatttttgttaatgttgatttcaacacatttgtatatattgttcttattatcatt

SEQ ID NO: 6150 - DNA, 207 bp, Diabrotica virgifera
  misc_feature (65)..(82): n is a, c, g, or t
  misc_feature (104)..(124): n is a, c, g, or t
  misc_feature (132)..(150): n is a, c, g, or t
ggagatattcccggagttagatttaaggttgttaaggtcgctaatgtgtccctattagctttatnnnnnnnnnnnnnnnnnnggccaagatcataattaaaatnnnnnnnnnnnnnnnnnnnnncttggcannnnnnnnnnnnnnnnnnngtgttaagcatataattttgtacagtgttttatttcaataaacaattttatacctgt

SEQ ID NO: 6151 - DNA, 557 bp, Diabrotica virgifera
  misc_feature (61)..(84): n is a, c, g, or t
  misc_feature (145)..(170): n is a, c, g, or t
  misc_feature (346)..(363): n is a, c, g, or t
  misc_feature (443)..(461): n is a, c, g, or t
cacccacctgcctcttgccagtttgaacatttcggttaagcgaaaatcaatgttgatttgnnnnnnnnnnnnnnnnnnnnnnnnctgacagtagtaaaacgcattttgaattaaataaattacatacattcttctttctgtctcnnnnnnnnnnnnnnnnnnnnnnnnnnttgcacaccctgtgtaaataattatgttaatgtttacattagtgaatagagaattgaataccctctcacctgagttatcacatgacccatattttcatttaaaaaaaatcatcgattacgtcatcacgtccagatggatgacgtcactagtatgatatatatgccaacaaatcggnnnnnnnnnnnnnnnnnngacctgtttcgggatttttcgcgaaagttgtcggtttatgaaataatgaaattatgcgttactttttggacgcactgagnnnnnnnnnnnnnnnnnnngtgattgattaattgagttgctacgtattcttacttataatataaccattacttaatacttttgcttatttaaccaatcacatcaaggtttttatt

SEQ ID NO: 6152 - DNA, 202 bp, Diabrotica virgifera
cttgtgttgggtttctcctgcgtggaattggaaacatcaatagctactcgcaccccaatttcttggttgttgatataaattctgctgttatcgaaatacaatatttcttttatcgtatcctcataagatatgatatcgatattatttgggtcatccaaaactttgctgatctcatcatatatgttttcgatagccactattc

SEQ ID NO: 6153 - DNA, 488 bp, Diabrotica virgifera
  misc_feature (194)..(212): n is a, c, g, or t
agacagttagctttatgatgaacacaacatatcaagaggatattgacgttaaatttggtgctgattgtaataattctctgcatatataacgaaacatcaatttgttatggactcgataatcgcgaagttaattttaaagtacaattaacggctaaacatataccagaacatactcaacgggacaccttatacgnnnnnnnnnnnnnnnnnnncgagaaactaacagtgaatgtggaatatgtcagtagttgtcaatgctcgaactataaagacgacggaaataaattttgtggccatggtacctatagatgtggacgctggtactgtcaggagggatggtctgggtcaaattgttcagaaaattgtgaaaattttgattttcgaagctgtcgttcatatgaagacttgatcccccatcaaaaaatttgttttgaaaacggagactgcaaatgtggccattgggaatgtgaactaccttattcagggaa

SEQ ID NO: 6154 - DNA, 349 bp, Diabrotica virgifera
  misc_feature (217)..(305): n is a, c, g, or t
gaaaaatctcatcgattgtggagtacagaataacaagatttcctctagctacaaactaataggtcatcgacaaggcagacaaactaagtgtccaggtgatgctctctatgaagaggttacgaagatgcctcattgggaggcgcatccaaattgagagtcagtgactaatttattagaataggtttagtgatatttacaaataataaactttttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccctttaagggggggggtaaaaaaaaacgggggggggttt

SEQ ID NO: 6155 - DNA, 407 bp, Diabrotica virgifera
  misc_feature (12)..(42): n is a, c, g, or t
  misc_feature (48)..(93): n is a, c, g, or t
  misc_feature (172)..(201): n is a, c, g, or t
  misc_feature (268)..(287): n is a, c, g, or t
  misc_feature (345)..(362): n is a, c, g, or t
ctcgtgccgaannnnnnnnnnnnnnnnnnnnnnnnnnnnnnngggggnnnnnnnnnnnnnnnnnnnnnnnnnnnnnnnnnnnnnnnnnnnnnnccgtttgggatcccaagtttttgggggccccaaaaaaggggggtttttgggattaaacccttaaaaacccaattgcggnnnnnnnnnnnnnnnnnnnnnnnnnnnnnngtcttggattttttttcccaacccctttttggcacctttttccccgttttttccgttggaaagggtnnnnnnnnnnnnnnnnnnnngccaaatgggaaaaatttgggccaaatttggccaaactttttcccaaatttgcacaannnnnnnnnnnnnnnnnnaaattcccctttaatgggggggtttaaaaattttttggcgggttt

SEQ ID NO: 6156 - DNA, 489 bp, Diabrotica virgifera
ccatgcatgcgccaccctacattgccggaaaaagactttctatttccgttcttctgcagattcatataatctttgaacctattataaatatcctcatcaacttctgtgcagggttcttgtactatgggttcaggtactatttctggtacatcaactccttctggaatatattctttatccaatttataattcctatcttcaatacggttgatctttttcataaaaatgtcaataccgtgtttccaagtatgtctaccttggctgatgttaccatgtggaacactatctctatagattctccttaatccaacaattgggtatcttcttgttctactaccagatttattagtagcaaacccatatgcataaaaagcaccaacaacacagaaactacgatgattttctgtcggataataaaacattttcctattaatgtccaaacatattctccatacttcgaattctttgacatatacatcttggacaaaa

SEQ ID NO: 6157 - DNA, 626 bp, Diabrotica virgifera
  misc_feature (341)..(367): n is a, c, g, or t
gtttaagataaatatattttattgcaggtaatattgcgtatatgggctcagttggaatatttccctccataattttaacctctcaggctcgggattgctcctcatcgttaattcatctccaatatccaaataatttacttcttcttgattaactggactccaggttatattcatatcgtttccttgaggagttgggttaccgaatttggcaaaattggtccagagtttaacaaatattctaattgcttttagttccttttctcctctgtgcatgtttagggactcaagtggcatttggaacaaatatcctagatcgtcagcatggcaagcacctggcatannnnnnnnnnnnnnnnnnnnnnnnnnnaaatttagtccggcatctagactcataagatataaataaacaggttcagtttgggcttttgcatgaagcttagcagttccaaccactggtgcagtgtaggtaccatcagttgccatcacatacttggccatttcatctgcattttcggtgaagtagaacttcttgagtttctctttaatcaactccttcttagggtctttattttctatcgccatatgcgggtgaacaaacttgtagagattgaaataatctggtttta

SEQ ID NO: 6158 - DNA, 159 bp, Diabrotica virgifera
  misc_feature (48)..(105): n is a, c, g, or t
ccaacattcataggcactgcctttaccaaccacatttcaaatacgctnnnnnnnnnnnnnnnnnnnnnnnnnnnnnnnnnnnnnnnnnnnnnnnnnnnnnnnnnnctgtcctttattgttacgtaatattgtcattaataaatggtaagttcacagtgt

SEQ ID NO: 6159 - DNA, 290 bp, Diabrotica virgifera
ccggaagtatgcagtcctctaggtctaggtgacttttagtaatttctcgttttataaaagaattgtagaataaaacgctagtgtataaggcgatagtttggtaattacattgggaagtatataaatttggcgatatgctaactattccttgaaggtagtatctatcgttttctcgatttttaaagataagtccactaccactgtttcctttacaaacggcaatggtaccattttgacgaccagcgcaaattttatcaaaaaaatgatattgttgctcaaatctttcggca

SEQ ID NO: 6160 - DNA, 555 bp, Diabrotica virgifera
accagacatacctcttccaccgttcttccttaaatttgctatctctttaaacttctgatagacatcttctcttatctcctcgtcatcctctacaatattgtctggatgaacagttttcggttctaggttggtggcacaatattcttgatcaaatttaagcttgtattctgccattctgtacacgtagtcatttataatgtctgacccatatcgcatttccattgttgcaacagggtttttgtctctacggctcttctttacatatgttctggacacatgaaattcatgttctagactacgtatcctaatagtcttccttcgataaatagggtctttctctccaacaatgtcgacgtccgtggacgtaaacattccatagaaggttgctgctaacgtatgttctctactctccattatataacgtctgccaaatagtttcgcaacccatctatcagattctctgcacaatacacgccaatctatttccctattatactccttctctttgatgctcttagttggctctactttgatttcatagatcttatcactatc

SEQ ID NO: 6161 - DNA, 507 bp, Diabrotica virgifera
  misc_feature (317)..(353): n is a, c, g, or t
ccaaaatcaatttttgattattttctttattaattctctttttttttgggtagttctggagaaaatatgggaaaatatgtaatatacattacacacatttttaaataacacagtacatggataatataatcactgatagtttctttactctagcataggcggttcagatggtataaaaagggtttttttaaatgtaacaccctgtaattaaaaaatttgcaattgcccttaaatcaaacctataccaaaagaatcagccagttatttgtgattaactggcgcagggcttcttcttaattttcattacagttagggcnnnnnnnnnnnnnnnnnnnnnnnnnnnnnnnnnnnnngtcatttttgtggcgccacctccgctaaacggtgggcgatagacatacgctctcgggaaataaatagtaggaaatatagtcgtcttcatgttactatttaagtaaattaccccctttaaagggatgaaaagggggggtccggggtgaatttttt

SEQ ID NO: 6162 - DNA, 249 bp, Diabrotica virgifera
  misc_feature (182)..(206): n is a, c, g, or t
cagcaccactgtccattttacatactacattaatcaaaggggggttattaaaactggggggggccttcgtagaacatatacgaattttttgtacatataagttaaagctaaatatactattgatagggttggataatatttctttcattacctagcgggtgtcataagattataggcttacnnnnnnnnnnnnnnnnnnnnnnnnntcgtgccgaaatccgtacgagctcttgccgaattcgtctccag

SEQ ID NO: 6163 - DNA, 471 bp, Diabrotica virgifera
  misc_feature (5)..(5): n is a, c, g, or t
tatantgaggcggattacaatgcactggccgtcgttagagagggtcactgcggaggtgcacaagcttttgttacctacagtgaggagtatataatttgaagcccaaacgacacttaattttgctggaataaggtacctggaagagcgtcttatgacgcaaacagatgtctctgaagcctatgaattactagcatgctatacagaaaagtggatttacttatttttcaccgcgaataaatacggtgattaatttgataaattcaatacttactgccctgatgaatgctataatttggccctatggggggtcctggtccttaaaaaaccttataagatttttatttcaaaacactgaccgtcgtttacaaaataaggacaggttttttttttccaccctttattccagctttaataaaaaatctatgattatcttccttagccggggaaaaataccgggccattaaaaataaa

SEQ ID NO: 6164 - DNA, 236 bp, Diabrotica virgifera
ggaacttaagaaatcaaacaagttacaaaaacacatagaaaaacgatctaagaagttatccaaaaaagagaaaaggaatatgggaaaagcagaaattcaatgattgtgtttggtgtcaataaataatgccaaacataattaatatgttatgatgttacattttgaaatccaataaattaatgtattatattagatataccacacacattgatgttgaactattaaactattttatt

SEQ ID NO: 6165 - DNA, 348 bp, Diabrotica virgifera
  misc_feature (134)..(153): n is a, c, g, or t
gtctgataaggtaatttatctgaatactgatatagtgcgtttcttagaacttaagaggcccttctataaatatggtttgtgtataaaatgtgaattttaaatgacccatattatttcgtaattagcaattaagnnnnnnnnnnnnnnnnnnnngaaacgtgtcgccacaggactatatcagacaaaagccctaagtaccaattttactgcgttgtttttatattgttgaaatactgataagtgtctgtacagaatattctctgtaattttattggctgcaaatcgaaatttttttataacacttcatttgtcaactatgaccgtttataatatacatggtagtatttt

SEQ ID NO: 6166 - DNA, 308 bp, Diabrotica virgifera
caagatcaaccaacgtgatggttgaaaagatactggccatcgtctcagggttggagtgcgaggttggtggctatggagagcaaagttaaaaccctagaggaggctcgccaacacatgttccaggctaccacaccgttgtaccctaatttggccaacatcgcccctacacaacatgtcccagtgaatgtaacacccttagctgcccaaaccgtctcggaggatccgtttggacccgtgtttaaaggtcattagtaattaagaaaaatcaaccaaccaacacaatgtctagatagatagcatgaacaagc

SEQ ID NO: 6167 - DNA, 201 bp, Diabrotica virgifera
ctaaaagtttcctgatgctatcatcccaattttaagagatatgtatgtagacgattttattatcagttttccaaatgtttctgaagctatagtaacacacactcagttagtgaatttgtttcaaaaaagtggttttaaattaaccaaatggatgtcgaactcgaacgatctactatcgacaatccccgaaccccttcaatt

SEQ ID NO: 6168 - DNA, 484 bp, Diabrotica virgifera
  misc_feature (200)..(219): n is a, c, g, or t
  misc_feature (222)..(235): n is a, c, g, or t
  misc_feature (306)..(328): n is a, c, g, or t
ttaaccaaaacctcaaaattaatccttggcttaagtaaaaatggggggctactttaaaagccattttttgaatacccttatcaaaaaatcatcatgacattttagaatttataattatttggaaccgttggtatcaaatcgaaatgtaaacaaattttgacgtttttgttttttacacaaataagttggatttttccagnnnnnnnnnnnnnnnnnnnnacnnnnnnnnnnnnnncattctaaaatttttggaaaacttgatgtactgtccctttttatatttatgcctgttactaccactttcgnnnnnnnnnnnnnnnnnnnnnnnccattattatgattcactaattacatctgttttaaaacatgtgttaagcaacattaaaatgggagcttagatataaacgtgcaaaggtttatacatattacatttattaagactagataaggttctcaaaacagctaaggacaggaattcatcaca

SEQ ID NO: 6169 - DNA, 302 bp, Diabrotica virgifera
  misc_feature (110)..(127): n is a, c, g, or t
  misc_feature (217)..(234): n is a, c, g, or t
ttattttattaaaaatagccccataattgatagaggggcaaatttaagcaaaatttgttatataaagtgattaaaataaatcaaaacttttaagttattaaagatcaaannnnnnnnnnnnnnnnnngaaaaatgcatgtttttaaccaatttttcatcaataactcaaaaagtgtaagttcttacaaaaaaggtattatcatcaaaattgaagccnnnnnnnnnnnnnnnnnnccttttagtagaaaaaccttttaatattaactaaaagtgagttataggtaactgaatatatatttttt

SEQ ID NO: 6170 - DNA, 134 bp, Diabrotica virgifera
  misc_feature (4)..(4): n is a, c, g, or t
ttangtgttaatgataaatttagtttttatttgatacattggtacattcgttaagttaaaattaagttaattggtcaattgttataatacacgtatttttttcttatggcaccagctgaagaaaacgaaagaga

SEQ ID NO: 6171 - DNA, 429 bp, Diabrotica virgifera
  misc_feature (259)..(259): n is a, c, g, or t
  misc_feature (354)..(354): n is a, c, g, or t
  misc_feature (406)..(406): n is a, c, g, or t
tttagctttgacgggttctgtcaaatgtacctaaacaacatattctttccaactgctttcacggttcttagacatttgctacggttgcctactccgactgtggtggggaggctttttgtggccaaatgtttgacttacgtcacaagagtacaaaagcctatatttaaatttgttgcggtaacgatcttcgatctttgaatgtgtactattatctatgtatttggattatgtatttgtgtaattatttatcttatcttanagatagcacgagatagataaccaaaaggtcgaaggagtatagaaaggccaaggaagaggtggagtgacaacctggatatctgatgaggaggcatncgaagatggaacaggcgcgagcctattaggggagcaggaagaagaagaatangattattcatctaatatatcata

SEQ ID NO: 6172 - DNA, 122 bp, Diabrotica virgifera
  misc_feature (24)..(24): n is a, c, g, or t
  misc_feature (26)..(51): n is a, c, g, or t
aattaaaaaaattggtaaacttcncnnnnnnnnnnnnnnnnnnnnnnnnnncccctgggtggggggcccggccccaaattcccctttaggggggggttttaaaaattccggggccggttttt

SEQ ID NO: 6173 - DNA, 127 bp, Diabrotica virgifera
  misc_feature (100)..(122): n is a, c, g, or t
gcatcttaaggtataaattgatagggagatacatacgcaggatatactcagaaaaatctgtgaacacgcatacactctatggtaaacgacctagagatannnnnnnnnnnnnnnnnnnnnnnctggg

SEQ ID NO: 6174 - DNA, 373 bp, Diabrotica virgifera
  misc_feature (147)..(147): n is a, c, g, or t
ccaaattctacgccactggcgaaaatgctattttagttaattttttggattctccagtactttctatgaaaataatatacccttcattcgtaacgataaagtgattagttttcgagatctttgaagttaaaaatgaaacgacacggntattttgattaatgtattgtgtcgcttaatttttaatttcaaatatctcgaaaactaaccattttatcgttacgaatgaagagtatattatttacataaaaagtattgcaaaataaaaaaattacacgaaaatagcaatttcgtcagtggcatagaatttgggaagggtcaaccagccactatcccctgtcgtacgcctctggtagtagctagaaacgtttattta

SEQ ID NO: 6175 - DNA, 678 bp, Diabrotica virgifera
  misc_feature (190)..(204): n is a, c, g, or t
  misc_feature (310)..(354): n is a, c, g, or t
  misc_feature (454)..(454): n is a, c, g, or t
  misc_feature (592)..(592): n is a, c, g, or t
  misc_feature (605)..(606): n is a, c, g, or t
  misc_feature (614)..(614): n is a, c, g, or t
  misc_feature (656)..(656): n is a, c, g, or t
aaaaggcacgtctgtgattacagacatttataatatttattctagttgtcgatagatttcgctataatcgaaaaaaatttatttgtgtaccaagtcagtaaaatgactctttatcgaacgagtctgatattacgagaagagtgagcgtggcgagcgaggcgagtaatagacgagttcgataaagagtctnnnnnnnnnnnnnnnatacaaaatttaacgccaacattatttgattggaaaaaaacttggaatttgacttccgatgattcgcaccttaaagttgactacgtaagagtttgggctctgtaannnnnnnnnnnnnnnnnnnnnnnnnnnnnnnnnnnnnnnnnnnnncggtcggttatttaacttctttaaaatctcattataacaccacaccattttttaaattttagtatcttcattatttcataaaattaatcatatttaattntaataatccccgaatgaaaaactgaagaatgaagtggtgaaaacttgacagcttggacaatgccaaaatatattttatctaaaatttcactttctataataatttgatattgttgtaacacttacttgcatttacaantaattaagaactnntataaatntagatgtcataataaattcatgacattgatgacagtcaactntcgattttaatcgataagtagt

SEQ ID NO: 6176 - DNA, 236 bp, Diabrotica virgifera
aaacccgttaggtaaaagtcataacgatgacaatcacaattactacaattccagcgcaccaaacgataacaggaattcgaggtattatgatatggctcctaagtttaatagacaacatgaagcttcgacgcgattctaaacaaagttactttttttaagtgaaaaaagtgaagataacattggaacaaataccgaaacgtagtattatcaatatgaaagtatgaaattatacgtaa

SEQ ID NO: 6177 - DNA, 478 bp, Diabrotica virgifera
  misc_feature (67)..(94): n is a, c, g, or t
atgacgtcgcctatatttagaatacctttttgtagtaacgtaacaatgaggttttaaagaaaacggnnnnnnnnnnnnnnnnnnnnnnnnnnnnggttaaaagtactgaacaacactcgagtataaataaaaattcgaaaattataatatttgagacatttgggacatccagagaggtataaccttctagacctcataatacaaggtacgattgccgaaagaagtggcccacgcagaagaagaactccagactccgcaatctctaagaatggcatcaaaagacatccgctaatctgtttctagctgccgcaaacaaagttattattgccaatacgatcgccaacgttcgataatgggacagtgtactgaaagaagaagaacacgagtgtttatcaacgcaaacctttataatggaactttgaacaagctctatcaagcaattggacgaaaacatcaagggaaactcttaacatagtat

SEQ ID NO: 6178 - DNA, 174 bp, Diabrotica virgifera
  misc_feature (4)..(36): n is a, c, g, or t
  misc_feature (60)..(82): n is a, c, g, or t
  misc_feature (85)..(129): n is a, c, g, or t
cccnnnnnnnnnnnnnnnnnnnnnnnnnnnnnnnnnaaattttggggtaccaaaaccccnnnnnnnnnnnnnnnnnnnnnnnggnnnnnnnnnnnnnnnnnnnnnnnnnnnnnnnnnnnnnnnnnnnnngccccccccttccccctttgggggggggttaacaattccgggggg

SEQ ID NO: 6179 - DNA, 511 bp, Diabrotica virgifera
  misc_feature (14)..(14): n is a, c, g, or t
  misc_feature (16)..(18): n is a, c, g, or t
  misc_feature (42)..(65): n is a, c, g, or t
  misc_feature (169)..(182): n is a, c, g, or t
  misc_feature (185)..(205): n is a, c, g, or t
  misc_feature (260)..(287): n is a, c, g, or t
gacgaagttttttntnnntggcttctttttctttacaatccnnnnnnnnnnnnnnnnnnnnnnnnggcaaaaaattttaaacccttaatggttttttcattttaaagaccccttttgaaaaagggggcggggaaaaattttcccccatggggtgaccaaggggggcccnnnnnnnnnnnnnnccnnnnnnnnnnnnnnnnnnnnnccgttttgggcccaattttttttcttggtgaaaaaaaaccaaattttcccatttnnnnnnnnnnnnnnnnnnnnnnnnnnnngaaacccaaattttttggggcccccaagcccccctaaaacggaaggggtgtccctttgggcaaaaaatttcccaaaaaatttgcctccggcccaggggggaatttcttataactgggggtttttttacctggggggatgggggaaacccataaaaactgtttaaaagaaattaaatccgggggcccatttaaagggggggggggcttattttggggggggggaa

SEQ ID NO: 6180 - DNA, 580 bp, Diabrotica virgifera
  misc_feature (419)..(447): n is a, c, g, or t
  misc_feature (501)..(501): n is a, c, g, or t
tctagacgtcataaacgtaggtaccgagctacgatttagaatttcaagtcggttcccgagagacactgcagcagagccgcaccccggggattgatatatgtactcccccacactatatggtgggagttgaaatcgcaccccactaggagcgtaattcgcaggtcctcacagtatctgaccaactccatcagttccagtgttggagggggttctggtgaatatttcaatcacttcctcggtgttttggaatttggtgttctgccaattgcttgtttatgtagttctttacagaagtctatctgtcaaaaatcattgatttcacataaaaatcttatacagatatttgaaggttctaaaacgtaaatgaggaaaaattcgtgaagacgtacagctgattttgctttgttttttaacaatcnnnnnnnnnnnnnnnnnnnnnnnnnnnnncctataaacaggtcgaccataagttatttaatttgtttctcctgagagcgattntaagcaactgtacttgcccaaacagtcactctagactttgtattttgtagtcactattttgtatatcgcaatcgattcg

SEQ ID NO: 6181 - DNA, 581 bp, Diabrotica virgifera
gtcatatcccgccatggtaattgaaagacactactagcagaagaatgacactaaccaacaccagatttaaactccctatgagaatacttggcatatcattcctccggattatattcatctggaagaggaataccgatatccattattggataccatgaaaatgaccggaacaaccatagccaaccaaagacaacctgccagttttgcaattagtgatattttagaattagatagacaaaatagtgaagaaatagatccaataaccacagatatgtcagtttaccccacacaccacgacctttcctattcaactagacatcagtggcttcaagtacctgaacctggaatgcatcacgcaccacctcacctaaccattccaccccattcgtcacaactaagcccagacagcaccagtcccgcaatatcagagagatccagcgtccccccagacacgcctttgggagactccaacatgacaaacccccttaaccaagctccttcctcaatgggaacgatcagcgaaggagaaatggaagaacaagatgacattaaagaagaggaaggagaacaacagtcgaatg

SEQ ID NO: 6182 - DNA, 291 bp, Diabrotica virgifera
  misc_feature (260)..(283): n is a, c, g, or t
gcagctgatgaaaccccaacgacagaagaaccaacagtggagggtaacaccgaatctgaaaaggtagaagcggaggtggtggtagaagctaaacaagaagaggagtcctcagttcctagccctacagacgagattgtggaagaaatttcgagtcccaaggaggagatttcaagtcctaagaaggagattgctagtccagataaggaaattccagatagtgatttatctgaaaggtatctcactcccaccgaagaaatttnnnnnnnnnnnnnnnnnnnnnnnngggggggg

SEQ ID NO: 6183 - DNA, 414 bp, Diabrotica virgifera
  misc_feature (234)..(261): n is a, c, g, or t
  misc_feature (331)..(349): n is a, c, g, or t
gcccgctttttttttgattagggggccccccttaaaattaaaaatccccccggcttgggggttgtgtttcaaaaagggcccccctggggggaaactaactggccgcggaaaacattaggaaggtttttattctggaaaaaagggtgtttaacccccgccttggagaacagccccacccccgggggtttggttggccccaaaaaaaacaaaaatttgggggggcttatagggggnnnnnnnnnnnnnnnnnnnnnnnnnnnnttttaccccggggaaaccccagcttttgaacccctggaagccccccgaaatttgggggcccccttttccnnnnnnnnnnnnnnnnnnnccaaaatggtttccttttgggggggccccccgaggaagggtttttttttccttggggggggggcc

SEQ ID NO: 6184 - DNA, 551 bp, Diabrotica virgifera
gttgctaccaatggtcgggagtcgggatcgtgtcattcatcatctgattttcttttgagaattttttgaggttgtgtttgggagttgggttgttttgatggcggtcacgaacagtcggaaacgtatccgctctcatcggatgcgcgcggaggaacgagttttgggcgactttgcgcagattcgccaaattggaacattgaaaacaatgcatttttcgatgatgttgatatcatagctagaagcaaaagagaaatgatagaagcatttaatgctatataaagagcggcacacaacagtggcctaaatattaatgaaataaaaaccacatacatgaaagcccgcaaatctacaggccaaagaaacctacagaatctgacaataggagactataacatcgaaagcgtaaaaaattttacatatctaggttcactagttaccgcagaatacaatgtcagcgaagaagttaagagaagaatacatattgctaataaaacatataatggactcattaaacatctaagatctaacaacatcacgagaaaaaccaaatg

SEQ ID NO: 6185 - DNA, 641 bp, Diabrotica virgifera
  misc_feature (9)..(27): n is a, c, g, or t
  misc_feature (30)..(30): n is a, c, g, or t
  misc_feature (47)..(72): n is a, c, g, or t
  misc_feature (80)..(162): n is a, c, g, or t
  misc_feature (174)..(212): n is a, c, g, or t
  misc_feature (236)..(258): n is a, c, g, or t
  misc_feature (321)..(352): n is a, c, g, or t
  misc_feature (365)..(384): n is a, c, g, or t
  misc_feature (388)..(388): n is a, c, g, or t
  misc_feature (390)..(457): n is a, c, g, or t
  misc_feature (478)..(513): n is a, c, g, or t
  misc_feature (517)..(543): n is a, c, g, or t
  misc_feature (558)..(613): n is a, c, g, or t
  misc_feature (616)..(636): n is a, c, g, or t
ctagtctcnnnnnnnnnnnnnnnnnnnttnttttttcttgggtttgnnnnnnnnnnnnnnnnnnnnnnnnnnttcccggnnnnnnnnnnnnnnnnnnnnnnnnnnnnnnnnnnnnnnnnnnnnnnnnnnnnnnnnnnnnnnnnnnnnnnnnnnnnnnnnnnngggggttttagnnnnnnnnnnnnnnnnnnnnnnnnnnnnnnnnnnnnnnnatctaaaccccccccccacattcnnnnnnnnnnnnnnnnnnnnnnnaatgggaaaaagggggggggcccttcttaaaaacccccccatttttctttgggggggcgcccnnnnnnnnnnnnnnnnnnnnnnnnnnnnnnnncggaaaaaacaannnnnnnnnnnnnnnnnnnntttnannnnnnnnnnnnnnnnnnnnnnnnnnnnnnnnnnnnnnnnnnnnnnnnnnnnnnnnnnnnnnnnnnnngggggggggtgtttttggcgnnnnnnnnnnnnnnnnnnnnnnnnnnnnnnnnnnnntaannnnnnnnnnnnnnnnnnnnnnnnnnngcccccccctgtggnnnnnnnnnnnnnnnnnnnnnnnnnnnnnnnnnnnnnnnnnnnnnnnnnnnnnnnnggnnnnnnnnnnnnnnnnnnnnnggggg

SEQ ID NO: 6186 - DNA, 479 bp, Diabrotica virgifera
atttgaggattactggtcagaagaccaaaccgattcttgggatagccatcgaaagaggagcgaacaccaagcatcctcttccaaggattattaacatcaatgaaagtggtgccgctttctacgcaggcggcctcgaggtcggccaactaatcctccaagtggacggtaccagggtcgacggccttcagcaccaagacgtcgcccgcctcatagccgaatgcttcgcccgaagagatcgcgaagaaatcgaatttctggtcgtggaggcaaaaaagagcaacatggagccgaagccgacggcgttaatcttcctagaagcttaacatttgctgagcctcccccctagtgaccctccggggccgagtcaccaattaaaggactgaaaggatctacgatctacgatttactacatatcacgtgtattataaatgaccagtctgagactcaccacacgttcacgctctcactgatctaatata

SEQ ID NO: 6187 - DNA, 426 bp, Diabrotica virgifera
  misc_feature (8)..(31): n is a, c, g, or t
  misc_feature (122)..(152): n is a, c, g, or t
  misc_feature (175)..(194): n is a, c, g, or t
  misc_feature (306)..(318): n is a, c, g, or t
  misc_feature (321)..(333): n is a, c, g, or t
  misc_feature (352)..(399): n is a, c, g, or t
gtctcgannnnnnnnnnnnnnnnnnnnnnnnctcaatcccggtgggggcccgggtaacctgggtaaaaccccccaacttgcgcctttgtgaaagcccaacttgtttttggttgggtaaactnnnnnnnnnnnnnnnnnnnnnnnnnnnnnnncctaccttttgcgggggggggcnnnnnnnnnnnnnnnnnnnnacccccgtcccttttaatggaaaaaacaccaattttttcatttggaaggtggttaaatatttaaaaaacccttccccccccccggggttaaggggaaaaacccctgcctttnnnnnnnnnnnnnccnnnnnnnnnnnnnttccaatttcccccggggnnnnnnnnnnnnnnnnnnnnnnnnnnnnnnnnnnnnnnnnnnnnnnnnccttgggggaatgggccccccccgggg

SEQ ID NO: 6188 - DNA, 172 bp, Diabrotica virgifera
  misc_feature (18)..(18): n is a, c, g, or t
ataaaaaaaaaaacccancccccataccccccttttctttgtcggcggccaccacaaaaaaaccaacatcttttcactcctctctttggggggggggggtctcccccccgcgcgcggcgggattttaataacccccctcggggggggggggggccacccctcttttttcttt

SEQ ID NO: 6189 - DNA, 400 bp, Diabrotica virgifera
  misc_feature (368)..(368): n is a, c, g, or t
attcagatgaattttttatggaattatgaatttgtatatatttgtaataagaattttataattccctttaattactattagttatgtaaatatgtccgaattggagttacaagaggaagagagggaagctctgtcatcaatatatgaaggagatgatctgtttaaacagattgataagtgtacatatcaatataaatatggtgagcatgatacaaataaatcctttgtattggaaattaaatgggttgagcagtatccaaatgagttaccagttatgaatatggacacattttacaataatcacatagtaacatcattaaagcagaagatagtagaaatgtttaggactgaagctgaacaatacttangaatgtctatgacttactctctatttgaattt

SEQ ID NO: 6190 - DNA, 341 bp, Diabrotica virgifera
  misc_feature (232)..(232): n is a, c, g, or t
  misc_feature (312)..(313): n is a, c, g, or t
cacaattatagctattttgcaacaaggtctatttttgtaaatatttaaccaattctatattgaaggaaatttaattacgcaacttttatttcagtacaacttttctcggaaatgaatactgttaaagttataatcaaaaaaccaagaaaaaaatcggatttttccttaattttttgacattttgattatttgaacaatgttccggacctttttgagatggatgataactcanatattattatttgatttattttcaagcaatttctgcaaaaaaatttgagtcacatctcaacgtccaaatgtaccaatatnnttacagatgcgccctggtctatgacacg

SEQ ID NO: 6191 - DNA, 370 bp, Diabrotica virgifera
  misc_feature (198)..(223): n is a, c, g, or t
cacaaatacatgggaagacgacttacaggggaagaagaggaaacagtcgaacaatgggttgcatcgaatctttctgatgagtttttggcagtgatgttatcattcaagattaaggatacatatatgttccccgcaacacttttcaaagaagaacttgtcaaaaaattctcaacaaagaaatggtggaagctgatatcnnnnnnnnnnnnnnnnnnnnnnnnnntaccatatgaattttgtatttatatgttatctttgttctcatgtccagcttcatctgcatctattgagcggattttttcttcatatggattaatatggactaagcttcgcaacagattaggtgaacttggtaaaaaaatataatcat

SEQ ID NO: 6192 - DNA, 230 bp, Diabrotica virgifera
  misc_feature (18)..(47): n is a, c, g, or t
  misc_feature (58)..(79): n is a, c, g, or t
  misc_feature (95)..(113): n is a, c, g, or t
  misc_feature (133)..(163): n is a, c, g, or t
  misc_feature (165)..(181): n is a, c, g, or t
  misc_feature (183)..(198): n is a, c, g, or t
  misc_feature (200)..(216): n is a, c, g, or t
taaaaaaaaaccggcctnnnnnnnnnnnnnnnnnnnnnnnnnnnnnncggtaaaaagnnnnnnnnnnnnnnnnnnnnnnaaaaacccttagaagnnnnnnnnnnnnnnnnnnncgttcttttaagattaaacnnnnnnnnnnnnnnnnnnnnnnnnnnnnnnngnnnnnnnnnnnnnnnnncnnnnnnnnnnnnnnnncnnnnnnnnnnnnnnnnngacccaattttttg

SEQ ID NO: 6193 - DNA, 311 bp, Diabrotica virgifera
cgatttttcggcgagggtatgagttccgataagatgtttaaggagatgatgacattgaatatattttaacatgttagcttgcaaccccccaacttgcaaccaacttacaaccaacttgcaacaaacttgcaaccaacttgcaaccaatcggaatgaaaccaaacacttctcgatgagaataggaaaagctactcccgacgtcggccgaaatcggatcttgatctgatcggagaaaaacggatccaatgtaggcacccacatttaatacataattatctacaattactaaaggttcgtaagtttcctctgga

SEQ ID NO: 6194 - DNA, 259 bp, Diabrotica virgifera
  misc_feature (115)..(144): n is a, c, g, or t
  misc_feature (195)..(214): n is a, c, g, or t
  misc_feature (222)..(257): n is a, c, g, or t
cggcacgaggccttgcccttatctgttctaaccgcagccggaatgaagggcaggcagaaacaaaaactgtcttttttgaaactataaagaaaggtatgtttaagttaaaaaccgnnnnnnnnnnnnnnnnnnnnnnnnnnnnnnttaaagtttaatgctattattaatatgattgactaggataccctatattgnnnnnnnnnnnnnnnnnnnngggggtgnnnnnnnnnnnnnnnnnnnnnnnnnnnnnnnnnnnnat

SEQ ID NO: 6195 - DNA, 299 bp, Diabrotica virgifera
caaaaagaaaaaggtgattaaaaagagagtaattaaaaagcacaaagatggaaaacaagaaaagactgaaattgtgaccattgaggaagaaggtagaaaaccggaaacaacagttactgttgaagaacttgaggaactcgaagaggtcgcaccggaaaagccaacatacattgttgaagaattgccagaagaagtacaggtgacagaagtagtcaccaaagaaggtgacaagaaaagaaaggtcattaagaagagagtaattaagaaacaaaaagacgggaaacaagaaaagaccgaaa

SEQ ID NO: 6196 - DNA, 160 bp, Diabrotica virgifera
tgcagatttatggcccataattgcatcaaatgcaagcagtattgcttgatgtgtatatgtttaagaaaaataaaatacgatattgtccttataaaaataaacaaacatcaacaatttcgtcctccgcggactcacccatctctcctaccagacttcccca

SEQ ID NO: 6197 - DNA, 337 bp, Diabrotica virgifera
gaagaagcatctcctggctgaggaaccttagagaatggtttaactgtagttcattacaactgttcagagcagcagccaacaaagtgaccatagccattatgatatccaacctcctataggacagggaactttaagaagaattcttcagctgtgtactattggcgaattacatttggttttgtaaattttaattttaatcgagagtagttgataatttaatttttctagtaataaaaatagaaggtcgtagaaaaaatatagcatagtattctactcgcatgtaatggctattactcactctgatgaattaatgatggctattactcgcaaacttcat

SEQ ID NO: 6198 - DNA, 295 bp, Diabrotica virgifera
gcgacctgaaaaacgcagagcaaaccagctgcattatctccttcacaattgtcaatttcttcggcggcgtctcttgcttgcttatggatgtcagttagatctttgagcaaaggtgcgccagtgttaaccaaagcgacgatgctatcttttacgcatttgccggcaccttcgacgagagcgacgcggatattgacgagatcagcttcgtgttgttcgacacaggaaaccatggatattctcaaagttgaccttcagattcccgaagctgtgaaaggtgatatccaacccgtcattg

SEQ ID NO: 6199 - DNA, 250 bp, Diabrotica virgifera
  misc_feature (25)..(51): n is a, c, g, or t
  misc_feature (57)..(74): n is a, c, g, or t
  misc_feature (76)..(88): n is a, c, g, or t
ctcgtgcccaaatccggacgaaccnnnnnnnnnnnnnnnnnnnnnnnnnnngggagnnnnnnnnnnnnnnnnnncnnnnnnnnnnnnnacagggatgtgtttacaatgaaatgttcattaaactgggggaaaactaacggtccaggtgaaacaacatggggttgggggtctttgaattctaaagaaaccttttttaccccaagaagctccccaggaattttggacaatccaaaaaagggggccatttttt

SEQ ID NO: 6200 - DNA, 368 bp, Diabrotica virgifera
  misc_feature (5)..(36): n is a, c, g, or t
  misc_feature (57)..(129): n is a, c, g, or t
  misc_feature (131)..(175): n is a, c, g, or t
  misc_feature (207)..(224): n is a, c, g, or t
  misc_feature (226)..(245): n is a, c, g, or t
  misc_feature (254)..(296): n is a, c, g, or t
  misc_feature (299)..(322): n is a, c, g, or t
  misc_feature (330)..(348): n is a, c, g, or t
cgagnnnnnnnnnnnnnnnnnnnnnnnnnnnnnnnngttttctttgaaaaaaggggnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnaaaaaaacccccttccccccccaaaagccccnnnnnnnnnnnnnnnnnncnnnnnnnnnnnnnnnnnnnnacacccccnnnnnnnnnnnnnnnnnnnnnnnnnnnnnnnnnnnnnnnnnnnccnnnnnnnnnnnnnnnnnnnnnnnnttttatgnnnnnnnnnnnnnnnnnnngtgaaccccccatttatttt

SEQ ID NO: 6201 - DNA, 365 bp, Diabrotica virgifera
  misc_feature (27)..(27): n is a, c, g, or t
  misc_feature (86)..(86): n is a, c, g, or t
  misc_feature (91)..(91): n is a, c, g, or t
cggccaggcgcatacgcgcattataanctttttgtgattggatgttcaaatgacgtgtcaaaaattatccaatatggcagctgtancgcanctgtgggctgtggtttggttatgtcgttgattgataaatatagagtgattggtatactgcctttttaaatagttttcatattatatttttggacttattaacatgcttgttgcatgtcattgtggaagcccaaactgtgtgagtgcgattttcaatcgcaaaattactgataaaaacctattggctcgtagaggtagtgtagagattctctacactagagaactgtggataacatcaatcaaccgggacgaatttacgatctcacttattcaaa

SEQ ID NO: 6202 - DNA, 178 bp, Diabrotica virgifera
  misc_feature (43)..(43): n is a, c, g, or t
  misc_feature (45)..(45): n is a, c, g, or t
gtctctcctcgtgccggagggggcgcgatctctctccaaattncncaccagcgtgccaaattcgacaagacacaaaaaagagaattgtagaacacccactatatgtgcgccagaaatatatacacacacacaaatccctgtaaaaacatatccatataaaaaaagatttacatattta

SEQ ID NO: 6203 - DNA, 84 bp, Diabrotica virgifera
  misc_feature (43)..(60): n is a, c, g, or t
aaccttggggggtttttaaaggggggggcgggtattcaaaacnnnnnnnnnnnnnnnnnncccttttacccaaaccctttaaaa

SEQ ID NO: 6204 - DNA, 291 bp, Diabrotica virgifera
caactcccgcgtaaaagcaaccttgggcccaaggtgaaacgtgaagcggatggtaggagaaacccaaatccaaattttcaaacaaatctgtcttgacgagaaaaattacagtccaaaacgttcatttactgacctataggttcgcctgatccatttcgtgagtttcgtagtcctgaaaatgaagtccaaggaattccgggcgcgtcaggatatagtacaagagtttctgggtacacagctcgttatactgtctttgtccgtcactgaacccggcgtcgtgggcgtgctcgt

SEQ ID NO: 6205 - DNA, 304 bp, Diabrotica virgifera
  misc_feature (131)..(160): n is a, c, g, or t
  misc_feature (211)..(211): n is a, c, g, or t
  misc_feature (250)..(250): n is a, c, g, or t
  misc_feature (293)..(293): n is a, c, g, or t
ttcagattttaaatcgcccttaactcgaaatctatcaacttttgagaaaaatggcaacatacctttcttgttagaatggcccaaaaaacctaaaaaaatatgttccggagcaaaaagggtgatcttttgannnnnnnnnnnnnnnnnnnnnnnnnnnnnnctggccaaaagtttcgccctgcgcacttcatatttccttaaagggaacatntctgaatgggaatacgcacagatgccgaaccatgatttnttttagacgggagcggcatcacgtcatggactaaatgtttctngccaacattac

SEQ ID NO: 6206 - DNA, 452 bp, Diabrotica virgifera
  misc_feature (5)..(27): n is a, c, g, or t
  misc_feature (67)..(85): n is a, c, g, or t
  misc_feature (91)..(117): n is a, c, g, or t
  misc_feature (129)..(207): n is a, c, g, or t
  misc_feature (212)..(234): n is a, c, g, or t
  misc_feature (242)..(305): n is a, c, g, or t
  misc_feature (308)..(331): n is a, c, g, or t
  misc_feature (357)..(450): n is a, c, g, or t
cccgnnnnnnnnnnnnnnnnnnnnnnntttacttttaagggggggcccaaaaaaaatttctcccccnnnnnnnnnnnnnnnnnnncccccnnnnnnnnnnnnnnnnnnnnnnnnnnntttttaaaagannnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnagaacccnnnnnnnnnnnnnnnnnnnnnnnnnnnnnnnnnnnnnnnnnnnnnnnnnnnnnnnnnnnnnnnngtnnnnnnnnnnnnnnnnnnnnnnnncaaaaagcgccgcgccaaaatttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnac

SEQ ID NO: 6207 - DNA, 165 bp, Diabrotica virgifera
  misc_feature (8)..(8): n is a, c, g, or t
  misc_feature (43)..(73): n is a, c, g, or t
aaattganaagggcctaaaaaaaaacatatggggttaaaaccnnnnnnnnnnnnnnnnnnnnnnnnnnnnnnntgcccccaaatttgcaaccaatttcaccagaacattgaacttggccaaaggccatttttgaattgtaacccttcgggtaaaaacaaaattta

SEQ ID NO: 6208 - DNA, 533 bp, Diabrotica virgifera
  misc_feature (22)..(68): n is a, c, g, or t
  misc_feature (106)..(160): n is a, c, g, or t
  misc_feature (166)..(186): n is a, c, g, or t
  misc_feature (197)..(234): n is a, c, g, or t
  misc_feature (239)..(294): n is a, c, g, or t
  misc_feature (301)..(335): n is a, c, g, or t
  misc_feature (384)..(407): n is a, c, g, or t
  misc_feature (414)..(435): n is a, c, g, or t
agagagagagctagtctcgagnnnnnnnnnnnnnnnnnnnnnnnnnnnnnnnnnnnnnnnnnnnnnnnagagagcccctttttttttcccgaggggggactttggnnnnnnnnnnnnnnnnnnnnnnnnnnnnnnnnnnnnnnnnnnnnnnnnnnnnnnngggttnnnnnnnnnnnnnnnnnnnnngtccccccctnnnnnnnnnnnnnnnnnnnnnnnnnnnnnnnnnnnnnntcccnnnnnnnnnnnnnnnnnnnnnnnnnnnnnnnnnnnnnnnnnnnnnnnnnnnnnnnnagttttnnnnnnnnnnnnnnnnnnnnnnnnnnnnnnnnnnntttataggtgtgggcgggggggggcacataggggggggcgctttttttnnnnnnnnnnnnnnnnnnnnnnnnaggttcnnnnnnnnnnnnnnnnnnnnnncccccgccggcgtttgggggattcttccccccgcgggcttttaaattgggggggggggggaacttttgggggggatgaggggggggggaaaaaccccc

SEQ ID NO: 6209 - DNA, 334 bp, Diabrotica virgifera
  misc_feature (171)..(171): n is a, c, g, or t
gccaggcagcgctaagggctctggaagcgcctaagatgagctctaagctggttcttgagtgcaagagagctctggatgacgttgctataaccaacagggttaggttggtatgggtaccgggacacacaggtgtggaaggtaacgaacgggctgacgccctggcaagacggngctcatcctctctgcctgtgggacccgaacctgtgattggagtgcccttcagtactggtcgtggtagtctcagggagcttctctgcggaggttccaggactcctgggcgagttgtgaggtaacgaaacaggctccacatagtggggccatccaaaagtcttac

SEQ ID NO: 6210 - DNA, 290 bp, Diabrotica virgifera
  misc_feature (188)..(188): n is a, c, g, or t
cagaattcatcgacactttccctggccaggttgacgaccaccttggttaaggggctaaaggtaccagggcccggcttacctaaatcggtcaagccctttaaggtggtatagaataaggtgctggacaaaatggtgaaggctggaaaaaaatgggtttctgtgtcgaacacacgaagcagatctcggcnatatccgcgtcgctttcgtagaaggtggccgcaaatgcgtgaaagatagcgtcatcgctttgggtaacactggggcacctttgctcgaagatctaactgaaa

SEQ ID NO: 6211 - DNA, 326 bp, Diabrotica virgifera
cgggggaaaaggaaaacaaaactgtatgggggggtccagtccacgaaaattcgagaaaatcatacccttcccgtatcacacattgggtcgataaggcaaggcacacagctaccaaaagttttttgaaatatgtagaagaagcggacgatctcctcagcatttttgaaaattgcaaagtcgattgctacatagaattattttgcttatccatattaccagaatacagaagaagaggaattgctttgacattagcgaaagcaactgaagaactgactcgacaactatctcatgggaaacctgtgaaacagtcattagatgacagtgat

SEQ ID NO: 6212 - DNA, 367 bp, Diabrotica virgifera
  misc_feature (270)..(270): n is a, c, g, or t
  misc_feature (288)..(288): n is a, c, g, or t
  misc_feature (299)..(299): n is a, c, g, or t
gtatatatacatttaatttcaatcttaatgattattaaaaataattgaagacattttgtgtatcaagtatcaatcactaacgaacgaaaaattaaatgtttaatgcaaattagacaggattaattaaagttacgcgaactttgattgttgcaaagaaatttcaataagtactacaaaatggcctacacagtttaccggcagtttgataacacggtgaccagtactttataagttggtcacaattttaaatgcgtttgttccataaatatnttagtgtgcctattcgtnttgcaaatatntaattaacaatttatatccgcagagatagacaaagttcattgataatggcggtcatataatggtaatg

SEQ ID NO: 6213 - DNA, 330 bp, Diabrotica virgifera
attgaaaataacatagatatatacgaactatattttattacatttaacttgcttgttccagcacacattctttagtatagtcggtgggcaacatatcacttaacagcgatttgaacttttgtaatgggcatgaaagctcgcattgagatatatgatactctttcggtgtatccttccagaagtttctatacgttattttaatacttgaatttgcataaagttcaaatataagggtagctccaaaaccaggtttcaaagtctctattaagttaagacttcttaaaatatgaactatcgttaagtcatgggctgcatataaatacaatttcg

SEQ ID NO: 6214 - DNA, 239 bp, Diabrotica virgifera
  misc_feature (206)..(206): n is a, c, g, or t
  misc_feature (209)..(233): n is a, c, g, or t
gattttatatattccgtattcgaatgggcatcttaatataaatatggtatataaatctcatacgtaaaatcttctaaagcttagaataaatacagtattgcattgacactcaatttatattgtagactttttgagatttttaccattccaatgttagttcatttgcatttatgtaactgagtctatttttcaatataaaataattntcnnnnnnnnnnnnnnnnnnnnnnnnncggggg

SEQ ID NO: 6215 - DNA, 300 bp, Diabrotica virgifera
caaccttgtagagaccttgagagtcataaagatggagtactcaagtagatctgtgggaggaagattcctgggatagcctctaacgatgctgattctgtactattcaaagctcctgttatatttagaagtacttgtctttgtaggatagtgagacaagaatacattccccgtccttatcaatatttctcttatcagtaaaagaactgattggattaggacttcttttatgactatgtttctattacttatcccgtaaaaaatctatcaggttccatctctttttttttttcactactttat

SEQ ID NO: 6216 - DNA, 159 bp, Diabrotica virgifera
  misc_feature (3)..(51): n is a, c, g, or t
  misc_feature (86)..(104): n is a, c, g, or t
tcnnnnnnnnnnnnnnnnnnnnnnnnnnnnnnnnnnnnnnnnnnnnnnnnncgtccaaaacctttgggggggggagatcccttggnnnnnnnnnnnnnnnnnnnccttttcaaattgggggataagggccaagcgaaaataccttttttgacattaaaa

SEQ ID NO: 6217 - DNA, 333 bp, Diabrotica virgifera
  misc_feature (252)..(252): n is a, c, g, or t
aaaattttcaatggaatttctggtattggagctggaacatcattattggtactgagttttttgcctgtaagtgctgttactctttcagttgttatgttagtcagtgctgtaggaatacagtcagcagctaccgcaggatatacgttaaatcatattgatttgtcaccgaatttctctgggacccttcaagcaatctgcaatagctgtggaagtggtttatcgatccttgcaccattatcagttcagttcatngtaggtgatgatgagacaaacaaacttaaatggcgcatcgtatttatagtagccgctatgatgtatattgttccaagcatc

SEQ ID NO: 6218 - DNA, 302 bp, Diabrotica virgifera
  misc_feature (278)..(278): n is a, c, g, or t
  misc_feature (290)..(290): n is a, c, g, or t
tggggggaacaatttaaaagaaaatgggactctccactttcaagtaagttcctggtgaagtaaccaccggttttcagctccctaaaataaagctcgaaccattccaaaatttcttaaaaaacataagttgattccaactccacaaaattaagttaagcctggctgggtcctcagacaagatattaggtattatttggtcacctgatcaggatactttttcattcaagcctcctgtatgcgaggtaacatcgccaattactaagagaaaaattcttagntatgtctctcgnttattcgaccct

SEQ ID NO: 6219 - DNA, 295 bp, Diabrotica virgifera
  misc_feature (3)..(15): n is a, c, g, or t
  misc_feature (221)..(221): n is a, c, g, or t
  misc_feature (257)..(277): n is a, c, g, or t
ctnnnnnnnnnnnnnggattacaatacacgatctactttatagaacgcaagttcttatattctctaagaatacataaactcattccataagcacccggcattggacaatgtccaaataaatattgtaaacagttctgcgtaatcttgtcagttattcttgtcttctcttgcaggctaagagtatttgtagtggtttcagggaaaaacagttgtattaattntgaagcttctcttgggtcgtattcatcgtatttggnnnnnnnnnnnnnnnnnnnnntaaggcatagattaaacg

SEQ ID NO: 6220 - DNA, 175 bp, Diabrotica virgifera
  misc_feature (96)..(96): n is a, c, g, or t
  misc_feature (141)..(141): n is a, c, g, or t
gttgaaaataagactaaaaaaccttctaagtattgacaaggcacctgtatagccatttgaaagtgacgttttttctcaaatgggataaacaagtangcttgggtcggcctattttttgcacttatggcaactacatattgntaggggagcaaagtatgctaaatgtgcagtcact

SEQ ID NO: 6221 - DNA, 106 bp, Diabrotica virgifera
  misc_feature (4)..(36): n is a, c, g, or t
  misc_feature (40)..(60): n is a, c, g, or t
ctcnnnnnnnnnnnnnnnnnnnnnnnnnnnnnnnnncggnnnnnnnnnnnnnnnnnnnnnaaaaccccaaacccttaaaatggaatttttaaatccgggtgttttt

SEQ ID NO: 6222 - DNA, 230 bp, Diabrotica virgifera
  misc_feature (16)..(40): n is a, c, g, or t
tgttcaaactggactnnnnnnnnnnnnnnnnnnnnnnnnnagtggattccatggctcggggagcacgagttcagtacgatggtcaaacggatcgatccctttgatatcatcttcagcactaggtggtgggtactcccgtgccagacctagtatgtgactccgattgaggctacgcataccgcacagtctcacccctggtactcgtcctacacatgtctgcctcatcaggc

SEQ ID NO: 6223 - DNA, 261 bp, Diabrotica virgifera
acacaagaagtacaccttcaccaaggtccagacatagtgttctgtgcaagttttagatttagttttcgtgctcgcgtatcagtgtatgtgcgcatctcaccggtaaagaagcaaatgtgtgtcgtgatgctttggtcactggatcttacatctctctgtccttgtttagacaaacaatttacttatcgttttcatagtgaagcagatcgtcaaaaaacttggatgtgaataaaaaaaaaacgattacttagttgtttatta

SEQ ID NO: 6224 - DNA, 345 bp, Diabrotica virgifera
  misc_feature (285)..(285): n is a, c, g, or t
tctggaatatgcctttaagatgctcaactgggacaataaagggatcacaatagacggagaaaagttaaatcatcttcgttttgcagatgacatagtccttataatgatgacctaggagaagtaaaggaaatgctaaatgagttagatgctatctgctggaaaataggcctgaaaatgagcttttctaaaactaaatctatgactaatctgattcctagtggacagctgattaaacgtgaacaagatatagaactagtggaagagtacatttacttgggtcatganattaggattggcagagataacgaaacgtgcgaaataaaaagaagaattactcttgcttgg

SEQ ID NO: 6225 - DNA, 301 bp, Diabrotica virgifera
  misc_feature (201)..(201): n is a, c, g, or t
  misc_feature (260)..(261): n is a, c, g, or t
actagggatacttaaactctaataacttaattacacacgtgtgtcattgtcgcactctattttgctttatacatactatcacaacccgaaagagttcttcctctttagtcttctgacccaattcacattgtcgaagagctgaattgcttcggtcggggttactgtgataaagaattcgattttcgtgacttccggcaaatntatcgatggtgtgatgaacagtgtctatctctataaagttccagtgaacttattctgannacgcaggattatgtctatattgcttttgctggcataaaca

SEQ ID NO: 6226 - DNA, 300 bp, Diabrotica virgifera
  misc_feature (176)..(176): n is a, c, g, or t
  misc_feature (186)..(186): n is a, c, g, or t
  misc_feature (188)..(188): n is a, c, g, or t
  misc_feature (193)..(193): n is a, c, g, or t
  misc_feature (276)..(276): n is a, c, g, or t
aaaaatctaaagaaagaaactatgttataacagcgagcggcggcagatagatatgatacctacataataaaataaatatcatttagtataatatattatatagataaagaatacattacacgaaaatgccaacaccgaaacaatacatactactaatagtgaaattgtagaatatnttgttaaatntntttanatggatttttgtcaggcacagaacacacaccaatacacacagggcttcaagcaagaatacgagtattatcatcaaccgctatntatgttccatgtgcgaatcattct

SEQ ID NO: 6227 - DNA, 301 bp, Diabrotica virgifera
  misc_feature (147)..(168): n is a, c, g, or t
ttttagtatattatagccttattagttaagaatatcggtgtaataatattgttgctagacaggtaaatgtcattttataccgggtgttacaatcatactgtgtttttttcttaaagttcggaacaccctgtggaatattctagcccnnnnnnnnnnnnnnnnnnnnnnctcgattgtagacttaggctttcttaacattttcttttttgattcatttgcttatgttggaaaataaaaaagttacaaaaaagtgctttaacaactagccatgctttttatcaataaatcctcatagtatggg

SEQ ID NO: 6228 - DNA, 67 bp, Diabrotica virgifera
agaaaggcaaccagagttcaaagaacatgttgggagcaaatgtctctaaacttccggatttcggttt

SEQ ID NO: 6229 - DNA, 184 bp, Diabrotica virgifera
  misc_feature (2)..(23): n is a, c, g, or t
  misc_feature (25)..(45): n is a, c, g, or t
annnnnnnnnnnnnnnnnnnnnngnnnnnnnnnnnnnnnnnnnnnacactgggatcagccatcgggtccgtcgtcgcgtgatgacttcagcattatgggggggtcatcgactgcactgggaggatcgagaatcttttcatgggacagtggccatcctttaacgagatctgtaatcggatcaccc

SEQ ID NO: 6230 - DNA, 241 bp, Diabrotica virgifera
atcaaaagtaccaccacccaaatcaaatactaatacattcttttctccttccttcttatcaagaccataggcaatagctgcggcagtaggttcattgatgattctcatgacattaagaccagcaatggtaccagcatctttggtggcttgacgttgggcatcattgaaataagcaggtactgttacaacagcatgggtaaccttcttgcctaaataagcttctgctgtttccttcatcttt

SEQ ID NO: 6231 - DNA, 229 bp, Diabrotica virgifera
gagagagagaactagtctctctctttaacaaatgcttcgatccatcatgtccactaaatgataattcctgacaacttaaaaaaattacaatatcaattaaacgacgtataacggcgtgattatttttgacaatttctaccgatgcgatctggcgatgccaaatgaaacaccgaccggcagatttaaatatgccgtacctgcctacggagagaatgtatgttcgcttgct

SEQ ID NO: 6232 - DNA, 227 bp, Diabrotica virgifera
  misc_feature (26)..(74): n is a, c, g, or t
  misc_feature (78)..(95): n is a, c, g, or t
agagagagagagagaactagtctcgnnnnnnnnnnnnnnnnnnnnnnnnnnnnnnnnnnnnnnnnnnnnnnnnnaccnnnnnnnnnnnnnnnnnngttccaaaccaagtttaacctaccacctattaattctatccaaataaaccaaaccccttttctcctcctcctaatcacatatccccctcctttcctccctcctgggccccttcctttcctccacaacttgaa

SEQ ID NO: 6233 - DNA, 248 bp, Diabrotica virgifera
ttctcctcgactccggtgagagggcccagtaagtggtcttggtccctgaaattgttaggggagcacgaccaatgaatccaggcacggtcccagcgtccatcgactgtgctccgggtggtcaccggataccgccgctggactctcaaaagtgccgcaactgaggcgatcaagtgcggcacctgcgcctacaacatgtagacatttcgttccaacttccttgcggctacccttacccatcaatgtaatct

SEQ ID NO: 6234 - DNA, 194 bp, Diabrotica virgifera
  misc_feature (102)..(189): n is a, c, g, or t
atcattttgagttgtgcggatcgcaaatgtaccgttgttatatttggttaaatgtaactaaaatattctttaaacattgtatcatcatttcactgatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcg

SEQ ID NO: 6235 - DNA, 296 bp, Diabrotica virgifera
gttgccgactcccgtatcaactcctgtcccattcagtggtatgttcttgccgatcgggatatctccgctacccatatctgttatgatcatgatgacgaggatgtctctgactaccccacctactggcacaatttatacgtcgctggctactactacaccaccgtctggcaccttttccttatcctgcgctactacggagcctccgtcatagacctgatccttccacaatggactggaagaatctgcgcactaaccgtccacactgtcttatcgactggacccatcgtcgaccgttt

SEQ ID NO: 6236 - DNA, 305 bp, Diabrotica virgifera
  misc_feature (243)..(243): n is a, c, g, or t
gtctcgactaatctttgcttatggcattgccgtggttgtatccctgccattggatctcattgaagatgagagtggataggagtatctagtagttccagtaagtatataaaggagagacttaacctggggtgccgaccaacatggatacagtcttggtcaaaagggaaatatctgggagaatggtgcgcacaaatttgacagtgcttacactggttcgagagcttgggattcccatggactganaccagattctcttggaggtcgtgtagaatacactagtaagccaactaaaactactgcttttg

SEQ ID NO: 6237 - DNA, 236 bp, Diabrotica virgifera
taactgtatcgtctgtatatctgattgtatttatcagaatttcattaattttcgcgccccgttacgaattatgcagcgcttctttaaatattctatctgaatataaattgaacaacagtggggacagtacacaactctatctgacgcctgaaacctatttgggcttcgatacgttactaaaaacattttttggtaaaattgtggcttattcccattaaaaatagttgaattataaa

SEQ ID NO: 6238 - DNA, 192 bp, Diabrotica virgifera
  misc_feature (79)..(79): n is a, c, g, or t
ctcctgtcctcttgagccctagcgatacccctcatgctccctctatagactggagaaatcaccgctctggactgccccnatcagttcacacctgtcccccctgtagtcagtgtctccgtccactgtcgagtggcatatgttcaatgggcactctctggttttggattgcttggacactcttatgggctcgct

SEQ ID NO: 6239 - DNA, 318 bp, Diabrotica virgifera
  misc_feature (261)..(261): n is a, c, g, or t
  misc_feature (295)..(295): n is a, c, g, or t
ggcacgaggaattacagagcaataactttatttaacaggtcatattatagcattctagaaaatatactacacaaagacttaaatcatgcactgaacgaatattaggaaaataccagaacatgttcagaccgggggaggtcgacgattaattccatacatacagtggagcacataagtcaagaatcgagagaatacgacagagaaatgcacctaatattcatggatggcaaaagcgcttgtgagactgccaatcggagaaanatgatggagcatctacagaatgttggaatcgcanataaattaagacatgtgctaaca

SEQ ID NO: 6240 - DNA, 250 bp, Diabrotica virgifera
  misc_feature (61)..(78): n is a, c, g, or t
  misc_feature (195)..(195): n is a, c, g, or t
  misc_feature (239)..(239): n is a, c, g, or t
ctcgtgccgctactctccaatttctgttttattctttattgatttgcgtgtatttgattcnnnnnnnnnnnnnnnnnnccatttatcagataccgtatacgatcacctaataatccaaactacgtcctctaccagactctactttgacggtcacgacacaatgaccaacacctccttcattcacggtatctgtancaccttttgattcagcacgatcggtggtagaatgtaggcgatanatcgttgctcg

SEQ ID NO: 6241 - DNA, 330 bp, Diabrotica virgifera
  misc_feature (8)..(31): n is a, c, g, or t
acgaacgnnnnnnnnnnnnnnnnnnnnnnnntaaacccaaattgtatctttttttatattgtatctaatacattacttatgtaatttctttgttttgggcatagtagggacttgtccctctgcccttgtttatgtataataataataattacctattatttattcctaaaacccaatatcataaataagtaaactggtgcagtacggaaaacgtctaggtaccgtcaatttttgagattattgatgaataccactaaacgaaatgggatatacacatatttcacagaatgctcactattttattctataaataactaatcgtaaaatttg

SEQ ID NO: 6242 - DNA, 161 bp, Diabrotica virgifera
attaatacattagtatattaagttgttagtactagtacaaccagcacgaaatactgattattcttcctcttcttcagctgcacctccaccaacgctcttcgtggggaggttcttcctctaaactcgtccagaaagaccgcctcccggtggtgacttaaaaa

SEQ ID NO: 6243 - DNA, 297 bp, Diabrotica virgifera
  misc_feature (217)..(217): n is a, c, g, or t
  misc_feature (265)..(265): n is a, c, g, or t
caaccacaaagttgaaggaacatatatcaaacttcgtattcccgaagaaaactttcttgagaatcttattaactgttatcaaatcctggatttaacaggtagttcatgtaaaccgcaaattacagaaggaggatacagccataactttatggagttacttcttgaaaatgcaaaaggcgaaatgatgcaatacgaaattcaagtttatactactgtnccaactactgaaaacccaacaacaatgtggaatgttttgtaaattgtntaaacttaacaataaaaacataacaataatgt

SEQ ID NO: 6244 - DNA, 112 bp, Diabrotica virgifera
  misc_feature (86)..(103): n is a, c, g, or t
  misc_feature (111)..(111): n is a, c, g, or t
cttggttggacaagagaatcattatcctctcttggggcaaaatatgcccttagtatattaaaaagtattctgttctaagcatatgnnnnnnnnnnnnnnnnnncatatatnc

SEQ ID NO: 6245 - DNA, 379 bp, Diabrotica virgifera
  misc_feature (242)..(278): n is a, c, g, or t
  misc_feature (281)..(306): n is a, c, g, or t
  misc_feature (331)..(331): n is a, c, g, or t
  misc_feature (362)..(362): n is a, c, g, or t
  misc_feature (369)..(369): n is a, c, g, or t
ccggtataaaaccggagacgattattaatttgtggttcatctgggagaaagtgtacaaatttatttgaaaagtttcaacgaagctccagttggtcgtgtggttacgagtagattatttaaatatatcagctaaattcaaacatacggctagagtactattttttatatgggtagcaattatttggctgttaatagattatgtataaaactgtaataaagtagttcttgcaacctgtaaatcnnnnnnnnnnnnnnnnnnnnnnnnnnnnnnnnnnnnngcnnnnnnnnnnnnnnnnnnnnnnnnnnttgttgactttttcacacttttaanaaattatttattgtttagaataatttatatntaatatntttttaatag

SEQ ID NO: 6246 - DNA, 201 bp, Diabrotica virgifera
  misc_feature (100)..(133): n is a, c, g, or t
  misc_feature (136)..(149): n is a, c, g, or t
attcattggaaagttctacaccgaatttgactttggtaataatcgtgtaggattagcggaagcagtttaaatatacataataaataagtcatagaatgcnnnnnnnnnnnnnnnnnnnnnnnnnnnnnnnnnnaannnnnnnnnnnnnncccagttcgcggggggcgagtcgtaattcaattcaataggcatcggtttaca

SEQ ID NO: 6247 - DNA, 292 bp, Diabrotica virgifera
aaaaactatgccattttaagtattatacttgtaagtggttgtcagggagctggtaaatcaggttttatcgtaaaccatatggatctggctcctaatttttcaggagccatgatgggaattagtaatggactttctgtcgcactttcttcgtttgctcctgtcttggcgcaaattattgtaaaggatgaacacaatattaaccagtggcgattcattttctacttcacgatgggattaaatctacttggtgttataagtaacacattatttacatcggggaaacgataaccat

SEQ ID NO: 6248 - DNA, 173 bp, Diabrotica virgifera
ccaagcgaacccttcaggttcaattggtgactttaggtcggaaaagtcgagcacgggctcaacacataaattatttggctatagatgttgagttttaacggttgctgttgtaatgcaggtcaatgaactcagggtggcagtgatagctctagtaactacgatcagggctccgt

SEQ ID NO: 6249 - DNA, 204 bp, Diabrotica virgifera
  misc_feature (30)..(51): n is a, c, g, or t
  misc_feature (59)..(78): n is a, c, g, or t
  misc_feature (80)..(93): n is a, c, g, or t
  misc_feature (175)..(201): n is a, c, g, or t
cacaaatgccaatttatctgccttcgagcnnnnnnnnnnnnnnnnnnnnnnacacaacnnnnnnnnnnnnnnnnnnnngnnnnnnnnnnnnnntgctgttttccaagagaatctccgcaaaatcgacgcacacaatgctaaatacgaaaagggagaagatacctactacatggcnnnnnnnnnnnnnnnnnnnnnnnnnnncgc

SEQ ID NO: 6250 - DNA, 196 bp, Diabrotica virgifera
  misc_feature (16)..(39): n is a, c, g, or t
  misc_feature (65)..(67): n is a, c, g, or t
  misc_feature (69)..(92): n is a, c, g, or t
  misc_feature (94)..(113): n is a, c, g, or t
gaatgacaacttaggnnnnnnnnnnnnnnnnnnnnnnnngaaaaacaggcagtactgcctatatnnnannnnnnnnnnnnnnnnnnnnnnnnannnnnnnnnnnnnnnnnnnnctcttaaaggagtaacacctttattagcctaagataagatataaggccaatcgacaccgagctgtttaattgataaaaattat

SEQ ID NO: 6251 - DNA, 297 bp, Diabrotica virgifera
  misc_feature (7)..(7): n is a, c, g, or t
  misc_feature (21)..(45): n is a, c, g, or t
  misc_feature (60)..(60): n is a, c, g, or t
  misc_feature (131)..(131): n is a, c, g, or t
  misc_feature (138)..(157): n is a, c, g, or t
  misc_feature (189)..(189): n is a, c, g, or t
  misc_feature (219)..(271): n is a, c, g, or t
atacatnttatggttgtaagnnnnnnnnnnnnnnnnnnnnnnnnncagaaaatacgtatntagttaaaaaattttccgacaattaatgttcagaaatcatttgtggcatttttaatgtgtttgtgtgtgtnttatttnnnnnnnnnnnnnnnnnnnngcactgttttaataaaaatgtttgagaagttntaaggtatagttatattaggcatagtaggnnnnnnnnnnnnnnnnnnnnnnnnnnnnnnnnnnnnnnnnnnnnnnnnnnnnncggtttatatccttttaaccttttat

SEQ ID NO: 6252 - DNA, 178 bp, Diabrotica virgifera
tcaaaatccaaaataagatataacagttaacatatatcatatgcaacaatattttgatcaaaatgtcacctttgttttgttcgatcgccgttagagtgtaatccgaacaagtgtgctttgtaaacacgctttatatcccacttatacaaattaaatgaattaagttaaggcatgtttc

SEQ ID NO: 6253 - DNA, 164 bp, Diabrotica virgifera
gcgagggctggattgcagggtttattttgcaaaatctattgaacgcacacactggccaaaattcagatctatcctggagaacaaggtgtctctagacattccactaaaaaccaaagaggacatttttcttgctgtgtaattttcttgcataataaatgactgtc

SEQ ID NO: 6254 - DNA, 246 bp, Diabrotica virgifera
  misc_feature (101)..(118): n is a, c, g, or t
  misc_feature (161)..(176): n is a, c, g, or t
  misc_feature (214)..(214): n is a, c, g, or t
ctcaaacttaaaagaaaaactactgtggaacaactcataattaatgatgatgaagcgagcaccagcggagatactggaactttacgaagtggggtgtgatnnnnnnnnnnnnnnnnnnaaaaaaatgttgatccggcaatatttggatgaatatttggatnnnnnnnnnnnnnnnnctggggaagaaaactgtccaattcccaagtgttttgtntgtgggcagacactcgctaatagcgcaatggc

SEQ ID NO: 6255 - DNA, 86 bp, Diabrotica virgifera
aaaaaatcggcagataagatgattttgatactgttcgcgttttcagcgatactattcaacggtgtacattccgtatgtcttaaaaa

SEQ ID NO: 6256 - DNA, 135 bp, Diabrotica virgifera
ttcgcgccaattccggatgagtgtacccaagacatggttcaactcagtagagccatcgtctgagtaaatcacagctgtttcccagatatgcctatcttattcccaaattcccccgtcccttttttgtgttccccc

SEQ ID NO: 6257 - DNA, 130 bp, Diabrotica virgifera
ctcgtgccgctcgagttttttgaacaaattcggggacaaatttagttttctaaaatggcacatacatataaacttatatattttgacgttcccggaaagggtgaagcaattaaaatgatcttaagctatg

SEQ ID NO: 6258 - DNA, 142 bp, Diabrotica virgifera
gcaggttgtctcctaagttctactttaatgttcttttctttagcttccttacgttgcttttccttggattttactccttgccagaagtcctgaacaaccctggaattgtttacatgttccataccgaaaatgaatcctttgg

SEQ ID NO: 6259 - DNA, 77 bp, Diabrotica virgifera
ctataattttaatccattttcaacaactcttaattcatatactaactattttccaagttggccttttatgccccccc

SEQ ID NO: 6260 - DNA, 197 bp, Diabrotica virgifera
  misc_feature (6)..(48): n is a, c, g, or t
tcgagnnnnnnnnnnnnnnnnnnnnnnnnnnnnnnnnnnnnnnnnnnntttcatatatttattccgttaaaagttggttcataaatattaattattccaatttccataccctgaccttaaaaaccttccctcaataactatacccaacctaaccatatagtcctatatgttacctaaaatttactccccgcccgtgg

SEQ ID NO: 6261 - DNA, 129 bp, Diabrotica virgifera
aaaatacgtgaaggccaaaatgggtagatcaactgcgaaggtgctaccgttattgttaaaaccaaccctacccccaaaatcctttcctccaaagttttcccaattccaaaatccctattttccaattgg

SEQ ID NO: 6262 - DNA, 127 bp, Diabrotica virgifera
  misc_feature (9)..(53): n is a, c, g, or t
tgtctcgannnnnnnnnnnnnnnnnnnnnnnnnnnnnnnnnnnnnnnnnnnnnttaaagattttgggtaccttttgaataaattttatgatgaatgttaattgtttttcccatttaattttcctcct

SEQ ID NO: 6263 - DNA, 114 bp, Diabrotica virgifera
gaatcgcagctgcggtggttttttgaacaaattcggggaaaaatttaattttctaaaatggcacatacatataaacttatatattttgaactcccccgaaagggttaaaccatt

SEQ ID NO: 6264 - DNA, 184 bp, Diabrotica virgifera
  misc_feature (132)..(176): n is a, c, g, or t
gcacttatgaagaggacgtcgaatatatttatggagtaactgacctcagaacagtaactgaaatgtgcatagacatgaacaaatgttaagctaaaccaaatatctaattgtatttttttaataaaaacatgnnnnnnnnnnnnnnnnnnnnnnnnnnnnnnnnnnnnnnnnnnnnncagggggg

SEQ ID NO: 6265 - DNA, 148 bp, Diabrotica virgifera
tccgattccaaaagtaagagcgcaagcagatgccgaggtactaaaagttgtcaaatcaggaaaaactaaaaggatagcttggatgataatggtaaccaaagttacatttgtcggataaagattcacgatgaatcctcccaaatttgaa

SEQ ID NO: 6266 - DNA, 308 bp, Diabrotica virgifera
  misc_feature (292)..(292): n is a, c, g, or t
cagataccagttttttggctgttttactcatattcataaacaaaggattttccatggtttgaatggtgtgtgcatactttgcatacctcttttgtaatttaatgcagattcgttgctcacatctcgcataatttttggtaataaaaaaagttgttgaaaagctattgattactctcgtactccaaagacaaactgtgctcatatttctggcgatgtcatcgctccttatcgagtctggatactttgggattacctcccaatatttcgtattaagttatataccatacttctnatattatatctcatca

SEQ ID NO: 6267 - DNA, 248 bp, Diabrotica virgifera
  misc_feature (23)..(60): n is a, c, g, or t
  misc_feature (138)..(157): n is a, c, g, or t
ctagtctcgagttttttgattannnnnnnnnnnnnnnnnnnnnnnnnnnnnnnnnnnnnntttcatgtcaaattattcctttatttgtccaagtttaatttacagatcgcaaataatgcaaggcaagttataagtccnnnnnnnnnnnnnnnnnnnntgatactccaatattattatttgatagatacaaaacatatccgaattatttaagtagtggaatccatatctcgtgacgaattcggctcaag

SEQ ID NO: 6268 - DNA, 103 bp, Diabrotica virgifera
  misc_feature (45)..(72): n is a, c, g, or t
tatataagaagtgttcggtacaagtttctcagtttttcctacacnnnnnnnnnnnnnnnnnnnnnnnnnnnnaactctgcatcaaatctagtgtgtgtcaacg

SEQ ID NO: 6269 - DNA, 350 bp, Diabrotica virgifera
  misc_feature (11)..(25): n is a, c, g, or t
  misc_feature (192)..(209): n is a, c, g, or t
gacctttgaannnnnnnnnnnnnnnaatactatgaacctttaagtcgttgtctaattcggcgctaaaattgaccagctccttaaatatgcctctatttctgaattttctttttcgtcgtgacctcttaaagctaactcgaaagctccacaacaccttataacatttgtagttttttttctagcgaaaaaccnnnnnnnnnnnnnnnnnnaatactaatctttattgtcaattaataaatttaacataagagataatcaaaatatccacgatcatgatgcactaaaagtttaattataaatacaaaaactttttaacagaaaatatacataatataagcgacaaaccagca

SEQ ID NO: 6270 - DNA, 281 bp, Diabrotica virgifera
  misc_feature (135)..(135): n is a, c, g, or t
agtgaacaaccattcattccgttatggatctaaaaaaccgtttttgtcgtgcaggtgcccaagcgccgaagacgaagctgctgaggcagttcggacctctgttggtggccatggtcggattgccgggaagagganagagcttgctggccacgagattgtccaaatatctcaatttcaccggtgataacaccaaagtatatgacattagcgagtaccgtcgcaaacacatcaagcaatatggttctcacgaaatgttccgagcagataacttgccagcttgg

SEQ ID NO: 6271 - DNA, 217 bp, Diabrotica virgifera
gattattgcatgagattttaataaaagggtaacaaatcaattgaaagttctgtctgacacaacacatgggacgtctttgtagtcagagtccgaaacttgtaagctgtgtcacaattacaactacacctgttcacgtatatcagggtttgtccggctacacagcgtcgggatattaacacattttcggctggctattaataaactttatttggtaccc

SEQ ID NO: 6272 - DNA, 182 bp, Diabrotica virgifera
tgacaacgctaccagcatcgtccacgattacttcaacgaccaaaatcgagaagctcccgagctctacttcgatattaacaagtgccactttctcgtcaaattctgactttataaatctaatattccagtaaacatttggcagatagaatgaactgggatatctgtgccttccttttccaaaa

SEQ ID NO: 6273 - DNA, 221 bp, Diabrotica virgifera
ttcaaagtggatttaaaaaattattcaaattgccttgtgaatcatcgatatacaccgctaaatgatagcgatactttttgctttaagacacatatttagtaacgaaccctataggtgcataatatttacagacagtaagagtgtcgttgatagactaactaacgtacataagtaccaacaactcattcttatagaactggaaattatgactctttataaaa

SEQ ID NO: 6274 - DNA, 323 bp, Diabrotica virgifera
  misc_feature (4)..(23): n is a, c, g, or t
  misc_feature (305)..(305): n is a, c, g, or t
atgnnnnnnnnnnnnnnnnnnnnccacttttgaggggtatcgttgattggaaggttgagaagaatgagaattataaaaagaactaaagttaggagagcacttagtaataattaaatagttataagatggttttatttaagtgtataaaggtagaattacataagaaatcaaaatagataatcctatatcaaagatgatatttcaatgacatataaattagaaattagtaactagaacatataataatttgaattttgagtattaccagagaattacttctatttgtaacatacaatagccttatntgttcgtaagaatcatca

SEQ ID NO: 6275 - DNA, 313 bp, Diabrotica virgifera
  misc_feature (183)..(183): n is a, c, g, or t
  misc_feature (246)..(246): n is a, c, g, or t
tgtcgcacttgttgcaaaatagcaataattgcgaaaaatccataaaaaaacaagtattcgcattttacggtttttaaccatttttgctacataaaggaccttcatattttacccagaaaaactctatgatatagtaaaataacactgtaaattttattaagatcggtttaacagattttgcanaattaattttgcaatccagctttctcaaaaaaaaatcatttttcaaaatgttgcaggactganaataaagcaaacagcaagttgattttttttaacatatagattaataatgtacctttcatttccaatt

SEQ ID NO: 6276 - DNA, 243 bp, Diabrotica virgifera
  misc_feature (29)..(57): n is a, c, g, or t
  misc_feature (90)..(111): n is a, c, g, or t
  misc_feature (119)..(119): n is a, c, g, or t
  misc_feature (145)..(145): n is a, c, g, or t
  misc_feature (148)..(173): n is a, c, g, or t
  misc_feature (202)..(202): n is a, c, g, or t
gcgactcgaagtgaggttgtctgtggtgnnnnnnnnnnnnnnnnnnnnnnnnnnnnntcccttgaggatttaatttccaagatggtccannnnnnnnnnnnnnnnnnnnnnggataganagtatctgcagctcctcttgcagtcnagnnnnnnnnnnnnnnnnnnnnnnnnnncccactttttgaaaagaagcctacatatnttggaattggtcaggatattcaacctccccgtgatttatct

SEQ ID NO: 6277 - DNA, 198 bp, Diabrotica virgifera
gagtcatattacaacacagtggccgtcgttacacaatgtcgagagtgagaaaaccctggtgtcacccatcttactcgccgtgcaacatatccccctctcgccatgtggtgtaatcgagaataagcgcgcacctatcgcccttcacaactgtcgcgcacccagaatggagagtggcatattgtacgcgtacatattgtg

SEQ ID NO: 6278 - DNA, 264 bp, Diabrotica virgifera
  misc_feature (10)..(10): n is a, c, g, or t
tggcactccnaattcgcttggaccatgctcatccctatgtgtctcagagatgaactctcgctatcactcgctccgatctccctggcaaatacttgaaaaccccattccactggcaacctccgctgtactctgactaccaactcaccatcactcacttgcacgggtgtcgctatgaattcttcgctggccatcaatatcactcactatccactaaaggaagatttacctcctccacaaaatctattctctctctcgtactccccc

SEQ ID NO: 6279 - DNA, 285 bp, Diabrotica virgifera
actcgtgcctatttcggccctaacacgcgccgacttcggccccaaaatcactatatgcctcgacctcgtcttctggcatctctatagagatcggtctatgtgtatgtgttcccccaatatgtcagtcgtggattcttcctatatatatcgtgcaatttatgtgaactatgcgatgccagtcggagtgcactggattgttttcttcaataacaaatccttttggtattcctgtgagattagtgcgatcccattcgactttggctccatccacttcgattatgatct

SEQ ID NO: 6280 - DNA, 201 bp, Diabrotica virgifera
cgaggaatctccaattcaggaatctccaccccgctccaatgctccaaaccatctacttccccccgatagcactctgataagctagagggactctcaatcagcaaagttcttatcacatgggagtcctgggtacacgggctcccacatgaaatcctaccccgagtcctggctctgggctacatccagttcggtgactcggcg

SEQ ID NO: 6281 - DNA, 126 bp, Diabrotica virgifera
  misc_feature (94)..(107): n is a, c, g, or t
  misc_feature (109)..(124): n is a, c, g, or t
ctggagtctgctgcccaaagaaagctgaagttgctgcttaagaatattgttgattgttgttattttctaatgaaatctaaaagttgttaaaggnnnnnnnnnnnnnngnnnnnnnnnnnnnnnngt

SEQ ID NO: 6282 - DNA, 63 bp, Diabrotica virgifera
ttgaacatccaatcagaacaaagttataatgcgcatgcgccgggctgataggttttaacatat

SEQ ID NO: 6283 - DNA, 173 bp, Diabrotica virgifera
ggctcgatcgcatgccgactccggtgtatcgagcaatctttttgtcctctatgaatctcgtcttgtctctgcccagcatgttttatctcgctctcataatcgtgttgtgtttctgcctctctgtcttatcggatctattattctcgtgtccaactccgctccagggggggccc

SEQ ID NO: 6284 - DNA, 120 bp, Diabrotica virgifera
aaaaaactgaaattgctaggacgcgtctaataatttgagcagtgactgtataattatgatattttcggtattagtgaaatactgttccaatgttttgagtaaattcttactcaaaattcc

SEQ ID NO: 6285 - DNA, 369 bp, Diabrotica virgifera
  misc_feature (79)..(79): n is a, c, g, or t
  misc_feature (209)..(209): n is a, c, g, or t
  misc_feature (269)..(269): n is a, c, g, or t
  misc_feature (274)..(275): n is a, c, g, or t
  misc_feature (342)..(342): n is a, c, g, or t
attcaaaatttccagttctataaaattcctattacaaaatgtacattgatgagggcctctgtgggacagtaagtgtatntttagattgtgtgtttttgagaaaccctttttgcagtaactgcagtgataggggcgatagcctgtgtgaatatactcgtgacaaacaacctctccttttgaagaaaactgtcttccacaatattgacatntatacggtttctctccagtgtgtgtcctgacatgcctgttgaaggaattgatcattctanatctnntagggcaatattcacaatgggtattcttctctcctgtgtgcagtcgcatatgatatgttagagcatncgcataattgaaatctttaccacatac

SEQ ID NO: 6286 - DNA, 230 bp, Diabrotica virgifera
  misc_feature (157)..(157): n is a, c, g, or t
aattcggcacgacctgctttagtacggccacagagttcgtaatctttgtagttacattatctataacatcttgagttaatgcttctttcatatcgggcatttcccaaactggctctgttagaaagtaatcaataatgttgctatcttctttctttanaccatcccaaaaggtgtgttcactaaaataaacgtgtaattgaaacatgttggcactggtacctcgtgccgaa

SEQ ID NO: 6287 - DNA, 305 bp, Diabrotica virgifera
  misc_feature (211)..(211): n is a, c, g, or t
  misc_feature (298)..(298): n is a, c, g, or t
gcctataggaactccgtggaaaaatctgaaggcaatgctgacacttggtgtagcataggtgtcctttaccagcaacaaaaccagcccatggatgctttacaggcctacatatgtgccgtacagttagataagtgccattccgcagcttgggccaatttgggaatattatacgagcattctctgcaagcaagagatgcgtatgcctgctatntgaactctagcagaggaactatctataagcaaacaaacgacggatcagttaacacgaataaacttccgaaaatcaactttccaaatntgggcat

SEQ ID NO: 6288 - DNA, 234 bp, Diabrotica virgifera
  misc_feature (180)..(180): n is a, c, g, or t
  misc_feature (223)..(223): n is a, c, g, or t
gcacaaatcagatagatggaaagagcagagggagacctatgtccatcagtggacgcgtccgggttgattatgatgataaagaatgttaccgttgatattctctgcttaattaaaatcgaagtaactatttattttcaaatcagtcaatatacgatattgcgataattctcaacatcctanaacataacaatacgtcattattggacgcgggcctgagaaaatntctgccgtgat

SEQ ID NO: 6289 - DNA, 108 bp, Diabrotica virgifera
  misc_feature (14)..(34): n is a, c, g, or t
gaactagtctcgannnnnnnnnnnnnnnnnnnnnctaaataagtaagaattaggtgattctagactcttgttgacattttttttgaagtgaataaacatagcattttt

SEQ ID NO: 6290 - DNA, 273 bp, Diabrotica virgifera
  misc_feature (145)..(145): n is a, c, g, or t
  misc_feature (243)..(261): n is a, c, g, or t
ctttgttggagctgatagaactcgtggatacggtactgacgttaatgctgggcttaaatacaattttctgcaaaagaaaaactggaatggagatatcagcggacaatacggtaaacatttcggatggcctggcggtactggcaanccacaaactggtgtatttttgaatttaaatggaaagtcttaaattagccactaatcttaaattcccgtgataacaatgtgttcatttttatactctgnnnnnnnnnnnnnnnnnnngtattacctttt

SEQ ID NO: 6291 - DNA, 194 bp, Diabrotica virgifera
ttgacgagcggcacaagaaaaatcacgtcggcattcgaatctttgtggacgcgaacaattatgaacacattgtcataatcattatccgaatcgagctcactctcgatgcctccctatataatgccatcgcatgcgatcttgcgcaccctgtattcagttatactggatgcgcttgatgtcgtccggccaccgtg

SEQ ID NO: 6292 - DNA, 177 bp, Diabrotica virgifera
  misc_feature (55)..(140): n is a, c, g, or t
  misc_feature (146)..(172): n is a, c, g, or t
gtttcgtttacggtgccggctaataaatgtggagttattattggtagaggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnttaaannnnnnnnnnnnnnnnnnnnnnnnnnnggttt

SEQ ID NO: 6293 - DNA, 229 bp, Diabrotica virgifera
gggtaccatttttaatttaaatacatatccttttatttataccactcccaaattaattgttttacggtaaacatagttcctttagggaaaggggcaaatttggccccttttattgaattccaaaataaatttggcaaaccaattttatttaattacccaacccaaaataattaataagggtaaaaacttcccccgcggttccaaaaaaaccatcatttatttggcattt

SEQ ID NO: 6294 - DNA, 121 bp, Diabrotica virgifera
  misc_feature (120)..(120): n is a, c, g, or t
taaattgaatcttaatgacaaatttgccacattttgactaaataaacactttagttaccctaacacatttattcggtctttgatttttgataaaaaggtcaaaatgtcatcccagatcgnt

SEQ ID NO: 6295 - DNA, 224 bp, Diabrotica virgifera
  misc_feature (3)..(64): n is a, c, g, or t
  misc_feature (68)..(98): n is a, c, g, or t
  misc_feature (125)..(143): n is a, c, g, or t
tcnnnnnnnnnnnnnnnnnnnnnnnnnnnnnnnnnnnnnnnnnnnnnnnnnnnnnnnnnnnnnnggcnnnnnnnnnnnnnnnnnnnnnnnnnnnnnnnccccctccaaagcaaatccttttgaannnnnnnnnnnnnnnnnnngaggcgtcccgggggttttaccactaaaatttttatttcttaactccgccaaacacaaatgtgtgtgggtgcaccccatta

SEQ ID NO: 6296 - DNA, 229 bp, Diabrotica virgifera
  misc_feature (135)..(184): n is a, c, g, or t
  misc_feature (202)..(223): n is a, c, g, or t
aagatatgaaaatatctaatacctggttcaagctaccacctagacgcttatatacatggaaagccccagcggaccgccccgagagtatagttcgaaaccagatcgattaaattatggttaacaaaagatttggannnnnnnnnnnnnnnnnnnnnnnnnnnnnnnnnnnnnnnnnnnnnnnnnnccatgtccttctcttagnnnnnnnnnnnnnnnnnnnnnnaggggg

SEQ ID NO: 6297 - DNA, 136 bp, Diabrotica virgifera
gtgaatcggctccagcgcaaatgaacgtactaatgctgttgtctttattcatgctcaacgttgctctaccgttgctcctcagtagacccgtatgagtcctacaatatggacctgtatctctcttcgagtctatatg

SEQ ID NO: 6298 - DNA, 320 bp, Diabrotica virgifera
  misc_feature (154)..(171): n is a, c, g, or t
  misc_feature (173)..(291): n is a, c, g, or t
ctcgtgccgaatcggcacgagataaaaaccgccgaacacagagctttcccgaaagcgttaaaacttctggcctcggataaaattagattaggagacgataataaaattatctggtcttgagatgttgttatgaaataaacttttactagtctcnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttac

SEQ ID NO: 6299 - DNA, 94 bp, Diabrotica virgifera
taaaccaaaatacctcaatttttaacaaaaaggtctgcacactgcccgttaccttcctaaattatcaaagtggcggtttgagaaagagagaaag

SEQ ID NO: 6300 - DNA, 83 bp, Diabrotica virgifera
caacttggttattccaacctccaaggtgtcaacaaccaaggtgtctaccaggctgatgttcttgcttcatcaatttgcagagt

SEQ ID NO: 6301 - DNA, 194 bp, Diabrotica virgifera
agcccatctgcctccaagtttatcatcactatgattattgccaccctctctcacggagtatggcggccgactcaacaagagtacctccttgccttcggattattttacacacgactgtgatattactccgtctggcatcaatagggtatgtctatatgcagggcgggtatctacattttctgctccgatgacat

SEQ ID NO: 6302 - DNA, 154 bp, Diabrotica virgifera
ctagtacagaattccacgtctatcttatcgacacgttcgtaccttcagtttagattattcctatttctaacttctagggcattatgtactcatgttcgtccgtctaaagatctagtccaccggccaggatctatcccggtgtaaacccatattc

SEQ ID NO: 6303 - DNA, 187 bp, Diabrotica virgifera
gaatctgatactaatgtatctaaagatattgaagaaccaatctcaatcgacaatgagaaagtaagtgaggctgttaaaactaaagaaattaaagagactgatgttgaagctgttacagatcagaaaaacgtagtactccttgaaactgttgatgaggttcatgccgaatccctattgaagaatctgg

SEQ ID NO: 6304 - DNA, 90 bp, Diabrotica virgifera
tgggatcgatccttgccagtagaccagatctttagacggaaataagggctcgtgcgacagtcgtagcgaactacgattgcctagtaaagt

SEQ ID NO: 6305 - DNA, 164 bp, Diabrotica virgifera
  misc_feature (98)..(98): n is a, c, g, or t
gcagcccgaaataagttgtctacttcgtctgtccctagtaacccataatgtaacagccttctcctctcctacgggtaggcatgtgactgttagattancgtgtaatctgaacctagtcggttctctacgttcccaaattgaccttcctaaaagtccttacaacc

SEQ ID NO: 6306 - DNA, 339 bp, Diabrotica virgifera
  misc_feature (51)..(71): n is a, c, g, or t
  misc_feature (261)..(286): n is a, c, g, or t
  misc_feature (288)..(301): n is a, c, g, or t
  misc_feature (308)..(335): n is a, c, g, or t
gcgctgactcggtgagagaaaaattatgtgatatattgggtcttttcgtgnnnnnnnnnnnnnnnnnnnnngagagagaaacagcactggcgcacacgggttgagactcagataatgtaaaattttaaaagtcgaagagacataaaaatataggtgcgagaccaattataaactttaaatccacatggatgtgtgtatctatataagtgatgagatatcgcaataaaaatttagtgtgttctcgagagtgggtgaggctgnnnnnnnnnnnnnnnnnnnnnnnnnnannnnnnnnnnnnnngcccccnnnnnnnnnnnnnnnnnnnnnnnnnnnncccg

SEQ ID NO: 6307 - DNA, 122 bp, Diabrotica virgifera
aaaacttcacaatgctgtgtacttgatagctaaataacacagataattatagaattttttttcaaactctgtatagcatttaaaaatattgttattaatcaacaaataaatattgataatta

SEQ ID NO: 6308 - DNA, 233 bp, Diabrotica virgifera
  misc_feature (119)..(119): n is a, c, g, or t
gagaaacgaaagagaacaacttagagggtggaatgtggaatacgaaagtcgacaaataaaaccttggaatcaacccgagaacgataatatgtgaaccactaagatccagcgtgacctangatttcttggtctattagctatgaacggaatccaaactctcttatattttttagtggtagaattccgtgtgtttgtttactactgtgtcgcaaaaacgcaacatactcatacca

SEQ ID NO: 6309 - DNA, 141 bp, Diabrotica virgifera
  misc_feature (107)..(107): n is a, c, g, or t
  misc_feature (114)..(114): n is a, c, g, or t
  misc_feature (122)..(122): n is a, c, g, or t
tgatgatatctcttttgattactgaactttcatttgttaatatttttctattgtcgtttttctctattactttactaattattttgggaatattgtctgtattttanagaatanagaaatanatgtagttagaattgtaaa

SEQ ID NO: 6310 - DNA, 109 bp, Diabrotica virgifera
aatacatctgattaaaatgacttgttaaagaatgttgtgttaatttgtttctcttattgtttatacgtgttatttgtataaaaaagtgcaagtgttcgatgactcatct

SEQ ID NO: 6311 - DNA, 264 bp, Diabrotica virgifera
  misc_feature (128)..(128): n is a, c, g, or t
  misc_feature (141)..(141): n is a, c, g, or t
  misc_feature (168)..(168): n is a, c, g, or t
  misc_feature (179)..(179): n is a, c, g, or t
  misc_feature (256)..(256): n is a, c, g, or t
ctttatgtttatttccatcccattctttgtatattcctgttccagtttcctcatcatagaactgaggtcatcttcgtcttgtgcgatcacttccttcgcactttcttttccatggtttcagggttttnttacaggaatatnttgaacagggtatgggatgtggatcanccctgtattantcactttgtggtcttaaatggactgcatattatatttcccattttaatagctactgtgttattcttgtagattggtnttactgct

SEQ ID NO: 6312 - DNA, 128 bp, Diabrotica virgifera
acacaagaacgtttgtggcaaactcaataccaaactctaccacgcgtgtattaaaaactgctttatttgtaatttgttgttaaaatgtttgttataattgttgaaaatatataaacatttgttttttc

SEQ ID NO: 6313 - DNA, 427 bp, Diabrotica virgifera
  misc_feature (310)..(310): n is a, c, g, or t
  misc_feature (320)..(320): n is a, c, g, or t
  misc_feature (371)..(371): n is a, c, g, or t
  misc_feature (398)..(418): n is a, c, g, or t
aacatggtgaaatatttagtgataggtatttttatatcgtttagttttatactcaataaatatgtatattgtgcaaatataccaatatgtctgaatcccaaggaacagggaactctagttgcagatctgcagattgaaaaaaatatgtttgactcaatttatgttcgaataccagaaagcggttttcttgatgctgccatatcatgcataaagatatacgatatcggaaatagtttcgctgtacctgttataaatgatggcggtcttggattcgcatatgtagaaatctctatagaacaccgaattctanaggaactaanatataggatacaagtgtttaaagaatatcattgacagttctgataatatanttaatatttgctttgtgattttcattnnnnnnnnnnnnnnnnnnnnntttttggtt

SEQ ID NO: 6314 - DNA, 67 bp, Diabrotica virgifera
gcgcggtggcgtttcggcgtcgtcgatgtttcggaaagatgaccaaacttgatcatttagaggaagt

SEQ ID NO: 6315 - DNA, 179 bp, Diabrotica virgifera
  misc_feature (10)..(32): n is a, c, g, or t
gtctcgaggnnnnnnnnnnnnnnnnnnnnnnnaaggggtttattttattttttaccgggggccctcaaaacctttaagggggccacacttgggggggctttgggtcttttaactttgtaagggggggtttcttttttttgggaatattttttggggccatgttgaaagaattctcctta

SEQ ID NO: 6316 - DNA, 255 bp, Diabrotica virgifera
cggcacgagctttttctgtctttacacggcaaattatgtgtagtaaaattctcactggtatggatatgtaaacattactacttgacaatgtcatcattaactttgaagagatggcttttaaatatttttgaataggtaattgtataactacctaaattattaattcagttaactaataggtatgataattttttcactaactatgtatataatgattgtaataatttatatactgtacaacaaaaactaatactc

SEQ ID NO: 6317 - DNA, 325 bp, Diabrotica virgifera
  misc_feature (243)..(243): n is a, c, g, or t
  misc_feature (279)..(279): n is a, c, g, or t
caagccgcttcttcaagaaccaagccctcctttggacccggaatcttaaactaccaccctctcaaaccccatggggaatccccgacacattttgatctattggaaaggtcgaaagaaagggggagggaagctggagattcaagtgaagttaaaaacaccaattcagactcaacaggtcgagcaaattcaagagaggtggttagtggtcgaccagtaatcgcttattgttgatatttagagttngctatgaaattattatcatattataatgtatagctntaacttttatacagtgagcgcgtaaaggttggaatgagttcatttt

SEQ ID NO: 6318 - DNA, 299 bp, Diabrotica virgifera
  misc_feature (30)..(80): n is a, c, g, or t
  misc_feature (281)..(281): n is a, c, g, or t
cacagttttatgaaagtaccctgaaaaccnnnnnnnnnnnnnnnnnnnnnnnnnnnnnnnnnnnnnnnnnnnnnnnnnnnacaaggcaggtggtccacaaggggtttttataaaaatcgtattaggaaaagaagaacattcagcagaagaatgggctaaattgttgcttgaagctcttcagcctttggaagaagaactttcgcagaggggaacacctttctttggtggagataaacctggaatggctgattacatgatttggccatgggcagagagagcangatgtataggaattaaat

SEQ ID NO: 6319 - DNA, 122 bp, Diabrotica virgifera
  misc_feature (8)..(31): n is a, c, g, or t
agatctannnnnnnnnnnnnnnnnnnnnnnncaaaagtggggcctttgttcgggggggggggagtttctcacttctctcttataaaatttcccccccccagtatttttaagtcaaaaatttt

SEQ ID NO: 6320 - DNA, 370 bp, Diabrotica virgifera
  misc_feature (312)..(312): n is a, c, g, or t
ggcaccagctcgctttttatataatcaaatattcaaaaaattcgatatcctggggtccagcttttttaacactttctcatttttgactctgtccctccatgatgttctacgcattcggcacaggcacaacatttcaaaagctttaagtttggtaatggatctgatatttaacgttcacacttccattccgtacaaaagaacggaccaaacgtaacactttagcatcttgtatctcaggttgaaatccaacttgcgagcagaagaaatttacgaagtttaaaaaagcttccagacttggtctactctgctctntatttttagtttcaggggccccaccatcgttgcatttgggtaactatttctgcctatg

SEQ ID NO: 6321 - DNA, 126 bp, Diabrotica virgifera
  misc_feature (32)..(63): n is a, c, g, or t
ctctctctgtctctctctctgtctctcggtgnnnnnnnnnnnnnnnnnnnnnnnnnnnnnnnnaccgacagagagagactgaaagagagagagaaatagagagagtgagaataaaaaaataagtgg

SEQ ID NO: 6322 - DNA, 281 bp, Diabrotica virgifera
tcgcaccaagcacaatttgatatttgcattttgaactaataaaaaagggatttcttaaaacagggaccccctaattgcaaaagctttctaacctacttaaaggctcctccgggcttaataaatgaactctaggttaggatgggctaaaatttcttttttgggcaccccaccttcttatgaaaacaatttttggaaagggtatccagatctttgtcaaatttccatataactgtttgtttcagttgacccaatgcattaataatactgttctttttatcatc

SEQ ID NO: 6323 - DNA, 295 bp, Diabrotica virgifera
  misc_feature (11)..(42): n is a, c, g, or t
cggcacgagcnnnnnnnnnnnnnnnnnnnnnnnnnnnnnnnncttgggggggggctactgttataaactcccccaaacccaaaaggtttaaaaaaaccaaattttttcctataagggacccttgggatgggggaacccaaatcctttttgacaaatgtccaaaaggccccttttttgggggtgccccaaacgggaaggcttaaaaaaataattgggaattgggcaccgttccaaaaacaaaagtgggaaaggagcccgccgccttttttttcccaggggggggatccaacaccaa

SEQ ID NO: 6324 - DNA, 217 bp, Diabrotica virgifera
  misc_feature (16)..(40): n is a, c, g, or t
aggaaaactagtctcnnnnnnnnnnnnnnnnnnnnnnnnntttgggccaaaaattttgcatttaaatttatttcaattggaccccaatggggaactattggattttcctttattaaaaatttttgcattttgaaccccaaggtttttctaaatatagggttattactcgggccaaattcggcacgaccttgtgccaaatttggcacggggggggggc

SEQ ID NO: 6325 - DNA, 254 bp, Diabrotica virgifera
ggcaaatagagaattaatttattaacactaatatgtaatttatgactttatttccagaaaaacgaaatcgcagtatttccattagttcgttatagttattgattctggcatttctggtggtggtggtcgtggcattctcatggcaaccttgaaggcatcatagatgaaccactgcaaagcagtcaatgtaccaatcatcacaatcctaggagtcaatcccttccatatccagccattcccaatttcttagcagc

SEQ ID NO: 6326 - DNA, 147 bp, Diabrotica virgifera
gaaagattagcaatgaactacatactgtcagaactacatactgtcagtgtgcgcaggcgcgcggtaaatgtacaattttaccctcaatcgattcgccgctaaagaagaatatcttcaaaaataaacctacgcattactacacccttc

SEQ ID NO: 6327 - DNA, 77 bp, Diabrotica virgifera
accagacagtgttgaatctcattttaaggaagtctggcaaatgatggactggtgcagctgttgttggggcgtcggtg

SEQ ID NO: 6328 - DNA, 184 bp, Diabrotica virgifera
gcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgc

SEQ ID NO: 6329 - DNA, 161 bp, Diabrotica virgifera
  misc_feature (22)..(38): n is a, c, g, or t
  misc_feature (131)..(153): n is a, c, g, or t
ggggcctatttcagtcgaagannnnnnnnnnnnnnnnnatatgacataatttttcttaatttcgtttattttgtattgaaactatattatacattcatggaagtctgtgtgaataaatttttgataaaacnnnnnnnnnnnnnnnnnnnnnnncaaggggg

SEQ ID NO: 6330 - DNA, 526 bp, Diabrotica virgifera
  misc_feature (403)..(420): n is a, c, g, or t
  misc_feature (466)..(489): n is a, c, g, or t
  misc_feature (492)..(513): n is a, c, g, or t
tttggtgtattttttaatgggcccgattttcctgggcccttgtggttggcgaagattcagatacatcttagcaaaaccctcggggatttttaactagggacccatgccgaatttccctaagcctctgaaaaaatcccgtatgatacactaactgaaaagtttcccgaccacaacttctggagaacaccctggaaagattttagatacattagggcccttcatcgggtgaacgttttccgtatttaccaaacgttctccgattggtaatagcccaagattatagattcatgagatatgaatgatattgaaaaatatgttaacttgaaaaatccaaatttaacctccgggatttttgaattgggggtaaacgatcctaatggaaaagggagggttatgatttttnnnnnnnnnnnnnnnnnnttttaaaggtaaacaattttggtaaacttttagtttaaattccggnnnnnnnnnnnnnnnnnnnnnnnncannnnnnnnnnnnnnnnnnnnnncctggttcgcccc

SEQ ID NO: 6331 - DNA, 109 bp, Diabrotica virgifera
  misc_feature (25)..(46): n is a, c, g, or t
  misc_feature (84)..(105): n is a, c, g, or t
ctcgtgccggttcatccaaagatgnnnnnnnnnnnnnnnnnnnnnngaatgaaataagtgtttcgtttaaatacatgttttcgnnnnnnnnnnnnnnnnnnnnnntgtg

SEQ ID NO: 6332 - DNA, 485 bp, Diabrotica virgifera
gaaaaaatagatcgatatttaaatacagcacttagaaagttacaacattttccattgtcttcaggatgacaccagtaaaacagtcaacaatataaaaatggctggaaatgcatagttgaaatttaaagtgcatcatatgcatccaaaagtgcattaacatgtcaaaataagtgtattatagccagattttgttacccgggggggttttggtgctgatgaaatcaccaatactccataaggcccatcctttgcaactcctaaagtacaacgaccctgattgggaacgacacacaatctggaatcagatgagtgtcttttgagcgtgtcaaaaaaggttaacaagttcatgaacactgctgatcaatttatgaatgctcgggattttgcatagagaccaaaaagtcctaagagtcaggataataacgagtaaaattcttgtaataaatttattaccaccgaacaaaagacaatttataaagaaaacc

SEQ ID NO: 6333 - DNA, 244 bp, Diabrotica virgifera
  misc_feature (11)..(30): n is a, c, g, or t
  misc_feature (44)..(69): n is a, c, g, or t
  misc_feature (77)..(114): n is a, c, g, or t
  misc_feature (117)..(141): n is a, c, g, or t
  misc_feature (169)..(188): n is a, c, g, or t
  misc_feature (193)..(219): n is a, c, g, or t
cgctgcccttnnnnnnnnnnnnnnnnnnnntctaggtgccttcnnnnnnnnnnnnnnnnnnnnnnnnnnccataacnnnnnnnnnnnnnnnnnnnnnnnnnnnnnnnnnnnnnntgnnnnnnnnnnnnnnnnnnnnnnnnncgaggaacacaatgctaaatacgaaagnnnnnnnnnnnnnnnnnnnntggcnnnnnnnnnnnnnnnnnnnnnnnnnnncgctgaattccaagctatgttggcc

SEQ ID NO: 6334 - DNA, 87 bp, Diabrotica virgifera
gcatgttggggtttttaaaggtttcattggtactctgaagtatttgagggtctatacatttaaaatctacagctggagaaggaatgt

SEQ ID NO: 6335 - DNA, 279 bp, Diabrotica virgifera
  misc_feature (253)..(272): n is a, c, g, or t
aaaaatgatgtgctcgagtatgcaggttataataagtcttattattaatgggaaaggtgcagctatgacaaattgcaaatttaacccggatacaaacggtacaagtcattaccacccttccacactttgaaaacgaagaaaatttccttcgttcatcatacaaactttttttaatattctttgattatcagatagatttgttaaattagaaaaaattatcagttactagcataaatattatccaccttcaacnnnnnnnnnnnnnnnnnnnnggaaaac

SEQ ID NO: 6336 - DNA, 154 bp, Diabrotica virgifera
  misc_feature (129)..(150): n is a, c, g, or t
gggcttagctcgcaagggcggtccaactcaatcccgccgcggtgctcttgactgagtgtcgaggtgggccggtacgtttactttgaacaaattagagtgcttaaagcaggccaaaacttcgcctgaatnnnnnnnnnnnnnnnnnnnnnnccga

SEQ ID NO: 6337 - DNA, 407 bp, Diabrotica virgifera
ccgcgagggtctgcagtcagggcatagggaaactttttgcttcgctatagatttaaataccacaaatctcaatttaaatactattggaattgttgaaactttcgcatttaaaatctaaatgaactctactaatatactgttagactagccggggtttcctatgcatttaactctatatattaaataaaatcagtgtgtatttgttttgttattaagtgaaacacaactgtagtgtagcagcagtactgttattgatactgctcagtcttctatgtgttagaattaggttatagaatgctcgacaacgtgatacatcaaccagggaatttatacagtcactcatgtgtggtttttgtgaagattttgcgttacgtgcaccatcatggttatccttcccagcgttgaca

SEQ ID NO: 6338 - DNA, 88 bp, Diabrotica virgifera
aactctctatctctctctctctatggatctgtctctatctctggggaacgggctaccaaaatctaacacgcgagaagaaacacacaac

SEQ ID NO: 6339 - DNA, 247 bp, Diabrotica virgifera
  misc_feature (9)..(31): n is a, c, g, or t
ctagtctcnnnnnnnnnnnnnnnnnnnnnnngaaattaattcctttagtttttaaaaattttcccctttaaataaccggttttttccacctgggggaaaaatttcagggggcaaatcccccaaaattggttccccgggcccactgggagtcaccctggttaccccgaccctgttccccagaatttttaaccccgtgcccaatattgccccaagtgccaagtcagggccctctaaaaaatggcccctt

SEQ ID NO: 6340 - DNA, 200 bp, Diabrotica virgifera
  misc_feature (121)..(172): n is a, c, g, or t
agaggctcgtagcacgatatcggcaacgagacggacacgagtgctctgcgctctctctcacgggctcggagtctcactagctctctctctctccccccgcgccccaaaccgcacccgggannnnnnnnnnnnnnnnnnnnnnnnnnnnnnnnnnnnnnnnnnnnnnnnnnnncaaaaacaaacaaagaggaagagaaaaa

SEQ ID NO: 6341 - DNA, 185 bp, Diabrotica virgifera
  misc_feature (109)..(140): n is a, c, g, or t
ggcactggttcaacaactgggggaacgacgaccgaaggaacacaacccccaaaattttaatcaaataatgataataaagatatgcccaaactttaataaaacttgaacnnnnnnnnnnnnnnnnnnnnnnnnnnnnnnnncctggggccaaattgggaacaagttttggccaaattcggcccggg

SEQ ID NO: 6342 - DNA, 493 bp, Diabrotica virgifera
ctcctttatgatctttattcgtatatttgggatatgagaggtgtgatatcattgctcaattcgtacgtaaaatggcttgctggcggtcatttcccaccatcgatgccatcgtatactcagggaacttacacatggttttcgaaaggatggaaggaaacgtttatgagcggtgagcaggaaccgtgggtgttcagaggaggtttaactgcggatttacagcgtctggttcccgtagactccggaaacgatctcttcctgtacaaagtccccgaagtacccaccaatagagtgttcacaatacgtccttacctgccaaccgacgaagagaccatttacaatgtctgcatcaggacgtgcaaagacggtctcgaagatccgataccatatccagacaatcttaagcatctacacgccgataagatagtagggccttacttgacacttcatccagaattttgcttcgtaatggaagacgacgctggtgtaatcgggt

SEQ ID NO: 6343 - DNA, 75 bp, Diabrotica virgifera
gtcaaattacgcagcgagaaagagtgctagattcggcgtgaccacagaagttcagcccactgtgttgcccaagac

SEQ ID NO: 6344 - DNA, 456 bp, Diabrotica virgifera
ttcggcacgaggtggtcttcgtgggagggagacatttctacatctaatagtacgtcactggcgtttacgtaaatagactgtggtgatgaagggcaggacgaatgattgctgtctgtctcactagctggttcatctttgatatttaaaggatcgtgttggagattattgcatgcggtcttcattgaaattactgggaaacattcatcatccatttcatcaactttgtggtgtgaagtaggcgaatctggtaaactatctccatctgatgtaagactgtaagaatgttctgtcttaataggtctggttcccaaagcggcgtccgtcatcagtctatcgtgaagaataactcccggcaggtccttggttggtatgtagctccattcgatggtcatatcccctgactgcatttttaatacctcttgcatcgccggatctaaatctgcctcccagagctcc

SEQ ID NO: 6345 - DNA, 199 bp, Diabrotica virgifera
ctcgcatatgcagatattttttacggagtttagaagaaaaataaaaatactatatcatatcagtaaacaaacctacataacctgatgtggttattacaccaattctgaaccatcatacaacgttattcaattaactatcaaataattcaacaagatgctagatgacccaaatttatttaagttgaatctcgtgccgaat

SEQ ID NO: 6346 - DNA, 313 bp, Diabrotica virgifera
  misc_feature (115)..(140): n is a, c, g, or t
tcaaattggatgcaagccgggttgcaagcgtgtaaaagaccatgcaatagacttgcatgaaagtcttgcatgcaagaaattgcagcaagttttcttgcaagctgtaaagcggtcnnnnnnnnnnnnnnnnnnnnnnnnnntactggggtacttatatgtcaatgggtacactactgattgttggggcaagagtctactcgtggctaaattgtcaatcaaagacaaggacctagccaatacaaagaagaagatgtagaagaataagaagaaccctttttttggtaacctaaaaatctgacttgtttttctatcg

SEQ ID NO: 6347 - DNA, 465 bp, Diabrotica virgifera
  misc_feature (163)..(178): n is a, c, g, or t
ttcttcactatttaccgggtattgggtacgtcgcatggtagtaggtaacgggttgacttcttctttggtcgtcctgaaaaggccaactcttcacccttggatcttggaaactccattttggacaatccatattggccccacttttcttaataccgtcatcccnnnnnnnnnnnnnnnngagaatctcgcaaataatactttatggtcaactgggggctggcccatggatactgacatattagcctcgccatatgtattaattagctcaccagtcgcttgtctaaactttactattgcaaggtgataattattatggtctcgtactacatctggacgtgcgatagttctcgttgcacctgtatccaccaaaaatgatctacatctattactgatacgaccttcgatgtataagttgtgaatccacccgaggacgtaagggtgacagttactatgggggctctaggt

SEQ ID NO: 6348 - DNA, 287 bp, Diabrotica virgifera
accggacgaacccaggaccaaccaaccaaaagaactttgggctttaattgccaaagtattggttttcaccacccttgtccaaatttaaaccggtttaccccttgacctgaactgccccacacttaacttggcttgcaattcccttgaaatcaaaaaaaaggtgacccgtcgttcttgtaaaacacttgaaaaaaacccaaaagccttaaattctgtgaaggccgccttggtaaattggtacccaaccaacccattgtgtgtaaaatatttcaaaaaattccaaccct

SEQ ID NO: 6349 - DNA, 324 bp, Diabrotica virgifera
  misc_feature (170)..(197): n is a, c, g, or t
cttggaggattccgccccaacctcagccaggattttggcaaagaaaagtattcctttgccggcccagttttaaaggattcccccaatttcttaattaccagaagctttccagtcttttaaaacttgtaccccaaaggtattaaacctttttaaaaaaagggcatggaggnnnnnnnnnnnnnnnnnnnnnnnnnnnngggtttaatcctccttccagaaaaaaacccaatggatatggtcatttggaaatgggcctaaaattctaatccaaggtaccttgcctggctttaacttttgaagaaccaaagaaaagaatttttggaa

SEQ ID NO: 6350 - DNA, 275 bp, Diabrotica virgifera
  misc_feature (64)..(85): n is a, c, g, or t
  misc_feature (254)..(254): n is a, c, g, or t
cagaagggtgtgtctttagttacgctacgagtgactaaaatcaagaatataaaaaaatcaaccnnnnnnnnnnnnnnnnnnnnnnttccaatttgaaggactattcgaaaaaaactgttagacagactaaatatacaaaaaaaaagaacaaagagctgggataaaaacaaaatcacacagggggggggcccccccacccataccccctttatgggagagtaatacaactccccgcccggggttaaaaaaagggnggacatttggttgactcactt

SEQ ID NO: 6351 - DNA, 474 bp, Diabrotica virgifera
  misc_feature (14)..(59): n is a, c, g, or t
  misc_feature (418)..(465): n is a, c, g, or t
ccccaacctacccnnnnnnnnnnnnnnnnnnnnnnnnnnnnnnnnnnnnnnnnnnnnnnggcaaatccacccgaattcaaggcagcttccttagaaaacctaagaaaagtcattgatccaccaaaaaaattggaacctaatcctttccgtgacccaaaaaccggccaaaaaggattctggtaatccttgaaaaaccccaccccacttggccaattcgtaactccgtcaaacccaaaggaatggaagaagtttccttgtagaattaattttggaccaattccctgggttgtcccccgaaaccaattccattttgaaaccgctaatttaggtgtatagtttgttagataattacacatactgacaaaatgtgataaaatattgggatcttgtgatatttctattaaataaatagtgtctnnnnnnnnnnnnnnnnnnnnnnnnnnnnnnnnnnnnnnnnnnnnnnnntgggggggg

SEQ ID NO: 6352 - DNA, 241 bp, Diabrotica virgifera
  misc_feature (4)..(4): n is a, c, g, or t
  misc_feature (8)..(31): n is a, c, g, or t
  misc_feature (42)..(61): n is a, c, g, or t
  misc_feature (75)..(100): n is a, c, g, or t
  misc_feature (108)..(145): n is a, c, g, or t
  misc_feature (148)..(162): n is a, c, g, or t
  misc_feature (165)..(216): n is a, c, g, or t
gaanaatnnnnnnnnnnnnnnnnnnnnnnnncgctgcccttnnnnnnnnnnnnnnnnnnnntctaggtgccttcnnnnnnnnnnnnnnnnnnnnnnnnnnccataacnnnnnnnnnnnnnnnnnnnnnnnnnnnnnnnnnnnnnntgnnnnnnnnnnnnnnnacnnnnnnnnnnnnnnnnnnnnnnnnnnnnnnnnnnnnnnnnnnnnnnnnnnnngcccccaattccccctaaagggggg

SEQ ID NO: 6353 - DNA, 320 bp, Diabrotica virgifera
caccaacctctgcccaaatccgcaccaagtttcttaatattaacctccgacctttcctggttttaagaattaaaaccaaggctttaaatggccatattggtaaaaagccaatatttgccgattcttaatgaaaacctaacccaaccggaaaaaggaaatcccgaaaaccccttattttaaccgacttgaatggagccagaaaaccggattaagcctcagataaagcttggggtccagggttggaccccggtattggaaggtactctgggtatttgactggtgataaaaaaccagaatctaaattggtcctctgggtcttt

SEQ ID NO: 6354 - DNA, 307 bp, Diabrotica virgifera
  misc_feature (44)..(64): n is a, c, g, or t
  misc_feature (72)..(91): n is a, c, g, or t
  misc_feature (94)..(129): n is a, c, g, or t
  misc_feature (156)..(168): n is a, c, g, or t
  misc_feature (170)..(195): n is a, c, g, or t
  misc_feature (247)..(247): n is a, c, g, or t
  misc_feature (250)..(253): n is a, c, g, or t
caccaacctctggccgaatccggcccaaggacctagcctcggannnnnnnnnnnnnnnnnnnnntgttcctnnnnnnnnnnnnnnnnnnnnacnnnnnnnnnnnnnnnnnnnnnnnnnnnnnnnnnnnnccaaaaatattcccccacacaaatttnnnnnnnnnnnnngnnnnnnnnnnnnnnnnnnnnnnnnnnataccccttgggggggggggtattaaaaacccgggggggggctttaaaaaantgnnnngtccatcgcactccgatttttttatttatacagtgatgaaggattgtattagtt

SEQ ID NO: 6355 - DNA, 297 bp, Diabrotica virgifera
  misc_feature (291)..(291): n is a, c, g, or t
actcaccgcgggggcggccgccctaaaacaattgattccccggggtgcaaggtcctgacaaattccggaccaaggcctttaaaccatgggtcctggaaaaattgggacacctcattaatggcaatacctgctcacaaaaatgtgaaagcatgggctcatattatgtgggaggcatttgttaccaaaacgactgttattgcgcacacctcatttatatatgtagacatcgcaccagcatcttaataatatatagtttcacaacatgtaaaaccccgaaaaaaccaccaattnatttct

SEQ ID NO: 6356 - DNA, 389 bp, Diabrotica virgifera
  misc_feature (12)..(48): n is a, c, g, or t
  misc_feature (77)..(94): n is a, c, g, or t
aatatctagttnnnnnnnnnnnnnnnnnnnnnnnnnnnnnnnnnnnnnctacctaaaaactacataatttcatcagnnnnnnnnnnnnnnnnnnaattgtgtaacaattatattctgatagaattactaattttatattaagttacaacccttttgatgtaattcttgaatttctcatgctgcttgtcttgcagcttcgcgatcttattcttggctttttcgtctttacatctagcacatacctcttttgtaaggccatgtaatgggctctggtaataaaaggacagatcttctagttctttgttctttctgtgaatgcgagtatgtaaaaatatttctatcacgcaaacaaaaacgagcatgatgggatggaagaatatcattgtcgg

SEQ ID NO: 6357 - DNA, 202 bp, Diabrotica virgifera
cggcacgagagcaagaggaaaagagacagaaacaagaagagaagagacaaaaggagaaagaaaagagaaaacaaaaggaagaagaaaaaaggataaaagaacaacaaaagcgagaagaggagcgacagcgtagagaggaagaacgtctgcgacgggaagaagaaacagcaaaaagaggaagaaaaaagacgaaagcaagagg

SEQ ID NO: 6358 - DNA, 439 bp, Diabrotica virgifera
gtttactctcagtggtggaaaacgtgaattgggtgaccacgtgaatgaaattgaacatctaattgatgagtggattggtttgccctggacagagttgttgaacgatgaggttgatggtgtagagatggtgtctgaaggtttgcctaaaaagatagatgacttgttgttgcttccagttactactatgggggcggatgagagagagagaatcttttggggaggaggtaaagctcctgccagttagaagaaagctggatcattcgctaacaaggtgttttacacgagccctgagtacgtttgtgttggggagttcgtggagaaatgttaaaggaggttgcatgaagagtggggttaccaagaggttgcgggtgagattggtgcaactgacttgagagtttgatacttgggcagattttaaaatgttggggccaggttaatt

SEQ ID NO: 6359 - DNA, 103 bp, Diabrotica virgifera
  misc_feature (14)..(28): n is a, c, g, or t
  misc_feature (30)..(47): n is a, c, g, or t
  misc_feature (53)..(72): n is a, c, g, or t
gattcggcacgagnnnnnnnnnnnnnnngnnnnnnnnnnnnnnnnnngagtgnnnnnnnnnnnnnnnnnnnngcgagcgcgcgcgcgcgctcgcgcgaaaaaa

SEQ ID NO: 6360 - DNA, 497 bp, Diabrotica virgifera
  misc_feature (12)..(31): n is a, c, g, or t
  misc_feature (140)..(169): n is a, c, g, or t
  misc_feature (331)..(351): n is a, c, g, or t
  misc_feature (365)..(382): n is a, c, g, or t
ctagtctcgagnnnnnnnnnnnnnnnnnnnnccttaggttgtttaattttatgcggcattattctaaatttaaacggggaataaatatttttcctagtctttttactcaaattaaattggccgaaaatcctttgggaccnnnnnnnnnnnnnnnnnnnnnnnnnnnnnngaaaggttttaagctgcccctttgtttacacaccaaagggggccattacaatttttatttaataccattcccaaattttggaagataaaattaaacccccaccccattattttattggtttttaacaaatacatcccacctttaaatccaaggttccaaagnnnnnnnnnnnnnnnnnnnnnctttaccttttccnnnnnnnnnnnnnnnnnnagatcttttttaaaaatcttttagttttatgacaaatattcggccgttcacctaattaataactttaaaaaggctttagacccttttccttataaataatcggaaaaaatataaa

SEQ ID NO: 6361 - DNA, 185 bp, Diabrotica virgifera
  misc_feature (69)..(92): n is a, c, g, or t
  misc_feature (127)..(157): n is a, c, g, or t
ttggtggtggaagtttaattaaagcccccccaataatttttaacatcgtcggtggggggcgaccccaannnnnnnnnnnnnnnnnnnnnnnntctccccccctcttctcctcaatttgaaagttggnnnnnnnnnnnnnnnnnnnnnnnnnnnnnnncaaggttatttgtaaaggaagacccttc

SEQ ID NO: 6362 - DNA, 115 bp, Diabrotica virgifera
  misc_feature (18)..(32): n is a, c, g, or t
  misc_feature (34)..(50): n is a, c, g, or t
  misc_feature (53)..(71): n is a, c, g, or t
  misc_feature (86)..(110): n is a, c, g, or t
aaatttaagctttttaannnnnnnnnnnnnnncnnnnnnnnnnnnnnnnngannnnnnnnnnnnnnnnnnncccttcattccagcnnnnnnnnnnnnnnnnnnnnnnnnnttaat

SEQ ID NO: 6363 - DNA, 240 bp, Diabrotica virgifera
  misc_feature (122)..(203): n is a, c, g, or t
aagaagaaagcttctaatggttccagtcttttttttattttagttgaaagttttgtttcaaattgattgttccggaaaataatattgtacacaaaatgattcaatataagattttaaaactnnnnnnnnnnnnnnnnnnnnnnnnnnnnnnnnnnnnnnnnnnnnnnnnnnnnnnnnnnnnnnnnnnnnnnnnnnnnnnnnnntttaaggggggggttaaaaaactccggggcggggttt

SEQ ID NO: 6364 - DNA, 505 bp, Diabrotica virgifera
  misc_feature (12)..(34): n is a, c, g, or t
  misc_feature (39)..(156): n is a, c, g, or t
  misc_feature (161)..(184): n is a, c, g, or t
  misc_feature (191)..(270): n is a, c, g, or t
  misc_feature (273)..(293): n is a, c, g, or t
  misc_feature (304)..(497): n is a, c, g, or t
ctcgagtttttnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtnnnnnnnnnnnnnnnnnnnnnnnntaagggnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnngtttttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggggg

SEQ ID NO: 6365 - DNA, 548 bp, Diabrotica virgifera
  misc_feature (55)..(76): n is a, c, g, or t
gcaatatggaaggttttctggagtacttagacataaatacgtaggaagctaaagnnnnnnnnnnnnnnnnnnnnnnctaaaaccacatagcctcaatagaaatgctgtggttgctaacctcaacaaaagagtatattatcaactttcgaagtttgaatatctagctagactataacaataataacgaatgggactgtgacatagcgcgttaggatatggatagaataaaatttgttgcacttaaaaagcaataatgtagcattacggattacgggttattatagtcctgcgaacaaactaagagagtcgttaatattcagctcaacggggtacgattgatggaattatgtacttaaataaacgagggatcattttatataacaggtagatcccttatcgatagaatttcacaccttgaagaatagcgccccgctgagcgaatattaataactcttagtttggttgcagaactttaaatgctatgttttttcttaattgaaccagtttttttcttaattggagatagaggggctttagcagcttttaaa

SEQ ID NO: 6366 - DNA, 667 bp, Diabrotica virgifera
  misc_feature (585)..(585): n is a, c, g, or t
aaatctttggcaaacccccctagggatggttttcttggcaggtgcttattactgcgcccacaaacctctcataatgtttgctggttggagggacccagctcaagatccggtctagttgttcagagaacttcttccagtttgcttttctaagattccacctgggtcgaggatatgatctaattattggaattgatattccaatggtgataagcaccggacgatgttgagtatgtagatgtagatgtaatgtatgtagattaaagtttttaaacatttgcattagacttcttttttaagcgctacctccaacagcaaacttcaaggtccttggattccttccgtggatacatggaaggtccataggaattttaacttttgatgttgttggtcgaaaaagtaaagcagtttgattttaatactgattaggtatgtctgatttctttatgtcattgatatacatattttgtgtagcatcaagtcctttttatgaagcaattaagaattactagtttgtgattggtagaagttaacataataaatggtgaacatttaaatggtaagtatatcctatttatcgatctgctntaccattggtggtaacattaaagttaatcataaatttacaagagaaaacgtatcttaaatactcaattgcagatgtgatttg

SEQ ID NO: 6367 - DNA, 178 bp, Diabrotica virgifera
  misc_feature (100)..(122): n is a, c, g, or t
tgcacgagtgttgccgcacctgcatatggttaatcctacatagacggggtattgctataacggttagttatgattttgtctcacaccggtttaaactcannnnnnnnnnnnnnnnnnnnnnngccctgaggggggcctgtaccccctacccccattataaactttaattcaaccggca

SEQ ID NO: 6368 - DNA, 222 bp, Diabrotica virgifera
  misc_feature (35)..(47): n is a, c, g, or t
  misc_feature (49)..(64): n is a, c, g, or t
attttcaacaaaaaatctctaatagttttcgatannnnnnnnnnnnncnnnnnnnnnnnnnnnncttcaaagggctgtaactttttttatgagcacatttgtactaaggtaagttaagttcagtcgaactatttttgaccccagaatgtgtggtataatttatgacaaatcttttcgggacaccctgtatataaaaatctattgctgtgcgttagtctcgct

SEQ ID NO: 6369 - DNA, 227 bp, Diabrotica virgifera
  misc_feature (53)..(71): n is a, c, g, or t
  misc_feature (81)..(211): n is a, c, g, or t
gtcaactccaaaagtctaattctaaacaaaatattggaaataggcttaattcnnnnnnnnnnnnnnnnnnncacttgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccccgcccggcg

SEQ ID NO: 6370 - DNA, 114 bp, Diabrotica virgifera
ctcgtgccgcttggaatgaggtgaagatcttagcgcaaaatagaactcgaatgcgcgtttggctctatgatccacttaggagttcaagaaccttataataattacacaatttcc

SEQ ID NO: 6371 - DNA, 605 bp, Diabrotica virgifera
  misc_feature (40)..(62): n is a, c, g, or t
  misc_feature (115)..(265): n is a, c, g, or t
  misc_feature (270)..(270): n is a, c, g, or t
  misc_feature (401)..(422): n is a, c, g, or t
  misc_feature (495)..(545): n is a, c, g, or t
  misc_feature (566)..(604): n is a, c, g, or t
ttaagaggaagaacctcaccaagaagagcggtggtggagnnnnnnnnnnnnnnnnnnnnnnntaagctgtatgtcgtgctagttgtactagtacttacatattaatatacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttncgggcgccctcctcccatttttttaaaagaacaggggcggccgtcgagaacaaaatagatcggtccccctcttttttagaggtggttgagccaacaatcaaggtggagccggatgtataaagaaggagggnnnnnnnnnnnnnnnnnnnnnnagtggggggctagtcttcctcctctctttaaaggggtgggggagagaaaccaccccgcacagcggtggggggnnnnnnnnnnnnnnnnnnnnnnnnnnnnnnnnnnnnnnnnnnnnnnnnnnntgtcgtcccttactcaccacnnnnnnnnnnnnnnnnnnnnnnnnnnnnnnnnnnnnnnnt

SEQ ID NO: 6372 - DNA, 604 bp, Diabrotica virgifera
  misc_feature (389)..(409): n is a, c, g, or t
  misc_feature (526)..(549): n is a, c, g, or t
  misc_feature (579)..(579): n is a, c, g, or t
attcggcacgagagtacctgctccatggaccgaccctgaagttgccaagaaaactagagcaatctgggaagaagttggacaaactccagtttccctcaccaaggaagttcccggatttattatcaatagactacagtacgccgtccttaatgaagcctggcatctagtaactgaaggagttttggacgtaaaagacgtcgacaaagtcatgtctgaaggtttgggtatgagatatgcctttttgggtactttagaaaccactcacttaaacgaacaaggttttgtcaactactgtaagcgatatggtgatactatctacgctgtcagcaaagattttaaaccaacaccgaaattcgagggaccacatgttcttgaaattgcaaagcagnnnnnnnnnnnnnnnnnnnnngataaactacaggaaagaagaaactggagagatctgtgcctcaccaaactgagtcagctaaagactgagatgaataaacttaaataatttgtctttgttctattaaattcattttcnnnnnnnnnnnnnnnnnnnnnnnnttataaagaattgacaaacatgcaccacanaaaaagtaaattgacaatctaatga

SEQ ID NO: 6373 - DNA, 435 bp, Diabrotica virgifera
  misc_feature (13)..(64): n is a, c, g, or t
gaactagtctcgnnnnnnnnnnnnnnnnnnnnnnnnnnnnnnnnnnnnnnnnnnnnnnnnnnnngggcggggaaaaccattgggtttaaaaaaacccccggggaaaaccttgggggggggaattaaaaggggggggtggggctttccttgggggccccaacggataagggggcaattttcccaaatattttcccttttaaaaaaagctcccagggcagaaaaaagggcccttggggcccttccccggaccctaaaaaaaccggaagacctggtatggccattttggacatacccggggggacccgcttggaccaaaattttccaaggggggggtctttaaccaaaaagcctttgtgggaaaagggaaagggctgtaccccccccttttaaaacggattggggggggttcccccccccccctttaacggggggggg

SEQ ID NO: 6374 - DNA, 152 bp, Diabrotica virgifera
ggccgcccttaatgtcgtagtcttattaaagtcgcagatccattttggattttatactactactttaaactttttgttttgcatcccgcgtcgggattcgattgatgaacctacaatacatgagcacgtaaaggttggaataaattcatttt

SEQ ID NO: 6375 - DNA, 330 bp, Diabrotica virgifera
  misc_feature (200)..(200): n is a, c, g, or t
  misc_feature (236)..(236): n is a, c, g, or t
tcgtgccgaatacggcacgaggagagtcgtggctatttatgtgacgggacggtgacgaattgacgaatgtcaaatcaatagcagaaacaaacaattttcgtttcagagttattgaatataggagtttacaaaaacttacaactataatgaggtatatatgataatgcattctgttaaggttcctcgtgtgtataaagtanctgctgaggtatctatagaaatgggcgaatgattangaactataaaaacacttgtatatgagaagataaaaaatcatcctaatatcaaagctatatatgcacttgtatcaacactctgtctgaaacttat

SEQ ID NO: 6376 - DNA, 153 bp, Diabrotica virgifera
  misc_feature (2)..(37): n is a, c, g, or t
gnnnnnnnnnnnnnnnnnnnnnnnnnnnnnnnnnnnngtctctctctatatgaggggggggcggtcaccctacccatatctatctatagagagacatatatcgattaactctccgcccatgtagcaacaggaaggttggaataaatccatttt

SEQ ID NO: 6377 - DNA, 181 bp, Diabrotica virgifera
  misc_feature (32)..(56): n is a, c, g, or t
caggtagactgtacattttacatactttattnnnnnnnnnnnnnnnnnnnnnnnnngggtataccttgttggtacatatacgaattttttgtacatataagtaaaagctaaatatactattgattgggttgtataatatttcttttattacctagtggttgtcatatgtttctaggtttac

SEQ ID NO: 6378 - DNA, 258 bp, Diabrotica virgifera
  misc_feature (193)..(216): n is a, c, g, or t
gatttaagcaccatggaaatggattcgataaaggaatgggagtcacaatttgatgaagaatacgacttcgtgggaagactgttgaagccaggtgagcagccgaccaactattcagatgaagaagacgcagacgaatcagcagccggcggagataaagcagacaaggagaaaaaagaagattaaataatccgcnnnnnnnnnnnnnnnnnnnnnnnngctgacgcggttataaacaccgatctaaactaaaagtaaaat

SEQ ID NO: 6379 - DNA, 156 bp, Diabrotica virgifera
  misc_feature (115)..(135): n is a, c, g, or t
aattcacgaccaggtgctagctgttttttccagactcatctaaatgactgactaaaatgagatggtgtgagacaactacatttaagaaagtcctattgctctgagtatgaaaggnnnnnnnnnnnnnnnnnnnnnctcgtgcccaattacgcacta

SEQ ID NO: 6380 - DNA, 393 bp, Diabrotica virgifera
ctcttggactataacttgttcaactgttttcacgaaatattttatagtcactgcagttgcgaaacgaggagatctgaaaaatttgtgtaatttttgtttgaattgtacttcattatcatcttagtagatattataaatattgatccatccatgctatggctctacagtccaataattcgagccatggcctccttcagcaaactttttcattcgttatggtcattctcctccacgatcgactgccaaggatatttctcgagccctcatccgcatcatcctcacatcgctttctcggtcttccaatagacgtcttcgtgtcttcacctgcattcttgcattcgaacatttattggaaacttgttttctgccaccctaaatacatgctggtccaat

SEQ ID NO: 6381 - DNA, 62 bp, Diabrotica virgifera
cttatagcgtagaagaactgggggttcaccctggttttcttggtttgcattgtcgcaccagc

SEQ ID NO: 6382 - DNA, 96 bp, Diabrotica virgifera
  misc_feature (22)..(22): n is a, c, g, or t
ggacttcaaggtttcttgattntccactccttcggtggtggtactggatctggtttcacttctttgttgatggaacgtctatctgttgactatggt

SEQ ID NO: 6383 - DNA, 152 bp, Diabrotica virgifera
aatgatactaaatcaactacactgcgcgccattaaaaagaggccacctaaatgttttgtcatttttaatttttacgaatcctaattgcttgctattagatgtttgtacaatgtttaaaaatatgttttaaagcagtatatgtcttgaataat

SEQ ID NO: 6384 - DNA, 197 bp, Diabrotica virgifera
atagagaactgatgatattgagtgggaaatctctttctaatagactgagtttattcaatgacgttgggttaaaattaatttgtattagctttaatagtttggcgtttgtattagtattaattattattatcaacatgattgtatctggctaaatagctaatttctaaagccatacatgatagaatcagactaaatac

SEQ ID NO: 6385 - DNA, 556 bp, Diabrotica virgifera
  misc_feature (10)..(42): n is a, c, g, or t
  misc_feature (44)..(70): n is a, c, g, or t
  misc_feature (81)..(134): n is a, c, g, or t
  misc_feature (282)..(308): n is a, c, g, or t
  misc_feature (311)..(369): n is a, c, g, or t
  misc_feature (374)..(408): n is a, c, g, or t
  misc_feature (411)..(440): n is a, c, g, or t
  misc_feature (456)..(477): n is a, c, g, or t
  misc_feature (483)..(539): n is a, c, g, or t
ctagtctcgnnnnnnnnnnnnnnnnnnnnnnnnnnnnnnnnncnnnnnnnnnnnnnnnnnnnnnnnnnnngggcctttccnnnnnnnnnnnnnnnnnnnnnnnnnnnnnnnnnnnnnnnnnnnnnnnnnnnnnntaaaaccaaaatattgaaaaattttaaaagccgaacaacttaaataatttgggggttaccccaattataaattttattccaccttggggggggaaattttttttatgaattggaactcccaaaaaaaataaccctgtttccccaaggnnnnnnnnnnnnnnnnnnnnnnnnnnnggnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnccnnnnnnnnnnnnnnnnnnnnnnnnnnnnnnttttaggggctttctnnnnnnnnnnnnnnnnnnnnnncttttnnnnnnnnnnnnnnnnnnnnnnnnnnnnnnnnnnnnnnnnnnnnnnnnnnnnnnnnncctttatattcagtttt

SEQ ID NO: 6386 - DNA, 222 bp, Diabrotica virgifera
  misc_feature (2)..(35): n is a, c, g, or t
  misc_feature (115)..(133): n is a, c, g, or t
annnnnnnnnnnnnnnnnnnnnnnnnnnnnnnnnncagacagctgctgacaaagctgcattcatgggtcctctcaagaaagatagagttaaggaagaagagaatgctgctgctcnnnnnnnnnnnnnnnnnnnttaaagtgttaatgtttgtattgtttgacaataaacagatatatagcttctcaaacgaataatttgaatgaatatctttgggggggggc

SEQ ID NO: 6387 - DNA, 220 bp, Diabrotica virgifera
  misc_feature (192)..(213): n is a, c, g, or t
cacaatctcattatagctacaatctccaccaacaacaaattccacagtccatggaacaacctggatggtggaaccaacaaaatggatggtggaaccaacaatacaaccagaatatgattccacaaggacatcaatatgctgctgtgggtcatcatatggctttagtgcattaaaaattaaaacgttataacnnnnnnnnnnnnnnnnnnnnnncattttc

SEQ ID NO: 6388 - DNA, 319 bp, Diabrotica virgifera
  misc_feature (146)..(146): n is a, c, g, or t
  misc_feature (258)..(258): n is a, c, g, or t
gccctttgtgaaaggatctgtgtttttacggtcagacctcccgcatatctattcacaagtttcatgcaaaatcttagttttagttcggtagcctagcagtgtattaatactagagtgtacgtgtgttaagtgacgagtgttttgtntgctgtaattattttgaatattggtttagtatttcgtttggagagtgtcaagtgttgattattgtaatttaattaatgtgaatagtgatgtggcgcccgtgggataatgtanatatcgcgtacgataacgctgatattgtaaaaattgccagtgctagtgtgaatgtaattac

SEQ ID NO: 6389 - DNA, 202 bp, Diabrotica virgifera
  misc_feature (132)..(132): n is a, c, g, or t
atatatgataaaaatacaggtaaaatgctatttaaatgaatatattataatcttattaattcatatatttatttaattacgttaaataaatgtcacgaattcttaaaaaaggggggaaacgtggtattaatntagaaaaaaattacggaagtaataatatcaaagactagtaccgtgctaaaaccggtgcaaccttagtgtg

SEQ ID NO: 6390 - DNA, 482 bp, Diabrotica virgifera
  misc_feature (251)..(273): n is a, c, g, or t
gtgaaagtggtctctagaaataaaaaaaaccgcgactggttagttacatgacgggtttccattcaagtgttgtgtgtttattgacttctttctttaaatacatacaacaacaacggtgataattcctgtaattattattcaagtgtatttataattgtgagcgatcaaaagtgtaaaaataaaacgtcggtagtggattgcgtctaataggaggcatcgttttttcggtaatcatttctatatttttgcgnnnnnnnnnnnnnnnnnnnnnnncaaggacgcatttaagtggtgctgattatgtctgtcgtgaaaatataaaatagtaatgcggttaatttgatatcaagggagcgtccagcgatgaatggaaccattatcagtcgaaaattaacgtgatacggtgcacatctagttttcccgcgtgacaaatgaaattttcgaggtttttctcttaaatggcggacaccgagaacgaggaa

SEQ ID NO: 6391 - DNA, 222 bp, Diabrotica virgifera
  misc_feature (4)..(37): n is a, c, g, or t
  misc_feature (128)..(152): n is a, c, g, or t
  misc_feature (178)..(197): n is a, c, g, or t
ctcnnnnnnnnnnnnnnnnnnnnnnnnnnnnnnnnnntataactattttgtaactgggcaggtaaataaatcctatctagtactaaacctgcctattatttcgattaagaacgagaatatgatgttannnnnnnnnnnnnnnnnnnnnnnnngcatagtttatatacaatatacaatnnnnnnnnnnnnnnnnnnnnaaacacaattacatataataataat

SEQ ID NO: 6392 - DNA, 300 bp, Diabrotica virgifera
  misc_feature (23)..(23): n is a, c, g, or t
actctttccgagggcggcactanaatgcatgggggggttctcatttcccccattcttctctgtttaaccataaacctggagagatttctctttcctctagttctttctcaattccctccctccagcttcttctcggccttcctctttttcttctcccttgtgggggccatgccaaaatctgcttatggatcctgtcatctggcattctctgtacatggccataccggactagttggtttgtttttatgtcatcaattattgattgcgtgacttccatcatttttcggattctctcatttg

SEQ ID NO: 6393 - DNA, 223 bp, Diabrotica virgifera
  misc_feature (15)..(59): n is a, c, g, or t
  misc_feature (84)..(109): n is a, c, g, or t
  misc_feature (127)..(145): n is a, c, g, or t
attcggcagagctcnnnnnnnnnnnnnnnnnnnnnnnnnnnnnnnnnnnnnnnnnnnnnccttaaaaacccaaccggggggacnnnnnnnnnnnnnnnnnnnnnnnnnncccccgggggcctttaannnnnnnnnnnnnnnnnnnccggaccaggggccaaaaaggttaaccggaaaaaactttaaaaaaaggccccaggggttaaaattcccaaggcccccc

SEQ ID NO: 6394 - DNA, 330 bp, Diabrotica virgifera
  misc_feature (300)..(300): n is a, c, g, or t
cggaccaaaaatatttatttccgggggtgcttttaataaccatcggggactaaaaaggcaacagtatttggaagccaaattatgtattaaatagccacacaaatatttttgggactgtaattgaggaatccatctttatgatgaactcagatatgatgacaccagaactaatcttcactgaggatattaacacaattataccatctagataacaaaaaagtccaaatattaatgaggacttaatatggttcacttcactgatggatttatagctgcccatggtattggatcaagagtctnttggataacagcgtactataataaaaatta

SEQ ID NO: 6395 - DNA, 97 bp, Diabrotica virgifera
  misc_feature (71)..(88): n is a, c, g, or t
cacagttagtgtccatcacaggctgtggagatctttaaaataataattgtgtatttgatatttttgttggnnnnnnnnnnnnnnnnnnaactgctac

SEQ ID NO: 6396 - DNA, 239 bp, Diabrotica virgifera
  misc_feature (77)..(114): n is a, c, g, or t
  misc_feature (120)..(141): n is a, c, g, or t
  misc_feature (169)..(186): n is a, c, g, or t
  misc_feature (193)..(219): n is a, c, g, or t
tgctgccctcattgtagccacaagtgccaatctaggtgccttcgaaaaatggactagttttaaggccacccataacnnnnnnnnnnnnnnnnnnnnnnnnnnnnnnnnnnnnnntgtttnnnnnnnnnnnnnnnnnnnnnncgaggaacacaatgctaaatacgaaagnnnnnnnnnnnnnnnnnntttggcnnnnnnnnnnnnnnnnnnnnnnnnnnncgctgaattccaagctatgt

SEQ ID NO: 6397 - DNA, 131 bp, Diabrotica virgifera
  misc_feature (99)..(124): n is a, c, g, or t
gaaggctccagccaaggccgcaggaaagaaataaacggactgctacggtttttgcgtattgttaagttttatgcactttgactgtggtaatccgagttnnnnnnnnnnnnnnnnnnnnnnnnnngatatac

SEQ ID NO: 6398 - DNA, 131 bp, Diabrotica virgifera; identical to SEQ ID NO: 6397
  misc_feature (99)..(124): n is a, c, g, or t

SEQ ID NO: 6399 - DNA, 308 bp, Diabrotica virgifera
gggacgagcgcgggacgcacgtgcccaatacgggacgagtttggagtgtagtgtaccaactagtatcatgtattcaaggttagacatttcgaatttttctcttgaaacgcattttataacacatacaaacgtacaattttttgcctgaattccactgtgtttgaagtaaagaacatgaaataaatcaatttaatttagaatgtatatctatagtctatagtatgggcactgaaacattttataaatatacgtacaccttcaaatagaagtgctaccaagacagtataccaacaaattgtcaacatact

SEQ ID NO: 6400 - DNA, 167 bp, Diabrotica virgifera
gaactcttaccctaaattgtaaatgatttaatgcgaatgaaacaccaaatagaattcataaataaagataaatcaacaactagccaagcaaaaagaactcactgggatgctcgacaaaataaactaaactatgtcaatccgcgggggggggggggtctcggcccccc

SEQ ID NO: 6401 - DNA, 194 bp, Diabrotica virgifera
atacaatcaaacgcaaacgtcgtgtgattgtgaaggaaaacattttcagatttaattatttatttccacttttaatcaaagtatttcggaaaaactgtaatatatttgagattaaaatggcaggaataaaagcattggttaccttagcctttcttggttctattggtatgacgtttgtgattttggcatgtgct

SEQ ID NO: 6402 - DNA, 262 bp, Diabrotica virgifera
  misc_feature (109)..(128): n is a, c, g, or t
  misc_feature (130)..(142): n is a, c, g, or t
  misc_feature (191)..(191): n is a, c, g, or t
  misc_feature (211)..(231): n is a, c, g, or t
  misc_feature (237)..(237): n is a, c, g, or t
  misc_feature (249)..(249): n is a, c, g, or t
aaaaagccgccttgctttgtgttgaaatatttctgtagacgatttatcccatatacctattgtgatgtttatatgatacaattctccaaaaacgatcgaatcaaaagcnnnnnnnnnnnnnnnnnnnngnnnnnnnnnnnnncattggatgtattatatttatactagagacatgtcatgtaagaattgtnttatgaacgtttttgttacnnnnnnnnnnnnnnnnnnnnncagtanaaagttagtttnttatgaaaatatg

SEQ ID NO: 6403 - DNA, 85 bp, Diabrotica virgifera
gtctggatcatcaacaactttaacatcacttgagctgacttctttggtagctaaaacagctacaaagacagctgccaaaagaaag

SEQ ID NO: 6404 - DNA, 173 bp, Diabrotica virgifera
  misc_feature (47)..(93): n is a, c, g, or t
gcaccatagacagatgcaccctcaacagctgcaccatacacttatgnnnnnnnnnnnnnnnnnnnnnnnnnnnnnnnnnnnnnnnnnnnnnnnagaatatattttcctccagctttgtaacgatagaatactataaaatcgtatccattatttactagaagaaaaataaaaag

SEQ ID NO: 6405 - DNA, 291 bp, Diabrotica virgifera
gttctctctacatagtttcccagtaccttttagagatgatacgtcgatgtttaattgtcgatccccgtaaagattttagtctcattcggtcacgatctcatgtacgtcccatatcgtgtaattataaagccatcttcgccgctgtatgcgtatctcgagtatcctgtctgtgttccgagactatcacatcatcgggcggactgagttgaagtcgatcagcagcggcatcagtatcatgatctgttgtggatcatgttctgcttgcagaacaatcagcactgttatctactc

SEQ ID NO: 6406 - DNA, 332 bp, Diabrotica virgifera
  misc_feature (223)..(223): n is a, c, g, or t
ggcactagtttgttatgtaaagccattttcttcttcaaaaccaaaatgtattcaactgtattcaaaatgttattattggttgcagtattaatattggttactatttcaccatccaatgcagataattataataaatgtcctgagaccagttatcaacgatccctggtttaccagaatgcattagagggggaatttatttatgtacgcattccacgcagaggtntctttaatgctccaatcaattgtcttctggtgaccgatattaatgaaagttttagtacaccagttatagaagatggtggatatgaaaatgagtatgtagttatacgtat

SEQ ID NO: 6407 - DNA, 168 bp, Diabrotica virgifera
attttactttcaattactagataacagtaaataaaacacaagtacatactaaaaaaataataatactagactacctattggaagaatataaacaatttaattttgcttgttgattattatttgttttttataattggtaggggagcccaagcggggatttttgcagtt

SEQ ID NO: 6408 - DNA, 123 bp, Diabrotica virgifera
  misc_feature (17)..(17): n is a, c, g, or t
ggcacaaagaagctctntctatacttttgttcttctccttctaataataaattacctccccctaaccttggaaattacggacattcgttaattgttcaaagtccttaacccatccgaaaaatt

SEQ ID NO: 6409 - DNA, 150 bp, Diabrotica virgifera
tgattactgcgcgactggtgccgatttcggctcgagacaaaatgacccactcttaacgttaccgccgaagaaccaaggattcttttgccccccagttttaatttcgttgttttggtcctccttccccttctttgaaaattcacctagttg

SEQ ID NO: 6410 - DNA, 74 bp, Diabrotica virgifera
ctaagcccttatccaccacacttactcgaatccgaaaagaacgaacatccacttaatccaaatgcctttccaac

SEQ ID NO: 6411 - DNA, 57 bp, Diabrotica virgifera
ttgaataatatttatgttcaacctaattttaacaaaataaaaacctatcccttaaga

SEQ ID NO: 6412 - DNA, 144 bp, Diabrotica virgifera
aaaacttgagatatggaattgggtgtaaaagtatctccaatttccacctctaatcttaaccttaataaaacctccatacctccagaattgtttgttaacctgtccactaatataataacacttattcctatgaatattttattc

SEQ ID NO: 6413 - DNA, 125 bp, Diabrotica virgifera
  misc_feature (53)..(70): n is a, c, g, or t
tacgaattgctcataggggtgcattttttattaaaatgtcgagtactgtgatnnnnnnnnnnnnnnnnnncaatcttatcgatttggtatctttatacctaaatagatatttaattaacaataat

SEQ ID NO: 6414 - DNA, 326 bp, Diabrotica virgifera
  misc_feature (84)..(84): n is a, c, g, or t
  misc_feature (146)..(146): n is a, c, g, or t
  misc_feature (222)..(239): n is a, c, g, or t
  misc_feature (241)..(255): n is a, c, g, or t
ctcaattgttgctcttgctcttaatacttttctaatacaccgtgcagactgataggcagtactgttccttctgccttctaccanaggcatgcataggcgacttattctcacagcataagcgttctatgtaaacaagaatatgcatngtaatgtagttttatacgtccaccatcacttttatggtattgcgcatgatttgaattttttaacaaagtatgatannnnnnnnnnnnnnnnnncnnnnnnnnnnnnnnncattttgggcctgcaatgccccgttagggctgatgcccctaggcaactgcctacttcacttataggttaat

SEQ ID NO: 6415 - DNA, 202 bp, Diabrotica virgifera
  misc_feature (116)..(118): n is a, c, g, or t
  misc_feature (120)..(120): n is a, c, g, or t
  misc_feature (164)..(164): n is a, c, g, or t
  misc_feature (167)..(167): n is a, c, g, or t
gtaccgtgctgtcattgttgacagttgtaaatcctccgaacatttttttataaagttgataatatattttgtggaattatgtataaataatattaaatgcggctaccactcccaannnanaataaaaactaaaaactaaaacaaaaactcaaaaaaaaacaaanaanatttgtaattatttttactaacaaaaaaacaatcc

SEQ ID NO: 6416 - DNA, 900 bp, Diabrotica virgifera
  misc_feature (205)..(224): n is a, c, g, or t
  misc_feature (470)..(507): n is a, c, g, or t
  misc_feature (514)..(560): n is a, c, g, or t
  misc_feature (569)..(586): n is a, c, g, or t
  misc_feature (684)..(715): n is a, c, g, or t
  misc_feature (795)..(831): n is a, c, g, or t
aaagatggtttcattctgtatcaaatcgccatttcataagagttataaatagattgagatgtaatcacgctcttactccccttcatatgttcaatttgggtctcacagagtcacctaactgtgagtgtggaaaagaaggtgatctactacatattctcctcaaatgttcccatcaatcagtaaatataaacaaattttatgatannnnnnnnnnnnnnnnnnnnccacttcttgtctacctgaacaacttgattgtttctgaagatattaatacattaaaagcaatttacgaacatatcaaaaactgtaaatataaaatgtagcaatataattaaccttctatttaagtaattttgttaaaacaaaacaggcatgtttttaaaacaaaacaaacatgtttgttttgttgttattctttaaccctgtagatttaagtaattattgtatattataattgaaaaaaagagaannnnnnnnnnnnnnnnnnnnnnnnnnnnnnnnnnnnnnggataannnnnnnnnnnnnnnnnnnnnnnnnnnnnnnnnnnnnnnnnnnnnnnaagtaaatnnnnnnnnnnnnnnnnnnatccaaaacagtgtatttttttagatagtagtatgttacatagtttgttatgtacatatatttagagttagaaatacagaaaaaattcctctgattgnnnnnnnnnnnnnnnnnnnnnnnnnnnnnnnnctggctaattggttcagccaaggccatcaaattcacataaaaagatctgaaattttcagagagtattcttgaaattatgnnnnnnnnnnnnnnnnnnnnnnnnnnnnnnnnnnnnncaaacaatgccccccttaaacagatcggtgcaggtcgaccttataatcggctcctctactatattaaaa

SEQ ID NO: 6417 - DNA, 779 bp, Diabrotica virgifera
ctaaaaccgcacatacacgtacgccaaacagttgggtgaacacgtaattaacgatatgtgtaatggaaaaattcctactctaatagtacgtccttctattgttactagtgccaaagatgaaccttttcctggctggaataccaactttaacggacctgttggaatgaacgtagcgggaggcaaaggtttacttcgaactgtatatggatacaaggatgctgttatcgatatggtgcctgttgattataatataaaagctatcattatagcaactgatgattataatcaaagaaactctctagaattacaggtatacagtttggcacagaatgatgtcttaggcatgaaacaaggcgaaatactggacttaggaaaaagacttttagatgattatccatttttaaacatattatggtacccttcattcactatgacagattgctggtatcaatattatttcagtgtattactgttccacattttaccggcagtgttctttgatgtactcttgaggataggtaaacaaaaaccaatgatcgttaaactgcagcgcaagatttatatagctaatatggtagtagcgccatttatgaaaaactcataccaaattcccaataacaaaatactacaggccataaaaaatgtaaaagacgaagattcggcattcacacttgatgttatttatcttaatcatgaaacacaatatgaatactcttgtaactgtagaataggattaacgaggtgattgttgaaaagacgagaagatatcgattttgaaa

SEQ ID NO: 6418 - DNA, 785 bp, Diabrotica virgifera
cccacgcgtccgaaacaaaaatgtaatttggagacactattataacatcagttaatctcattttattgtagataaaaatggctgaagcagtaaaaccaggggcacagccccttgtgaagattggccactacgtgttgggggccaccctaggtgtaggcactttcggtaaagtaaagattggcgaacaccaacttacaggtcacaaagtcgcagtgaagattttaaacagacaaaagataaaaagtttggatgttgtgggcaaaattagaagagagattcaaaaccttaaattattcaggcatccacacattattaaattataccaagtaattagtacacctacagatatttttatgattatggaatatgtgtctggaggagaactattcgattatattgttaaacatggaaagttgcaggaacatgaagcgagaaggttttttcaacaaattatttcaggtgttgactattgccatagacatatgatcgtacatcgtgatctaaaaccagaaaatctactgttagatcacaacatgcatgtcaaaatagctgactttggtctatcaaatatgatgatggatggagaattcctaagaaccagttgtggatcacccaattatgcagctcctgaggttatatcagggaaattgtatgctggcccagaagtagatatatggtcctgtggagtcattttatatgccctcctatgtggcactctacccttcgatgatgagcatgtacctacactattcagaaagatcaaatcaggcatatttcctatttcc

SEQ ID NO: 6419 - DNA, 206 bp, Diabrotica virgifera
  misc_feature (12)..(33): n is a, c, g, or t
cctcctccggcnnnnnnnnnnnnnnnnnnnnnncaggtgaacctggaaaccaaaatgcgtgcttctgaacaagagacttcaagttcgtcgcagtcatggagtgaacacgatggatatcaggactcgatttactcatggatgccgacatcgctcgaacccctagtaacacccttaactagttgattgtcgtctatctccaaaggagt

SEQ ID NO: 6420 - DNA, 958 bp, Diabrotica virgifera
  misc_feature (866)..(866): n is a, c, g, or t
  misc_feature (895)..(895): n is a, c, g, or t
  misc_feature (940)..(940): n is a, c, g, or t
attacaacaggaaacttgttccaattctgcaaggcagaatgaaaaagctcaaaatgaagcaagctccgattcagaaataaatgaagacagtcctaaagtgtctaaaaaacgaaagaaaaaacataaaaagagtgacaaaaacaagaagtcaggaattgtaaaacataatatacttgagaatgaaatatttaaaatcgaaacgaaaggtgcaagagaactgatttctgttaacacaatttcacgaccatcagcacctatttaccaggtaaagtttttccttggcaacacaaattataaaaaatgtaagtcaaaaaataaattcaaacgctactacaaacatctatctcatgagccagaagtaaaagaagacataataactcagaaaaatgtgaaccaaataggatttgcacctagagacgaacatttcacaggcttcaaacaagaacaagagctaagtgaaaagacaggattttttaacagttatttaactgggaaaccagaagatataaatgtgtggctagaatatataaactttcaagatacagtgcatcaatttgaaaagagttataggaaagggagtatagctaaagctcagagagttttaggagaaagaaagctgtctatattagataaagctttgatatcaaatcctaatagtgagaaacttcacagggaaaggttaaatatagctgttgtaacatttccttctgatgaattacagatatacctgagggatttagtcgagaaagataaaagtaatatcatcctatggcaaggatatatagaagccacacaatgctcaatgtcccattgtagcacaccagaaagtataagtttatatacaaagtgtctctcaactttacatncactgaggcgaacgaatatcatggaacgncatttattagaagaatgtatattgaagatgctgtatcagtgcggnttatttttgaagcaagca

SEQ ID NO: 6421 - DNA, 712 bp, Diabrotica virgifera
  misc_feature (47)..(69): n is a, c, g, or t
  misc_feature (126)..(158): n is a, c, g, or t
tttaagggcgattaagcaagttaaatactgttttatttatttcctgnnnnnnnnnnnnnnnnnnnnnnncttgagaattatggccccaaccacagcacctgtgaaaaagcaaagttggagcgaagnnnnnnnnnnnnnnnnnnnnnnnnnnnnnnnnnggaaagagcaaaatttagtcaagaagctagaaaagaaaaaacgcaaagaagcagtggataataaattaaaagagtcaaatgtaactgtaggtaatatttcgacgctttcaatagcggtaccaggttcgatattagaaaacgctcagtcccaagaattacgaacatatctagctggtcaaattgctagagcagcttgtatatttcaagtagacgaaataattgtttttgatgattatggagacgaggcttctgcaaagaaatctaatttagatagtgatgctggtaatgtaacagctagacattcctgtatacagctgggaagaatactgcaatatttggagtgtccacagtatctaaggaaacacttttttcccatacataatgatttgaaattttgtggactgttgaatcctttaaatgcgcctcatcatttgggacctaaagaggaatttttgtttagggagggcgttgttctaaataagcctgccaaaagtggttcatttgttaatgttggtctattgaaggaagcccatgttgataagttactcactcct

SEQ ID NO: 6422 - DNA, 777 bp, Diabrotica virgifera
  misc_feature (10)..(37): n is a, c, g, or t
  misc_feature (199)..(776): n is a, c, g, or t
ttaaaggcgnnnnnnnnnnnnnnnnnnnnnnnnnnnncccacccgtccgccatgttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 6423 - DNA, 704 bp, Diabrotica virgifera
  misc_feature (525)..(525): n is a, c, g, or t
  misc_feature (557)..(557): n is a, c, g, or t
  misc_feature (564)..(564): n is a, c, g, or t
  misc_feature (589)..(589): n is a, c, g, or t
  misc_feature (626)..(626): n is a, c, g, or t
  misc_feature (646)..(646): n is a, c, g, or t
  misc_feature (677)..(677): n is a, c, g, or t
tagagttcctctagctccctgtttgttcgtcacacccatggatctttttgtcaaatacctctgttcacttcaaattcatccgatgagaatctcctctccatactccataatttcgtgtgcaattcagtaatttactaatctaaccagttatgctggtatgcccaaggagctcagtgctttttgtgtcatatgctctttttaaatctatgaacaacgcatgaatggttagagggttaccttatgtttatagcaggtattctggattccttttaatgtaaaaactcattgtcattgatctattgactctacaaccggcctctgatattcaccttagttatcttcagcaagtatgttcagtctctctattagcatcctggctaataccacagaataccccaaccaactgggttggttagggtactctgtgctaatatcttgtaataagtatcaaacagagtatcaacatcctgtaattttcacatgccaatatatccccctttttgtatatggggtatattaaagctntggtccaatctttagtcatattttcttcttcncatattntcttgataaggctacgcactatatntgttcttctgctcctccatatattcttagaatctctncgtcgatgtgttaagcattnttggctccatctgttgtgcttgcgcatacanaataaatctcttacagtatgtttatct

SEQ ID NO: 6424 - DNA, 813 bp, Diabrotica virgifera
  misc_feature (707)..(724): n is a, c, g, or t
  misc_feature (782)..(811): n is a, c, g, or t
aaagtcgcttaccaagaagcagaaaaaagggtatggatggcagaacagaaagcagaagcttacaaaaagaaacaagaagaactccgtcagcagtatgaaaaagaacaggatttacatgataacaaagctatgctcagcaaggaaagtaaagacaaattgagcattagttttatgtacgaacctcctcctggagcaagaaaggaaagggagagagaggataatgagcccgaatacaaatttgaatggcaaagaaagtataatgctcctagggagagttattgtaaaggagatcaagaaattcgagatcagccgtttggaattcaagtgagaaatgtgagatgtattaaatgtcacaagtggggccatatcaatacagataaggaatgtccaatgtacagcctctccatgagtgcagccagatctttagaaaatgccacagtaatggaccaaaagtctctggagcaacagatgttggatgatggattggctttaaaaaaacaacatgttaatactgtagaaactaacaagcatcttttagttagtgaagatgaagatgccaatgaagaaaccccatttttaaagtcgctttaccaagaagcacaaaaaaagctttaattggagaaagttaaaaaaaacttggaaaagcagccccgaaaagaaaaagatagccccaatgcgaccggaagggacgaatcctccgaatgacnnnnnnnnnnnnnnnnnnccttccaaaaaggaaaaggggccccccagagggaaccgggtatccgataccggaaggnnnnnnnnnnnnnnnnnnnnnnnnnnnnnntc

SEQ ID NO: 6425 - DNA, 133 bp, Diabrotica virgifera
tgtggattggtagtcacgaatccccatctgttatttttccctataatcctttccggatgatattcagaccagtttaccgtcctccaatcatcaagaagaggacaaagaagctcatctggcatcccaccgatag

SEQ ID NO: 6426 - DNA, 542 bp, Diabrotica virgifera
cggccttctttttgagggccgggacaaagaagggccaatattactcggcggtttttttcgcgcacagctatatttagcctggcttctaactcattattttactgcacttcatttgcaagcctactgtttttttaacttcatttaattgttgtaacatttcatttagctcttggatattatcttctattaaaactatgtcatctgcacatcctcaaatggcttacggatgatcctgctgtatctctggtacacatagcgaggtagggatatcatcttcactgaatctctcgatcaccttatgcatatgggtgcttatatatgcaactctcgttagatactctttataacgagcgtattagagtcccattctggcatgcagttctcacaaaataactgcaaatatttctcctattattcttataacgaaatcactatattgtgaaacactcttatgagggtgaatacattgtctgcattacgtagaaaagtttgatataaataatattcttgttctttatatatatgcagcccgaaaggacctg

SEQ ID NO: 6427 - DNA, 811 bp, Diabrotica virgifera
  misc_feature (16)..(16): n is a, c, g, or t
  misc_feature (19)..(19): n is a, c, g, or t
  misc_feature (28)..(28): n is a, c, g, or t
  misc_feature (41)..(41): n is a, c, g, or t
  misc_feature (69)..(81): n is a, c, g, or t
  misc_feature (83)..(104): n is a, c, g, or t
  misc_feature (397)..(418): n is a, c, g, or t
tccataaaaccgaagntgnattactagntaatctgaacgtntgccctaattttgtttcatttgtggtgnnnnnnnnnnnnncnnnnnnnnnnnnnnnnnnnnnngtatctcagtccatgttgcccaagccggagtccaaataggtaatgccgccaataactacgctagaggtcactatacaattggtaaagaaatagttgacttggtattggacagaatccgtaaattggctgatcaatgtactggacttcaaggtttcttgatcttccactccttcggtggtggtactggatctggtttcacttctttgttgatggaacgtctatctgttgactatggtaaaaaatcaaaactggaattcgccatctacccagctcctcaagtatctactgctgtnnnnnnnnnnnnnnnnnnnnnnttgaccacccacaccactcttgaacactcagactgtgcctttatggtagataatgaagccatctatgacatctgcagacgtaatctcgacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttctgtagctgaaatcaccaatgcctgtttcgaacctgccaaccagatggtaaaatgcgatcccagacatggtaaatacattggcttgctgtatgttgta

SEQ ID NO: 6428 - DNA, 65 bp, Diabrotica virgifera
ccccgaaattcgaaacaggtaaatactatgtaaccatccttgatgtccgctggaatcaaaaattt

SEQ ID NO: 6429 - DNA, 492 bp, Diabrotica virgifera
aaatagtactagagcgagtacgagacgatctagaggattcttcctaactacctcgtggatgcgacttcttaacatcttcaataaagcacacgaacgctgttcactggacggatccttcattcgaaatgatggcaagagcctggccttgccatatgaataatcttgacttcaatcctgctgttctcatcctgaaaatcataacgaaaaagtccacaccgaacactcttaccttatactacataccctgaatgcaaaatgggacgccccctgacatgatcttcatttttgggtaggtgctgagactaaccaggatgagcaacgatccacttgccatatatactagctcaccggtccttaccatttcatcccataatctctccaacctcgcgaaagctttcaccgccaatctcaactgctcttatcctacttcaggagcggagttattcgataacttcctggtcgagctaaatctggttaccacgatgtcgatcc

SEQ ID NO: 6430 - DNA, 1267 bp, Diabrotica virgifera
  misc_feature (1058)..(1113): n is a, c, g, or t
  misc_feature (1128)..(1148): n is a, c, g, or t
  misc_feature (1189)..(1210): n is a, c, g, or t
gtcttttcttagcttctggagaatagttatgttagttgtttggtgtatacagagaagggctaaattatggaataaattggttttctctggaatggacgactttggaggggaatcccgagacaggtcgattttgatttttaaattgcaattttttggcatatatttcatgctggtgacgtcgttcatctgggcgtggtgacgtgatcgatgattttttttaaatgggaataggtgccgtgtggcgcctcatttgagggggtgttcagttctctattcagtgatataaacattaatatcattgtttatacagggtggccaaaggatagatttttgaattgaattaattgacgagggaagaggagtgtatgcgatttatttaacttaaaatacattctatcactttcagggaatgggaaatagtgtttgtttggcaaataaacattgcttttcgcttggattaaatgttcaaactgccaagtggtaggtgggaggctgtttgtgatttaatttgagcgaagagagatgtttatttgtgaaatgggcatttttttctatttactgacagcaatacaatgtatttttagttaaatgggttgcatacattcttctttttgcgtcaattaatttggttcaaagattatttttttggtcgccctctatgaatggtgatattatttatattgctgagtggagggttgggcaccgtttccagtgaggtgccgcacggcccctgttcccatttggaaaaatcattgattgcgtcatcgcgcccaggtggatgacgtcactagtattgagatgggtgcaggagaattgaattttgaaaataggaaaccgacctgtttcccgattttttctcccgggtggcccttttaaaatggaattaatttttttccctttatatgaaaaccttaaaatttggctgggaagcgcccccatttcaaatacttccaaatcgttttatgggattcttccggaaaactttcaactttccacctccctaaagggaggaaccttaaaaactaaccttctaaaaattttttttccgtatttttatnnnnnnnnnnnnnnnnnnnnnnnnnnnnnnnnnnnnnnnnnnnnnnnnnnnnnnnnggtttttttcaaaannnnnnnnnnnnnnnnnnnnngattattattcccccacaatctctctttaaatttttcgcgnnnnnnnnnnnnnnnnnnnnnnctcccctcccctctctctttcacaacggggggggaacctaacaatatttttgtaata

SEQ ID NO: 6431 - DNA, 648 bp, Diabrotica virgifera
  misc_feature (23)..(40): n is a, c, g, or t
  misc_feature (202)..(220): n is a, c, g, or t
  misc_feature (624)..(641): n is a, c, g, or t
ctgacagaatgtaaattattatnnnnnnnnnnnnnnnnnnctagtttgtcagtttattaacaattcaggaaaacatgttatcagtatagtgaattcaaaccacaagtagggcaaactattaggctatggacgggggaccatcggattttccatttgaagaacagcctacaggaaaaagatgggatcctctaggagccccgannnnnnnnnnnnnnnnnnnggatttaaagaagtttggcgatgactgtggccttaatgatcaggaggttttggaaaaaattcggacattagaagaagaacaggagctactaaattcatccctatttgctttaacaacccactttgcccaggttcagtttcgtctacgtcaagttgttaatgctccttcagaagataaagaggaactgctaaaatctctggaagaatttgcttttcgtggcattcctgatgttggccacgttcaagaacacatcgatgaagccagcttagctgacgctgtgcgtttaagaagaagccaacaaaaagaactgattgataaacttaaatcccagttaagagaattagaacagtatgcatttgaaaacggtgaagctggaatacctcaggatatggttcttgaaaggnnnnnnnnnnnnnnnnnngaattaa

SEQ ID NO: 6432 - DNA, 1172 bp, Diabrotica virgifera
  misc_feature (49)..(87): n is a, c, g, or t
  misc_feature (89)..(160): n is a, c, g, or t
  misc_feature (239)..(265): n is a, c, g, or t
  misc_feature (272)..(285): n is a, c, g, or t
  misc_feature (287)..(323): n is a, c, g, or t
  misc_feature (362)..(386): n is a, c, g, or t
  misc_feature (395)..(431): n is a, c, g, or t
  misc_feature (473)..(485): n is a, c, g, or t
  misc_feature (487)..(504): n is a, c, g, or t
  misc_feature (540)..(558): n is a, c, g, or t
  misc_feature (766)..(800): n is a, c, g, or t
  misc_feature (807)..(871): n is a, c, g, or t
ctgaatttcatattttacaatatgttattatctatttctatatcttatnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnattgataccggcatcctgcaccattcttttcacctgattattaaaaacatgcctttttgtattacatataaagcctctnnnnnnnnnnnnnnnnnnnnnnnnnnncgcgggnnnnnnnnnnnnnncnnnnnnnnnnnnnnnnnnnnnnnnnnnnnnnnnnnnngatgcaggggtggatgaaaacaacactgtctatatttgnnnnnnnnnnnnnnnnnnnnnnnnnacaaaaagnnnnnnnnnnnnnnnnnnnnnnnnnnnnnnnnnnnnnatttatgaaattattgataccgttttttgatatttcattccnnnnnnnnnnnnncnnnnnnnnnnnnnnnnnnctaaaaacaaattcaactttttttacatcattatcnnnnnnnnnnnnnnnnnnnccccaaccttttttgattataacaataaatttaccctcaaaggataacaggcgtaatttttattggagagttcctatccataataaagattgcgacctcccagagggaatttaggttatgattggtgtagcagatatattttttcctctgttcggatttttaaaatttaaatgatgtgggtttcaaccccccgagaccccaccccccnnnnnnnnnnnnnnnnnnnnnnnnnnnnnnnnnnncaaaggnnnnnnnnnnnnnnnnnnnnnnnnnnnnnnnnnnnnnnnnnnnnnnnnnnnnnnnnnnnnnnnnncgcggcccccccttaaaggaacccccacttaaccaaccctgtggatgcgaaccaaaaacctccttctatagcggtcccctaaaattctcctttctcctcccccccctctaacaacaccccccaacgggggaaacccaggcgggtccccactttcccccccctccggcacaccccctcttctcccccgtctgccccacaaaccaaaaaaacgccccccccccactccccttttccccaaacccttttctcgccacctcaaaagctgaaaatgtgctgccgcccccccccccacgcctccacg

SEQ ID NO: 6433 - DNA, 76 bp, Diabrotica virgifera
aaaagggggccgttcaaaaggatccaggttaacgaccccgggctggcaacgccttactcctccaatagggccccca

SEQ ID NO: 6434 - DNA, 859 bp, Diabrotica virgifera
ggtccatgggttgaagataatgatgacctagataaaaatcttaaatctaaatattccaacctatgtgatctttgtggacctgaaaaatgcaacgtcaactacaagactccattcaacgattccttgaattgccttgaatctggtggagatgtagccgtcacaagcctttccagagccttagtatttctaaacaaaagtaccaatgctgataggtaccaatatctttgtcctaatggcactattagcacgaccattccttgcgtatggaccaaacaactgaatagactgatcgtaacaggaaggactagagtcaatgaagtctcggactacctgaagaaaaacttaccagctaacaccgcatttgcatctcaaagtttaggaatgctccctataaaagactctctactagaacttcttaaaatgaagtccactgataaaattaattatcttcctgacacttcactttccaagcatgtagcaggtatcagatctatcccatcactttcgaataacactcgttgtaaagaagtagttaactggtgcacattgaatgacaaagaacagcaaaaatgtaaatggttcgcacaagctgccttaaacgttggtcttgaacctgtcgtagattgcaaacaaagttcggataacgatacggtgtcttgcttaattgatctacaaaacaataaatctgatgtgatgtattccgacgttacttatggatatattgctctcaagaaaggcttgcaacctatcgcttatccagaaaccttcaagactaatatttcttacgtagtaatagctgtgaagaacgcacaagcattaagaagttaaatgatctccaaggaaagcatcttgtttccct

SEQ ID NO: 6435 - DNA, 567 bp, Diabrotica virgifera
gcatggaacgtttcgtagtctgacgttcgaaatttttaagctgttccacagttggaacttcccctgttccagtgttcccatatatcaaggtttgtccgactagacaccgttaggctattaacaaattttcagctgacatttattaatcaaattttttttggtacgcgggatccaggatccaggtctaatatgcaaaatgaacatttatgggtctaggacgtttcatcgccgcccgccgtttcgatgccgccagttcgatgccgatgccggccgattcatcgccagtcaattaatcgctatctgatatatttccgaattttcgacagttacaattattagttatttttagtattaattaggaattctagaaaatgcgagatatgacggcgatgaaatggactggcgatgaaccggcggcatcgaaacggacggcgatgaaccggcggcatcgaaacgtcccattccgagcatttataacttgatcttaccatattattactttatacactgttactaataaacctagtataaaagttatattgagaataactaacgtacaagcaaaat

SEQ ID NO: 6436 - DNA, 211 bp, Diabrotica virgifera
  misc_feature (8)..(66): n is a, c, g, or t
  misc_feature (69)..(133): n is a, c, g, or t
  misc_feature (137)..(200): n is a, c, g, or t
attattannnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnggannnnnnnnnnnnnnnnnnnnnnnnnnnnnnnnnnnnnnnnnnnnnnnnnnnnnnnnnnnnnnnncatttttttac

SEQ ID NO: 6437 - DNA, 839 bp, Diabrotica virgifera
  misc_feature (382)..(398): n is a, c, g, or t
  misc_feature (820)..(838): n is a, c, g, or t
taaacaacaaacgcacagaaacatcgaaaaaactaagggtaaacggaaaagaaaagcagacacatctgatagcgaagaagaacagttggaaaacaaaaggaaaaagcggcataaagaagaatcaacttctagttcttcgccatcttcctcatgttccagcagttctagtagcagctccactacggacaccagttgctctgatgaagaggcttcacaaaagaaaatcaaaacgaaagtgaggaaaaagaggaaatcgtcaccatctacatcgtcaacctcaagttcaagtgaattatctgaggaggagctaaacagtaaaaagaaaaagaaggtccttaccaaaaaacgccctagaaagcaatcatctagttcgtctacttcnnnnnnnnnnnnnnnnngtagcttatcaagtgacgacaaatcaaaaaaaccttccaaaacctcgtccaaaaagaaaaagcccaaacaggaggatgaatctatggatataccaataagtttgatggagaaaagtaaggcgatggcgccgatgacgaaagaagagtgggacaaaaatcagtctaccgttaaaagagtctttgatgagtctacaggacgtcttagattaataaaaggcaacggtgaagtgttggaggaaatagtgagcaaagaccgtcacaaggaaaatcaacaaatggcgacccaaggggatggggaatattttccaaaataaacttgcctttatgctgctaacaaaataaattcaacttagcaaaggttagcttagtaaataatattttttaaccatttgaatatttatttaagtacttaaacatttaannnnnnnnnnnnnnnnnnnt

SEQ ID NO: 6438 - DNA, 958 bp, Diabrotica virgifera
  misc_feature (337)..(358): n is a, c, g, or t
  misc_feature (901)..(918): n is a, c, g, or t
tttgcgtccgaaaatatctttgtcgcattcaaacctgttttcttgtgatattttaacattgttcactattttgaatggaaattaaccataattgcaattcaaaatacgtttattttgaagtctccatttttatttcgaaactttttggctcacaatgtcaaaataaacgtgctaaaattttcaactgaaattgtgcttaattcccattaaacatagtaaataaagaattttattaccaataacattgtttatgtaagcacaatcaatacaaatggaaacgttatggacataagttgtgtaatttttcttgcgtttctctaattttgttcataaatgnnnnnnnnnnnnnnnnnnnnnngctgacgaagcttatagaattggcccagctacagcctctcaaagttacttaagaggagataagttgctagaagttgccaaaaaatctggaagtcaagcaattcatcctggatatgggtttctttcagaaaatgttgaattcgccgaacgttgccaaaaagaaggtattattttcataggaccaccatcatctgccataaaagatatgggaattaaaagtacgtccaaagctattatgtctgcagctggtgttcctatagtcgaaggatatcatggtgaggatcaaagtatagagactctaaagaaggaagctaaaagaattggctttcctgtcatgattaaagctgttagaggtggaggaggaaaaggaatgagaatagccctcacagaagaggattttgaagaagcgttggagtctgccaaaactgaatctcaaaaagcatttgctgattctggaatattattaaaaaaagttggttactgaacccgagaaaccgttgaaatttcaaggtttttgcgggaaaactcctgggaaattggctgnnnnnnnnnnnnnnnnnnggggattggtttctgtacagaagaaagggattactaaaaa

SEQ ID NO: 6439 - DNA, 287 bp, Diabrotica virgifera
gggatgtttcccttgttgcccctttttcgccatgcgattcaaatatgcgaaaaaccttgcacacgcaagagagcctaacaacctagtgaatatgaatgtttttaaggcgcgtttcacgctcatcaccgcctcaagcacaatccgctatcctttactgtttatctggaaagtctagtcaaaaacaaggaccataatggagcaccgtcctcttcacaaagaggtctgtgatggtatggagaacagagagccggcgcccgcccgtacgtcgcactatagaccgaggcgcg

SEQ ID NO: 6440 - DNA, 457 bp, Diabrotica virgifera
  misc_feature (144)..(159): n is a, c, g, or t
  misc_feature (361)..(361): n is a, c, g, or t
  misc_feature (400)..(425): n is a, c, g, or t
ccaaatagaattgaccttttctggggcgataccatgcgttagggaatacgtaactcctagtaccaggcactacgctaccgaaaaccaaattctcctctggaagaagcttgataaaagcaacgtgaaccgaatatgtgcaaaagnnnnnnnnnnnnnnnntcttgtgaaaatgttgctgcgcagcgagcaagtctaatctccatgcaatccgacctaaactgctacaacctagatcggacagaccactctctcctcagaggatttatagcgtcagacgccgcgaatctctgccaattaatcttggttcgttaccaatatttataagtataaaacatcacaaacttacattccgcgtaaccangacaaaaccaacgccataaagcagacgacaccgatgacnnnnnnnnnnnnnnnnnnnnnnnnnnttaatatcccaatcctttttcttctacgaacc

SEQ ID NO: 6441 - DNA, 146 bp, Diabrotica virgifera
  misc_feature (53)..(79): n is a, c, g, or t
gggcccaaggggttaacattcaacttggaactcccaccgggggaaaaaacccnnnnnnnnnnnnnnnnnnnnnnnnnnncgtttttcccaaggggttaagaccttttttaaaagtttttgtttattggggggggggcattttttcc

SEQ ID NO: 6442 - DNA, 422 bp, Diabrotica virgifera
ttgaggccggaaagcaaacatccttaaaactgaagaacgactttagctgaaagaaacacatccttaaaactgaagtacgactttcagctaaagtatcggtgatgaattatgctccttttctagcttcacaactaggaattcaaggcgtgaaaaaggaacaacgccaatttttcgtcaatataattggatcaaccgccgaacatagaagaaaccataacgtaagacgggaagactctcttcagttgacgacaaacttattagatcctccagaggatggtgcagatcatctaacgttccgaccatgtcgacagcccacgtcgccctctctcctcgcggcaccgtcctcgacctcctcatcggccaccatgacagctgccttatgcgggcctcgcgagccttgcagaattgggagacacacttca

SEQ ID NO: 6443 - DNA, 619 bp, Diabrotica virgifera
  misc_feature (78)..(78): n is a, c, g, or t
  misc_feature (84)..(85): n is a, c, g, or t
  misc_feature (87)..(87): n is a, c, g, or t
  misc_feature (112)..(113): n is a, c, g, or t
  misc_feature (136)..(136): n is a, c, g, or t
  misc_feature (145)..(146): n is a, c, g, or t
  misc_feature (184)..(184): n is a, c, g, or t
  misc_feature (187)..(187): n is a, c, g, or t
  misc_feature (240)..(240): n is a, c, g, or t
  misc_feature (289)..(289): n is a, c, g, or t
  misc_feature (305)..(305): n is a, c, g, or t
ccgtacataaaagccccccccgcccgcgggtattttcctcgtcggtcccataaaaacaataaaggggggtggggaaanagaaannanagaagaatagagaaaatggtaagannagaagattttcccctaaaaaaanggagagagnngtagaggaaaagaaggtggggagagaaagaaagaaagngangtaaaaagaggaatagaaaggagagaagatgaaagagaaatagaaaaatgagnaagaaggaaagaaaaggggagtatgttaggagttttaggttgtttgagnaagagtagaaggaagnttaatggagtggggatgagaagtgttattattgaaatatattttgtagttgaatgtgatgttattgttagtttagttgaggaaggttttggagaatttgaagttatttagttaagagaaagataaggtgataaggggagtgttttagaggaagataaatatataaatgttttaaatagtaggaggtttaattgatagaaataagttagttgaaggagagagttgttttaaaggtggtatgaaataaaataggtaaaaaaaatagatgtaatatagatgatattggtgataagggttatttttattatttaagag

SEQ ID NO: 6444 - DNA, 745 bp, Diabrotica virgifera
  misc_feature (652)..(673): n is a, c, g, or t
  misc_feature (720)..(741): n is a, c, g, or t
gcatattaggagttacttgtgataaatagttgaaatagaataaaataagtgccaatttaacacgtatttgtgataattttatgtgcgaagttctttcacaaaccagtgcgcatttcaaagttaaacgtcttgaaatacacacgtgttttaaagtaaatatgctccgtcgtttccgtgtctttttcaaaactaccctgtcgtgaaatgaacacggaaacgttaatacgcgactcggtcccgtatagctctgttatttagcacgagatggaacatcagaaatgcccaattcacgatattcaatattaatcatttcacgttatagacggagaggcagcgctgaaaagaggcagttgattactgtgattgtttatagaaacatactgcggtcggtcaagcgaaacgtataacaggagttactgagaggatatcaaagttgctttccctaacgaaggtaattaaatccagtttaactttggaggagagggtataatgaaacaacttgcatctatcgtgactaaattcaaaaaggttttattttccgcttcactgcacttgtccctgccacggagctccttacaatattacccaacttgagtgcgttccccaaatacaaccaattttaaatacatcacattccccccttctttttatnnnnnnnnnnnnnnnnnnnnnncttttctttaaacaaaatctttccaaaaaacaaacttttaaacttcnnnnnnnnnnnnnnnnnnnnnnggcg

SEQ ID NO: 6445 - DNA, 1232 bp, Diabrotica virgifera
  misc_feature (57)..(87): n is a, c, g, or t
  misc_feature (99)..(125): n is a, c, g, or t
  misc_feature (241)..(267): n is a, c, g, or t
  misc_feature (663)..(683): n is a, c, g, or t
  misc_feature (695)..(715): n is a, c, g, or t
  misc_feature (877)..(896): n is a, c, g, or t
  misc_feature (995)..(1051): n is a, c, g, or t
  misc_feature (1105)..(1142): n is a, c, g, or t
  misc_feature (1182)..(1202): n is a, c, g, or t
  misc_feature (1205)..(1229): n is a, c, g, or t
cccaatacaacgcaaataccagccgcgtggtaagttggttcgaatcccaatagaaannnnnnnnnnnnnnnnnnnnnnnnnnnnnnnatgattgtaagnnnnnnnnnnnnnnnnnnnnnnnnnnngaaaatacgtatttagttaaaaatttttccgacaatcaatgttcagaaatcatttgtggcatttttaatgtgttttttggcactgttttaataaaaatgtttgagaagtagtaagnnnnnnnnnnnnnnnnnnnnnnnnnnngtataaataaaaagtatattaatttcgtttataatcatataatcatatacatataatagaagtataacttcttacgtgcgtacaaagtacacacacattcttttttttagctctaatacagtatgtctgcgtaacttggaacctattgataacttttttaatatcaattttacgaaaaaaagttattctttataaaatactctgcatcgtatataacataagatgcaatcatcaaatatctaattttgttaattttgtacgaggtatgtagaaaaatatgaatttcacttaatagtcaagtacctttatatttcactatatcgaaaatgtttataaagaaaagttgtttggaattaaaaactatgttccaatatgtaattatgtccttctaatcgnnnnnnnnnnnnnnnnnnnnnctttctaatacnnnnnnnnnnnnnnnnnnnnngtgaaaattatttgtttatcttttttttaagaatggaattccatatttgtttgattgaattctacttgtttttcgtttaatatccgccattttggatccgccattttgaaatttaatttttaatctttaattcagatttcacaacctgttaaaaataaagannnnnnnnnnnnnnnnnnnngttcttttatgttctttttaaaaaatctggattttggatcccccatttttaggataggttaataaggttaactttttaagttaggtttatcaaagctcnnnnnnnnnnnnnnnnnnnnnnnnnnnnnnnnnnnnnnnnnnnnnnnnnnnnnnnnnattttaacaacttatttttttaaagttatccccccctttttgggatttgccccnnnnnnnnnnnnnnnnnnnnnnnnnnnnnnnnnnnnnnccgggttcccgaaatctctcccccaaaaaaatacccaccnnnnnnnnnnnnnnnnnnnnncgnnnnnnnnnnnnnnnnnnnnnnnnncgg

SEQ ID NO: 6446 - DNA, 939 bp, Diabrotica virgifera
gaaagactctggtgctgccacaggaagaacactacatgaggtaactctgaatgagtcaattcgttacaaaccaggcgatgatgtagaaacgtggctggtaaaactgctgtgtttggattcgacgtctgtctcgccaatcttatccggttgtcctcctcctgacagttgtgatctgtactatatcaacagagacactcttttctgttaccacaaagcgtcggaagagtttttgcaaagattggtagcattgtatgttgcttcacattacaagaatactccaaacgatctccaaatgatgtcagacgcaccagctcatcatctcttctgcctcctaggacctgtagatcccaagaaaaggacattaccagaagtattagtcataattcaagtctgtctcgaaggtgaaatatcaaaaaattctattcttgacgggttctcaagaggcaaaagggccgcaggggatttgattccttggacaattggtcagcagtatcaggatgccgattttcctaagctagcaggagctagaatagttcgaattgccactcatcctgattatcaaggtatgggctatggagcaagagctttagacatcctcaaacaatattatgagttcaaaattcccagtttagacgaagactctcaactgccgaaacaggaaattgataatgttgaagactctgaagttggtctattagaggagacagttgagccacgaaattcactgccaccattgctgttcaaattaagcgaaagacctccagagaaattggactatctaggtgtatcgttcggactgacagaccagcttatgaagttttgaaaaaagcagggtatattcctgtctaccttcgacaaactacaaatgatttgaccgggggaacattcttgtataatggtgaacggggtaaacacttgaaaaaagttaaggagactgac

SEQ ID NO: 6447 - DNA, 735 bp, Diabrotica virgifera
  misc_feature (2)..(15): n is a, c, g, or t
  misc_feature (170)..(188): n is a, c, g, or t
gnnnnnnnnnnnnnnagcaagtaaaaggaagaaaaagtcatggaagcaatatctgaaaaagatatacgataaaatatttcaaattcattgtcttaatttcaaatgttcggttataaaaaccagaatatgtaatatacaaatcaaactggctgaatgtgggtgaaaaatgnnnnnnnnnnnnnnnnnnntcgccctgtatatcacaataaccgcaacttcacagcctaattaacttctacgacctcacaatgaatccctctaaagtcaaaacgtggtcagcaaacaactctaattaaatcatttccggtggcatttctggacaaccttattcataccattcctaacctttggttgtaagacataaatcaaaagaaaacccaaatccttttatgaaaggcctaaggcccccaactgccattttgcatcccctctctcatccgtaaatgaaacaatctcatccccccattattatataagatcatccattttcctctcctttatcatattggaatatcttacccttacaaagggttaaattttttaatggggaacatttcattgaaaaattaacagggctccggggggattattaagccccattatttaaatttcacgattaaaaagagaaaaaaaagataattttgaatggttgtaaattggatggaatttaatgggaaaattttccaacctcggggacaaaacccctggggccccctccggggggggggtttgggg

SEQ ID NO: 6448 - DNA, 649 bp, Diabrotica virgifera
  misc_feature (205)..(225): n is a, c, g, or t
cgacccattgcgctccgggtttgaaagtatttttaattttaatacttctactacaattattccgatgtggtgtcactcgttaaaagtattccgtttagcagaagtataatataccaattattgaaaagcatagtttctttttaactaaaaatgagtccaccaaaatcaacgacaaagcttctacagcagctaagggctcttatgnnnnnnnnnnnnnnnnnnnnngaacctataagtgcttacattgtcccttccagtgatgcccataatagtgaatacctagccgaatgtgatgaatacagggcctttataaccggcttcacaggatccgccggtactgctattatcacagataaagaagccctttttatggacagatggaaggtattactttaccaagccagtgagcagttggatttcaaattgggagctgatgaaagagggacttgcccaacccactcctccacccagggcgattggctttctaagaaaccttaataacaaggatcccaaagaaggggtcgattccaaaaggaatattccgaaaggcaaatttcaacccctcttcaaattccaaaacttagaggccctcgggcccaccaaactggggtcccccattggttaccgaatctttataaaaaattggatt

SEQ ID NO: 6449 - DNA, 431 bp, Diabrotica virgifera
  misc_feature (46)..(65): n is a, c, g, or t
ctttgtccgagctgaaatcaagaagatcgctgatgctatcaccccnnnnnnnnnnnnnnnnnnnngctggcgacgaatctacctactgtacgttagcgtttcgctgacatctgagttgaaaacaactaagaaacaccgtcggaaatacagacgtcttcttttcaccggcgatccatgtcattggacaatacatttgtgctgtatttttgatccactaaaggttatacgagaaagccgatgatggtactccattccgacaacgtcgttaatagaaaggaaggattactggtattaacatccactcctgctgtagttcctctcttcggctgctatgactgctgctccccccggaggtttgcactattggtggcaccttagtccccccactcctttaaaaatggtcgccccttctgtaaattcgccgttgctgt

SEQ ID NO: 6450 - DNA, 1197 bp, Diabrotica virgifera
  misc_feature (271)..(308): n is a, c, g, or t
  misc_feature (750)..(767): n is a, c, g, or t
  misc_feature (774)..(795): n is a, c, g, or t
  misc_feature (854)..(875): n is a, c, g, or t
  misc_feature (914)..(931): n is a, c, g, or t
  misc_feature (939)..(959): n is a, c, g, or t
  misc_feature (1044)..(1084): n is a, c, g, or t
  misc_feature (1104)..(1123): n is a, c, g, or t
  misc_feature (1137)..(1183): n is a, c, g, or t
gtttgtgtccttcataactgatgcatatttccattgcactcgctgctcattgtaccaggcatgtttgctagtgttgcccaaaatcggtcttggtcttgttcttgcgttttcgcaagaccaaaccgccttttagcaagaccaagacttaccgtgcaagacttgagcaagaacaagactaagcctgcgagacacttgcgtcttgcagttagaactgagggtcgttttagggagtatattagttcggctatattcttagatactctattatggnnnnnnnnnnnnnnnnnnnnnnnnnnnnnnnnnnnnnngacttatgctcattacgaacaataccataaacatacatagcgaatcaaaatatccatttaaagaacacttgacacgtactcagaggtcattattacaatgcaaaaataaaatattttgtacattcttcccagcaaacgacttctctgaaattaattgtccgggttatgaaaatagtcaccttctaatcataacattcttgctttgtgacgccgatagtaatatcgaatatcgtatccaaactttttaaaaatatgtcaccttagctgataaaaaatatacctaataagtaattaatttttttcattatcagttttctaggaatttaaccacccacaaatcttatcggtatactatataaaatagaaaaaatattatgaattgtttttgctgaatgggctgaaaccactcggttaaacaaaatttgccgaaaacgcgccggcnnnnnnnnnnnnnnnnnnataaccnnnnnnnnnnnnnnnnnnnnnngccggataggcgaaaaaccaaaaaacataatatgattttaataacggataacactttcnnnnnnnnnnnnnnnnnnnnnnttaaaatggccccaaatttccaaaggccgaaattaaagnnnnnnnnnnnnnnnnnnggtgtttnnnnnnnnnnnnnnnnnnnnnggggaaaaatgggcaattttttgcctttggccccaaacacaacggggtttttcccaaaaaaacacacacccgggggaaaattttnnnnnnnnnnnnnnnnnnnnnnnnnnnnnnnnnnnnnnnnnaaatttttctcaccccaaannnnnnnnnnnnnnnnnnnntcctcttattatannnnnnnnnnnnnnnnnnnnnnnnnnnnnnnnnnnnnnnnnnnnnnnttattctaatatac

SEQ ID NO: 6451 - DNA, 612 bp, Diabrotica virgifera
  misc_feature (50)..(50): n is a, c, g, or t
  misc_feature (136)..(136): n is a, c, g, or t
gcacaaaccagacgcgcggacaaaaaaagcacgttttttacggcaacganaacgcccaccacaacacgccgcccaccaaggcgcggagaccaaaaaaaacagcgcaccaaatttttagagcgaaggacgggcaaanaaaaccccctcaagacggggaggacgaccagaagcgaggaaacggacctcgcccaactgttcgtccaaccacaggcttcgtactacgctatttccgaatagcgtgaaactggatgcgcacagttcacagacatacatgacgaagtgaacgcttttcagacaaagctcgtcaacgaagtgagaagatgcgatgaatcggaaagacagctaagatacattgaagccagaagtgagaaaagatgacgtccactttcccgatgtcaacgaattaccaacacatccaatccccgtgaattaatagacttctaggctcctcttgaacacaccgaccgtgacatcaaaaatctctctgaaagtggagttgctctcatgaccatctcactataactatccgacccctactcattctggagaacaccccagcgtcttccactgaaaagattaagcaaaaggactctctaaatcactcaccacacc

SEQ ID NO: 6452 - DNA, 281 bp, Diabrotica virgifera
  misc_feature (20)..(36): n is a, c, g, or t
  misc_feature (38)..(54): n is a, c, g, or t
  misc_feature (59)..(77): n is a, c, g, or t
  misc_feature (96)..(109): n is a, c, g, or t
  misc_feature (112)..(124): n is a, c, g, or t
  misc_feature (129)..(149): n is a, c, g, or t
  misc_feature (151)..(167): n is a, c, g, or t
  misc_feature (169)..(181): n is a, c, g, or t
  misc_feature (192)..(212): n is a, c, g, or t
  misc_feature (260)..(280): n is a, c, g, or t
tttattcctcataaatttcnnnnnnnnnnnnnnnnncnnnnnnnnnnnnnnnnncaacnnnnnnnnnnnnnnnnnnncaaaattctatatttagcnnnnnnnnnnnnnnccnnnnnnnnnnnnncgccnnnnnnnnnnnnnnnnnnnnncnnnnnnnnnnnnnnnnncnnnnnnnnnnnnnccctcgccccnnnnnnnnnnnnnnnnnnnnncccgccgtatcctgaccgcgccaccgtagcataatcatcagcctctcnnnnnnnnnnnnnnnnnnnnnc

SEQ ID NO: 6453 - DNA, 147 bp, Diabrotica virgifera
  misc_feature (23)..(47): n is a, c, g, or t
ctaatcataaagatattgtttcnnnnnnnnnnnnnnnnnnnnnnnnngcaggaatcggtagtgaacttcagttacagaatctttatgtacgaagcagaattactgcaggactcggatcttctaattggaaatcgaccaaatttcata

SEQ ID NO: 6454 - DNA, 414 bp, Diabrotica virgifera
  misc_feature (2)..(177): n is a, c, g, or t
  misc_feature (248)..(266): n is a, c, g, or t
  misc_feature (299)..(319): n is a, c, g, or t
  misc_feature (360)..(403): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggataacaccggaatttttatttggaaaattcaaaaccataataaaaaattgcaacccccatgtttgnnnnnnnnnnnnnnnnnnngggtaaaaactatattattttaaaactggttcnnnnnnnnnnnnnnnnnnnnngaaatctggggtttataacccggggggggaccccggttggnnnnnnnnnnnnnnnnnnnnnnnnnnnnnnnnnnnnnnnnnnnnaaaggggccaa

SEQ ID NO: 6455 - DNA, 410 bp, Diabrotica virgifera
tatgattgatgatgatgttccaccccgttttgcggtcaaccccgaccaaaccactgagatagtcatggaggacagtcttgaaccaagcgtgctgaaagtgagctacaacagctacgacccgcaggaatcattttctgctgaaggcggtctcgctattgactactccgtaaaacaacattcggaagaccctcctagactcccactaaattgaagttgaaatcgtcgttctggacaacttttctttcagccctcgaactgctgtcactgctttgagccaaaatgttgcaggaagcgacgcacatcccggaaagtacactgtaattaaccttggtaaagctgccttcgatattgatccgaaccgaactttcaccagttcaacctctagaactcttgcgcagccccgttgagcc

SEQ ID NO: 6456 - DNA, 268 bp, Diabrotica virgifera
  misc_feature (4)..(46): n is a, c, g, or t
  misc_feature (52)..(74): n is a, c, g, or t
tttnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 6457 - DNA, 938 bp, Diabrotica virgifera
  misc_feature (327)..(354): n is a, c, g, or t
  misc_feature (603)..(664): n is a, c, g, or t
ctcacctgatcacaaccttgtgctaattccgagcaaggatgacatacatccacatgtgatacatttttaatcttaagacatcgacttattgtcgattactatacagctcataatgtagcaataatgttattttgaggttttacacctattcaagtggctagtttcaattacttgtacactggacgtaagtaaccacattttcttttttaactgtcaaaatttcacccttttgcatttcaatctaagtggttcacttatttccaggtttacactgaggatggtcagtttgaccgaaaacgttttgtacaaccactcccttgtggatgnnnnnnnnnnnnnnnnnnnnnnnnnnnnatatacctatatacaacagaagtgtttacttcattctacgttgtcttaacaaaggtatacagccaactacagggtttacccttttaatgttttatttaatgacgatatggtcaacttggctcttaagtacttgcggctagctacaaagaggaacaacactaaattggatatatggttcatatctcaatgccttaatcacaaagtcattccaaatttttgcagagtaaaaacatcaaaaaatgtacctcnnnnnnnnnnnnnnnnnnnnnnnnnnnnnnnnnnnnnnnnnnnnnnnnnnnnnnnnnnnnnnaaattaaactacctcaactgtcaacttaaggtaatgtatgattctttgctcgaaataataggttttatcaatattaataactttatgtcagatgttcaggataaggtggagatttctaattcaattaaatttaatagagttaataacaaatttaattaaacttatttcagccaaaactttgctcgatcaagcttcagatgtcagagatgtcagaaagttttcagatttcaaattccatccccgtataaagaacctccccaacattatttttttc

SEQ ID NO: 6458 - DNA, 573 bp, Diabrotica virgifera
  misc_feature (473)..(485): n is a, c, g, or t
  misc_feature (488)..(505): n is a, c, g, or t
catttttcatctaaatacaaatatatggtaaaaataaagttatatagatataaagcggtattgtttgagtaaaaacggcaactgtaggtaaaaatctgttaatgattttgaaattgtaattgcattagccgccagatgtcgccatcggtgacagttctcccgactttcgacgaaaggtaggagcgtatcgagcgccgtcaaaagttgaggttatgtttaaaatactaaccttagttgttaagttagttgcgaaccgttgcaactctcttccctcactgtttgctgcattaaaatagataaaatggcctggcgacgtacctggactcgcgaataaaggttcaccgacattgaaactgaataaaaagagagaaaactttgctggtttcttttttctacgatattaatcgatgtcttccgaaacggaggcattgcggcctattaccggcactaaataagtagagatgttatgatgnnnnnnnnnnnnnatnnnnnnnnnnnnnnnnnnctatgaatgttgtcgctccgagctataatacggttaggtacgtaactgtaagcctattttgggcacag

SEQ ID NO: 6459 - DNA, 1177 bp, Diabrotica virgifera
  misc_feature (426)..(706): n is a, c, g, or t
  misc_feature (715)..(763): n is a, c, g, or t
  misc_feature (765)..(819): n is a, c, g, or t
  misc_feature (824)..(904): n is a, c, g, or t
  misc_feature (906)..(993): n is a, c, g, or t
  misc_feature (1001)..(1065): n is a, c, g, or t
  misc_feature (1093)..(1116): n is a, c, g, or t
  misc_feature (1121)..(1176): n is a, c, g, or t
aaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaaagagtttgtgtgattataaaataaacgaaataaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatttcgnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnngagannnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaannnnnnnnnnnnnnnnnnnnnnnnnnnnnnnnnnnnnnnnnnnnnnnnnnnnnnnnnnnnnnnnngtttttataaaaggggaaatttggcggnnnnnnnnnnnnnnnnnnnnnnnngcggnnnnnnnnnnnnnnnnnnnnnnnnnnnnnnnnnnnnnnnnnnnnnnnnnnnnnnnng

SEQ ID NO: 6460 - DNA, 301 bp, Diabrotica virgifera
  misc_feature (8)..(29): n is a, c, g, or t
  misc_feature (82)..(101): n is a, c, g, or t
  misc_feature (124)..(142): n is a, c, g, or t
  misc_feature (145)..(171): n is a, c, g, or t
  misc_feature (183)..(269): n is a, c, g, or t
  misc_feature (274)..(298): n is a, c, g, or t
ccccctcnnnnnnnnnnnnnnnnnnnnnngtggggggggtggttcccccccggggcgggcggcggggtgggggtggggccannnnnnnnnnnnnnnnnnnncctctaataaaggggggccgcannnnnnnnnnnnnnnnnnngtnnnnnnnnnnnnnnnnnnnnnnnnnnncttctttgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnacacnnnnnnnnnnnnnnnnnnnnnnnnngat

SEQ ID NO: 6461 - DNA, 797 bp, Diabrotica virgifera
aacgaaacagaaacgatatttaacagataaaatgattaaccttcacaagaggtttttgaatactcacccaggtattactgtgagctacgctttttttgcagatgtcgtccgttttggatattgcatatgaaagtttccagtagagatacttgtatgtgcattacccacgcaaatattgagcttattacttctagcttatttcaattcagagttttaagttcaaaaaatttgactaccattattaaaagtttatgctgcgagaaaaaactgaaaattgtctattacgtgtgtgtgaaaaatgtcaagagactgttataacatacaaggaccacgataaaaacaagcctgtcaaatattataaatggtcaacaaaaaaagaaggatattacgaccccaaaagtaacacaagtaaaactacgattaaaaccataaaacttcttgttccaataacattgggatccttaattaacgaatttgaatccaaattaactgcatttttggcacacgaagcacgaatatgtcaccaatttcgggccttaagaagcaactgtcacaggaatctatcctaatacactgcgacttgagcgaaaattacaacttaaaatatgctcaagacacactatcgtttcatttcggaggctcacggcaacaaatcaatttacatacagttgtcgtctacaaaacaactgcagattctattgttaaacctaaatcttactgtacgatgtcagaatgccttaagcatgatgttcctgttatttgcgcccacttattaccggtggtaaaggattcatatg

SEQ ID NO: 6462 - DNA, 801 bp, Diabrotica virgifera
  misc_feature (518)..(540): n is a, c, g, or t
  misc_feature (554)..(554): n is a, c, g, or t
gaaacttgtatatattgttaattttattgttatttcagaacatcattcaacaaaatactatgagtatgtacgtcaatagaaaaaagatataaaaatcaactattttataagaaatgttcaaaacagtatttttttcaaattttacactctgtataagcatattttactgatttaagttgaaaagttgaggtttgttattgtgtattagtatttagtcaattgtttcaattccatttgatatttttacgatctatgatcatagagtcttcttttagttcaataagatattggcctctgtttctcagatagtatgagccgaaaaggtctttaaaaatactgatttactcatgctacatgctcttaaacagttgctataaatcgccattgtgacaagaatgaaacaacggtataaaggcagaaaatcgtcatcatcatttatcatcaatctactgctacagcccctaaaggggttgtaaaaaccttcaatgaataactacaaattttttactcatttaacnnnnnnnnnnnnnnnnnnnnnnncccccgtggctcanaaaccaaatgatcaccctcaaaaattaatttctattattttcccatagtggttcttggtcggcttctcccaaaaggggtaggctaaaattatttggacaataaaacaacaaaggcacgctaaatttaaaataatcccgatctccccctaattcaaagaagggatttccgtggccccaaaaaatttaaaaaccttcttaaaattaacttggattcggaataaaacccgccccaccccccctctggtcc

SEQ ID NO: 6463 - DNA, 560 bp, Diabrotica virgifera
caaagcatccgtgagcactatcctaatgcctaatacatcacagaactccccaataggtaaaccagatggtactcatcaagaacaacatattctcgtatcttctggagaacaaatctgttatgggaggatcacaagaagatatacaagtaccacccaaagtcttcactaatgaaggtatgcctcccgttactgtatcacctatggtaactactgttacatcatccgtaggcactgttattccaattgttgatcagcaggttcttgggcaacaagcagcttcagtaaatgctcttccagcacccttccgttcttcaacctggagtcaccatcgatatggacggtgttcctgtcgaccccaacttgcagctaccccaatttgtgacaggaaatctcattcagcagcctatacaaattgaccactctgacacacggaggggtaccaccactactgtcgtcggacccgactaataagggcaaacaaaggaaggattctgctccgactggggctagaatgttgctattcccgacccaacagagtccccggggtggggatttcccct

SEQ ID NO: 6464 - DNA, 65 bp, Diabrotica virgifera
attagggggagagtttgggtaggccttgcgaggtactcggtccgggaaattcccgggggcgaccc

SEQ ID NO: 6465 - DNA, 587 bp, Diabrotica virgifera
  misc_feature (4)..(25): n is a, c, g, or t
  misc_feature (41)..(61): n is a, c, g, or t
  misc_feature (107)..(125): n is a, c, g, or t
  misc_feature (144)..(211): n is a, c, g, or t
  misc_feature (224)..(257): n is a, c, g, or t
  misc_feature (259)..(293): n is a, c, g, or t
  misc_feature (297)..(389): n is a, c, g, or t
  misc_feature (498)..(515): n is a, c, g, or t
ccannnnnnnnnnnnnnnnnnnnnncatgccttttgtattnnnnnnnnnnnnnnnnnnnnnctgattatttgaatggcgcggtattttgacgtgctaagtagcaaannnnnnnnnnnnnnnnnnngtgggatgagggttgatgnnnnnnnnnnnnnnnnnnnnnnnnnnnnnnnnnnnnnnnnnnnnnnnnnnnnnnnnnnnnnnnnnnnncgagagaccctannnnnnnnnnnnnnnnnnnnnnnnnnnnnnnnnngnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggaaaaaaggggtaattttttttggggaaagttccaacccaaaaaataaaaattgggcccccccctgggtgggattaaaagtttataatttgtgggggaaacnnnnnnnnnnnnnnnnnngccggtctcccccttttttaaattttttccgtggtttggggggtttaaaaccggggcgggagggcccggggt

SEQ ID NO: 6466 - DNA, 176 bp, Diabrotica virgifera
cgccacgcagctgactcgatgaagctgaagatatgactgagcccaaagtattatgacttgtgccttacgataccctagatgttatatgttggtttaaaagttcaatactcgatattcgtgccgaatagttgagggaacattcccttgataatataaaagattttccagatgcattg

SEQ ID NO: 6467 - DNA, 201 bp, Diabrotica virgifera
  misc_feature (39)..(65): n is a, c, g, or t
attgttaaaaaattctagaaaatatacataaatactctnnnnnnnnnnnnnnnnnnnnnnnnnnnagctcgagaggaagcaagagtaggtagggggggatgagacgggatagctggactggagcggcgccggagttcaagcttttggcctggggagttgaattggcaggacgtggcaaaaaccgggatagacgcattcctg

SEQ ID NO: 6468 - DNA, 475 bp, Diabrotica virgifera
  misc_feature (14)..(15): n is a, c, g, or t
  misc_feature (31)..(31): n is a, c, g, or t
  misc_feature (43)..(43): n is a, c, g, or t
  misc_feature (57)..(57): n is a, c, g, or t
  misc_feature (69)..(69): n is a, c, g, or t
  misc_feature (84)..(84): n is a, c, g, or t
  misc_feature (87)..(87): n is a, c, g, or t
  misc_feature (107)..(107): n is a, c, g, or t
  misc_feature (118)..(118): n is a, c, g, or t
  misc_feature (216)..(216): n is a, c, g, or t
  misc_feature (268)..(268): n is a, c, g, or t
  misc_feature (280)..(280): n is a, c, g, or t
  misc_feature (345)..(345): n is a, c, g, or t
  misc_feature (356)..(356): n is a, c, g, or t
  misc_feature (385)..(385): n is a, c, g, or t
  misc_feature (401)..(401): n is a, c, g, or t
  misc_feature (403)..(403): n is a, c, g, or t
  misc_feature (408)..(408): n is a, c, g, or t
  misc_feature (413)..(413): n is a, c, g, or t
  misc_feature (417)..(417): n is a, c, g, or t
  misc_feature (426)..(427): n is a, c, g, or t
  misc_feature (429)..(429): n is a, c, g, or t
  misc_feature (446)..(447): n is a, c, g, or t
  misc_feature (450)..(451): n is a, c, g, or t
  misc_feature (453)..(454): n is a, c, g, or t
tcatccgaggcgannagaggaaaaaggaaanaaagagagaccnaatttttgaggagnagaagggacaancagaagaaagaaaancgncaagacggcggcaagcagcnaaaccagcacngaatttggcaagcaacgccacgacccccggaacaacgagagcgaagcgacggagaccgaagcagaggcagaagagggcaccgagcccgaggaacgggngaggacacggccggacagggcaaaagacaaggaacaaaaaccacgagagcanagcgaggccggncgcagccaaaggccacgcagcacgaaacgcaacagggcccaacaagacaacgaccgcgggagacnagaaaaagggngacaaggcgccgaaggaacccagaaaacncaaaagaacccaccgncnaacanagaanaccnagaagaggnnanccaagaccaccgagagnnccnncnngaccaggacagccacaagagc

SEQ ID NO: 6469 - DNA, 698 bp, Diabrotica virgifera
  misc_feature (140)..(157): n is a, c, g, or t
gttgtagtgggttgtgttttttgtcgtgccatattattattgttattattatttaagttatagcaaatacaaatttaaagactgtagactattagtgatgtattttaggatacagaggttattatttttagcagtccttnnnnnnnnnnnnnnnnnngcacagaataaccaacgaagtagcagtgatatcacttttaaagacgaagactctgcaattgaaggcagtggatataatggagaggtgacgcacgacctggaatcaagtggttctggttttggaccagatgacgaagatgatcatgataacgacaagcaggatagaataatagaaccaaaaataagtccacctcaagaaccaagtttccctagaaacataccggaactggaaactgagaaagacaaagacaaagaaactaaaggttcgcctaacactacgttggatccaactgtcagaatgaattcaaatgatcgcccaacttcattctttactcaacccggcatgatggctgctgtggttggtggcgctgttgttggattactatgtgcaatattagtggtgatgttcatcgtctacagaatgcgcaaaaaggatgagggctcatatgcagtaggagaccccaagcaatcgccaaactcaaactcgtacagcagagctacaacaaataaaaaattcttttgcctgaaagtagccctactaa

SEQ ID NO: 6470 - DNA, 648 bp, Diabrotica virgifera
ccctttgcggtccgggacggaaaaggtggatttttacgggatatttcccaaaaagggaggatcattcagaaagaggtgtcaaactagaacctgttggtaaagaagataaacctattctctcagatacagttgtaaaagatatgcttgatagcactgcgttcttaaaagatgaaatagacagatatcatgatgtcaggcccattattaggcatccagttgaagatgagcacgttaaagttgatgtcagagcaactcctgaacaaacaaagccagaaaaggtgccaagaaaatcaaaaactaaaggagactaagaaagtggtggtatttttggaatctttaaaaagaaatcagaatctgtcgaaagagatttctacagatgaaattgaatcaattaagccagatttaaaagactcaggtgaaataattataactaaagtaacaactactattacaaatatatctcctgaacaaactaaatctatagtcgtccggaaacaacagctaaagcaattagatgcacgccaacaattttccttaaactttgcaaatttgaaaagtattcacgatgttacaacctcttccttccaagagaatccattcataaaacagtcacaagtgattagcagcaacctgtgcctgaaacaaaaa

SEQ ID NO: 6471 - DNA, 933 bp, Diabrotica virgifera
  misc_feature (448)..(466): n is a, c, g, or t
  misc_feature (511)..(511): n is a, c, g, or t
  misc_feature (623)..(657): n is a, c, g, or t
  misc_feature (828)..(846): n is a, c, g, or t
  misc_feature (876)..(929): n is a, c, g, or t
gggttgtatcactatgtgttttgtgatttcaaccatttatgatacttctgttgttttatttgtttctgttgttcaagttcatcgctccagattatgttaatatttctcctagtatttgaaagctcctccatacctaatgcttcattggctgcttaattaatctcaaatgttattttgtcgtatattgtattggtgctacatgtcaggtcaatttgatcaagtttttgatccagtctgttctggtaaggagacctggtgctgtcgtcatacagcccagttagattaaatttggtctctttaactattttttgttcttttcctcttgcgatatttcatttattccatgtttgaaggagatttgagctcgagtaattagtagataatggtcagctccgcattctacacctttgcattgtatacccttgtgtcttggattttccattctgannnnnnnnnnnnnnnnnnngtctattacctcaaagttattacctaaaaacaacattgataattnaattttaagtatctcaaaaatctgtcaatctgtaattataatgttgctgagggaaatccagagtgttagaaacacgttttgtttatatcatcatgttttacagatgttatgnnnnnnnnnnnnnnnnnnnnnnnnnnnnnnnnnnngttcgaatcgcttttcctgtggcccaactggtctaatgacggtaagaatttctttttttgggaaaggcagttggcttaacgggactggaaatttataaaccaaccaaaattacctgttggtaacccatattagaaataagaaacatacattaataacattaaaccttaccnnnnnnnnnnnnnnnnnnncccctttttattgttttgggttaacaaatnnnnnnnnnnnnnnnnnnnnnnnnnnnnnnnnnnnnnnnnnnnnnnnnnnnnnntccc

SEQ ID NO: 6472 - DNA, 647 bp, Diabrotica virgifera
  misc_feature (60)..(643): n is a, c, g, or t
cagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatc

SEQ ID NO: 6473 - DNA, 900 bp, Diabrotica virgifera
  misc_feature (22)..(46): n is a, c, g, or t
ccggacaatttcaagcagaacnnnnnnnnnnnnnnnnnnnnnnnnntttaaagcgctagaaaataaagtaatccctcccaaggagaacaacacagcaagcctccaccaattttcatacacggtgtacaagactatcaaaaaatggtacaaaaattaaggatgtagcagaaagcgaagaatatcatacaaaaagtttaactaacaatgtcgtaaaattaagttgtggcaggccagatacatatagaaaaatggtcagatattttaatgaatataacattttatcaccacacatatcagttaaaacaggatcaagcctatagagttgtaataaaataccttcaccactctactaacactgaggacataaaaaacgaactcctaaaactgggtcataaagttcgaaatataataaatgcacaacacagaattaccaaagagccacttaattggttcttcgtggatctcgaacccggcagcaaatagcaaagatatttataacttaagggggctacagaacagagttattgaaattgaacctccccgaacaaccaaaaatcgcataatacaatgcatgagatgccaacaatacggacactccaagtcatattgtaataagccattttgtatgcgtccaatgcgggggagcccccagtacccccagaaaaatgtggattatgtggggcggatcaccccgcaaattataaaggatgtgaacatttccaaaaaagttccaatcttaattacgggaatccttaccagaaaaacggattaaatcccggcaataaaacaaatatattaccccaccccaaaaaatttaccccacccccgaattcccaattccgtatggaaaggtacccctccaggtaccgccaaaaattatactttcccaaatttcctaaa

SEQ ID NO: 6474 - DNA, 122 bp, Diabrotica virgifera
accccccctcttcagcggcttgatgtgtgtgtgagctactgtaactaccctattgaataagagaaaatgtcggtatcccccgctcgcccattagtgagcgcatacaatgagaaactccgagg

SEQ ID NO: 6475 - DNA, 204 bp, Diabrotica virgifera
tttcgtccggcaagatttttctattggaagccattaaaaaccccactcgctggtcaaatacacactgcaataatggaggataataacgtttatcacaataacacaaaatctagaccccatcgagctggcgacctgttcagtaagaaacagcaatcccactattgtgaggggacctcctccccccatggcccccattcaaaaatt

SEQ ID NO: 6476 - DNA, 139 bp, Diabrotica virgifera
  misc_feature (40)..(76): n is a, c, g, or t
gtcacctctagggtcgaggtgaaaaaagtaacccctaatnnnnnnnnnnnnnnnnnnnnnnnnnnnnnnnnnnnnncgaagtccgtgcttcttattaataccttcaccaaaagcaacaatgcagtggtcagcttttaac

SEQ ID NO: 6477 - DNA, 1265 bp, Diabrotica virgifera
  misc_feature (537)..(584): n is a, c, g, or t
  misc_feature (845)..(863): n is a, c, g, or t
  misc_feature (865)..(883): n is a, c, g, or t
  misc_feature (1084)..(1122): n is a, c, g, or t
  misc_feature (1170)..(1188): n is a, c, g, or t
  misc_feature (1240)..(1260): n is a, c, g, or t
ggagaatttccttggcatgcagccctctatcacgcaagaggaatagacctaacatacatatgcggcgcaactcttattactagatatcatttgatcactgtagcccactgtgtaacaagattgaagacgcaaaatgctttatctccatctagtctcatggtatatttaggtaaatattatttgaaagtttggtccaacgcaggcatccaagatagacaaatagagaaaattattgttcatcagaattacaattctcgtacgttcaatcatgatatcgccattctaaagctaatagaaccggccgaaataacaaactatgtaagaccggcatgtttgtgggaagacaacacaagtttggaaagtgttatcggaaggcaaggtactgtcgtcggttggggatttgacgagacgggcagagtcactgaacaactaacgaaagctcacatgcctgtggtatcacaagaaacctgcatatactcctttccagagttctattccagatttacatctgaccatacttactgcgcaggctttaannnnnnnnnnnnnnnnnnnnnnnnnnnnnnnnnnnnnnnnnnnnnnnncccaagatcaggctccagtccaaataacccccatttgggagataaggggaatggtgtccataagtgtggcgttacaaaatcaattcccgatgtgattcatcgcattatgtagtatttactgatatagctaaatatttggactggatcaagaacgctcctcactcctttaacttcctgactcataatatgtaatagaaaaaagaatttttaacaatacctatgcctaactaataaatatttagataattttacctatttatnnnnnnnnnnnnnnnnnnncnnnnnnnnnnnnnnnnnnngagggcgctctaaaaggatcaaggttactaacccggggctgggaacgcataggtcttccattatggaccccaaaataaattccccgggccgccccttttacaacgcccgggacggggaaaaaaccggggggtacccgaacaaaatccccttgcccgccctccccccctctccccccctgccgaaaaaagaaaaaaggccgnnnnnnnnnnnnnnnnnnnnnnnnnnnnnnnnnnnnnnntgggcaaggggaacacccccccgcgccccggcgccctataacggcgcnnnnnnnnnnnnnnnnnnntggccggccggggggggcgggctccccccttttcctacccgcctccccccannnnnnnnnnnnnnnnnnnnntcccc

SEQ ID NO: 6478 - DNA, 461 bp, Diabrotica virgifera
  misc_feature (151)..(170): n is a, c, g, or t
gtaaggagaagtgtaaataatccaaataaaaagtaaataacgttatttgtaaataaaaatgtctacagaacgtaaaaattcaagcagtaatcaaaacaatactcttcctttaaaccccatctctctacagaatcaattactcgttgctagnnnnnnnnnnnnnnnnnnnnggtaacaaccttaatactcttaatccatgttcaccgaaaagagctcgattaacatctataagaaattgccagaatggcagtgtctctcgtgtaaaaagaaacacagtaattcaccgccacctgctccgcaatttacacacacgaatattcacagcccgctacctaggccaaacaattactaacttttccgagaaaagaggcacctccacgacaacctgccatcttgctcaagatatgacaacttcaactaccacttcaataaaaatgattttacaaaacagaacatgcttt

SEQ ID NO: 6479 - DNA, 678 bp, Diabrotica virgifera
  misc_feature (520)..(534): n is a, c, g, or t
gccctgtgtacaatttgtgtagtggtaaaaaaattgcacgttgttgcagggctactttgatgttgacggtcaacagcagtaaaaaagtgggtttatattatactgttggagtcatgcagggcgatcaaatcagtatgattttttgatgaaggtgctcgtgactttgaatcactcagtgtaaccctggacaagtgttgtatctttttaatcagaagaatgtggagaggccagattttgaatgaaatacagggtgttccatttgaaaaagcagaactttggtttggcaccgtgttatggaggaccctgtgtatttctcactggttttaaagtgtgtacattgagggtgtctgtgacttttgttaacggctttttttcatatattttatagtggcggatgtattggactttgtcacggaggttgatcaccctgtatgagaccctcaacatacgtcggtagcaccacatttcaaatgcctctaaccgttttatggcatcttctgtcaggctccatctttcaacnnnnnnnnnnnnnnnactaaagacgtaacatctaagaattcttatgcgtatattgatacttaaagacaagttgcacggaattttcctaagaatgttaaaaaatctatggtttttttcatatgagttttttatttcgtaactatgatccccagtatcttt

SEQ ID NO: 6480 - DNA, 52 bp, Diabrotica virgifera
aacacccccattttggttattttttttctataaatcaatttccaaatattct

SEQ ID NO: 6481 - DNA, 660 bp, Diabrotica virgifera
  misc_feature (45)..(64): n is a, c, g, or t
ctcgtgatataagttggcaagactgtcaagaaattgttgaagttnnnnnnnnnnnnnnnnnnnngatggaacataaatttaacacatttagccaaagacattgggattttgctgttttgtctctagtgtcatgggcaacaaattgtctaaaatttaaggattcatatgattcacttcagtaccaagcaatactctgttcggtggttagtttatacgtcaatacagacaacaagattaaagaattaaaacaaaaggatgtatcaagcagttttgttgacgaatggcaagatgttttggtggaaagtatacattctgatttattacaaacatggctatatttcgctgataaacttaaggacaagaaggatattatgaaatatatacccctgatacaagaattatcgaagctccttgataacataaactgtgatacaatatttaaactaagcgaatcggaattaccaaagtggacaaaattcttaaagcaaggttgtgtcttgctggtaaactcgcagccaaacttgcaatcttggggatataaatggtgttgatttggaccccggtttgcccaaaattggatatgacgctgttattactaatactcccccacccaaatggcctgattttcaagcagtttaggaaaatttggtggaaaccccc

SEQ ID NO: 6482 - DNA, 1205 bp, Diabrotica virgifera
  misc_feature (984)..(1002): n is a, c, g, or t
  misc_feature (1043)..(1072): n is a, c, g, or t
  misc_feature (1087)..(1125): n is a, c, g, or t
  misc_feature (1142)..(1187): n is a, c, g, or t
tttcgtccgcagttacatctcaagaaagttccgtgtttgacacatacgacgagggaatagaactgggcagaaacaaagaagtgtatagtagtgttcggagagagacgttctgtgatgataagggtattgtacgtattgaacgtgttgctttctcagataaccacccatttcccagctttgtcaccagaagtgaatcaacagcatcgttaaaaaggcttgagtacataatagatgaaataaaatcaactgaacgaaaatatgttgaagacctggctaagttgtcaagacgtataaaccatggattgagaggcatactccagtcgaactcaaggactatcacggctatttatttggaaatatagataaaattcataggaggcagagaaagttcctagaagacctaaataaatgtggcagagatgtaaatgaagtagtaggatgtttcataaaacacgagcttctcttcgaaatgtaccctcactatttcaggaacaaaccaaaagctgataatctacttaaggaatttagtcctataataaaggaaatgcaagaaaaatatggggaaagacttgacttttcagcatacttgttgacaccagtgcaaaggcttggaaagtacatttttattgttagaacagatttgaaaaacattggaaaaattggaattgcctgtggataatacccaaactggcctttagcatagtgaagagagaaaatgtcaaaggtaacgatttcagggttatccaatcgatcgaaaccagtcctattagtaaaatggattatggatcgtttaaaatggagggaaatgttccgtattttccaggccccaaaaaagtagaatgccttgggggtcttttttcaccatggggtttggggtttacgaaatggtggccccgggcaaaaaatccccccccccgatttttttaaaacccaaattttgggcagtacccttacacccccccccggccaacttccgatttgggnnnnnnnnnnnnnnnnnnncccccccttaaaaaaaagaaatggttttgtggggatagcgnnnnnnnnnnnnnnnnnnnnnnnnnnnnnncccccaaacggggannnnnnnnnnnnnnnnnnnnnnnnnnnnnnnnnnnnnnncgcggcacagataaccnnnnnnnnnnnnnnnnnnnnnnnnnnnnnnnnnnnnnnnnnnnnnnggggaaaaacacccgggg

SEQ ID NO: 6483 - DNA, 777 bp, Diabrotica virgifera
  misc_feature (10)..(30): n is a, c, g, or t
  misc_feature (32)..(73): n is a, c, g, or t
  misc_feature (75)..(156): n is a, c, g, or t
  misc_feature (158)..(191): n is a, c, g, or t
  misc_feature (204)..(249): n is a, c, g, or t
  misc_feature (257)..(273): n is a, c, g, or t
  misc_feature (275)..(287): n is a, c, g, or t
  misc_feature (291)..(383): n is a, c, g, or t
  misc_feature (388)..(409): n is a, c, g, or t
  misc_feature (442)..(505): n is a, c, g, or t
acccttttgnnnnnnnnnnnnnnnnnnnnntnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngaatttttattgnnnnnnnnnnnnnnnnnnnnnnnnnnnnnnnnnnnnnnnnnnnnnntttttagnnnnnnnnnnnnnnnnncnnnnnnnnnnnnnctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcnnnnnnnnnnnnnnnnnnnnnntaaaatcttcatatttcacaatatgtaattatnnnnnnnnnnnnnnnnnnnnnnnnnnnnnnnnnnnnnnnnnnnnnnnnnnnnnnnnnnnnnnnntaaattttataatgatgataatattatatcaaaaacttcgaatatttagttaaaaatacttaggctttactaaagggaattcggaaccatttttttcaccggattataaaaaacaggccattttgtacaaaatataaatttccggtggccacttgataaatttgaatggtgcgggatttttaccgggtaaagaagtaaatcattaacttttttttggaagggaaaagcagggtgggcagaaaaaaatagcctttttttattttacaaaattt

SEQ ID NO: 6484 - DNA, 184 bp, Diabrotica virgifera
  misc_feature (9)..(55): n is a, c, g, or t
tttcgtccnnnnnnnnnnnnnnnnnnnnnnnnnnnnnnnnnnnnnnnnnnnnnnnagtcatggagaatacgagtcttattgaaaaattggatcgacgagtatgaataggttaaatattccttcaatcagttacatctttactggtggaactaccttcctaaaaataccgacttgttacttctgt

SEQ ID NO: 6485 - DNA, 1330 bp, Diabrotica virgifera
  misc_feature (12)..(30): n is a, c, g, or t
  misc_feature (710)..(732): n is a, c, g, or t
  misc_feature (955)..(1030): n is a, c, g, or t
  misc_feature (1034)..(1060): n is a, c, g, or t
  misc_feature (1186)..(1204): n is a, c, g, or t
  misc_feature (1231)..(1257): n is a, c, g, or t
  misc_feature (1259)..(1271): n is a, c, g, or t
  misc_feature (1279)..(1318): n is a, c, g, or t
atctcttgaacnnnnnnnnnnnnnnnnnnngcttagatccaaaaatacatattataaaagatagaaattatacatactagtcaacatcaatatcaaatattacaaaaaatcagaatagttcttcaaattataaagataaattcacatagttcggattctgaaattcaagaatcgagttttcaacagttttctgataatttatactccaaagtacaagcatgagataaatcataatacggtatgagacaataaaaggttgcaaaaaaatgtctttatatcaattattacaaaatataactttagagagtaaacttaaacctaaggaaaagagaaaacaacatacaatttaggtgacaaagagtaacaacatattttttaggttaagatctaacagcatcattaaatcacagattatgtgtaaatgctgtatgacagatttatgaaacatatcacataacgaaacaaaaaagtgctaccaaatcaaatatacttagatcagggcgcatctgtaaaaatattagtacattgggatgttgagaggtgactcatatttttttgcagaaattgcccgaaaacaactcatataacaatatttgagctattttctgcaaaaaaacagagtcacttctcaaggtatatctcaaaacagatccgccctggactaattcgtttttatagcggtttagggttattaaaacaattattcccannnnnnnnnnnnnnnnnnnnnnnctggaacaataaagaaatccgaagggggtttgcaatccggttggggatgaaaaaaatggttttattctctataaaaaatggtgggacaccccccccttaaaaagatctaccatggtgttatggaaagttttccttaaaactaaaaatagaatttgcaacatgggaattaatggatgtggccttggctccccgccggaacacctggggttttaaggggggccgnnnnnnnnnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnnnnnncaaatctcttgggggggggaaaaatttaaggaagaatacaaaaaattctcccaaagttaaaacccttttaaatattgggtcccgtcttttttttgtggcccccggggggggccgaaaaaattagannnnnnnnnnnnnnnnnnngtggggggctcaacatttgtggataannnnnnnnnnnnnnnnnnnnnnnnnnnannnnnnnnnnnnncttttatnnnnnnnnnnnnnnnnnnnnnnnnnnnnnnnnnnnnnnnnaggggggggggg

SEQ ID NO: 6486 - DNA, 703 bp, Diabrotica virgifera
tggactttttacttcttcaactcttacggatcgaattgacaagcagattcgcatggaaaaagatggatatgtcacgatccaaagtattgttagcaaagctgaagtaagtgacgaagtagaaaggcatcgcaattccttagcagaacactataaaatgtgggaagaagaggcccttaaagccttcaacagagatttagcaactcttacagcgcaaagaagtgcaataaatatggaaccgtacataagatccataccggctaaagattgcatagctataattgtagaagaagcaaaaaagatgtctcaaggatcagaaacctacagtccaactgtcagtatgctctacaaagaactcggaagtaaagtgtatgcgagatataaaataatttgcaagcagaaaaatggggttttagataaagttaccaatatccataaaacttactgtagtaactatgcaaatactcataaacctctagatattttacctgagaaagaagttacggtgaatcccagacaaatttggcaatggatcgatcacggtttgaaaaagaaaggtgctacaattgagatggatcatcagcaatgggcaccagcagttttaaccttcataggaaaatttttataccacattgttatgtacgatatccaagtcgatgttaatgttttaaggaataccaaacataaaaattacttaccagctttt

SEQ ID NO: 6487 - DNA, 1104 bp, Diabrotica virgifera
  misc_feature (8)..(40): n is a, c, g, or t
  misc_feature (647)..(667): n is a, c, g, or t
  misc_feature (731)..(748): n is a, c, g, or t
gcgtccgnnnnnnnnnnnnnnnnnnnnnnnnnnnnnnnnncatctctttatttgacagttgtaaacagagcatccaatcactaaatatagaaccatatcacaatatatgactagatggtaaccattaccaatgtcaaatagtacattattacagttcaacaggaagtcagtacaaaaaatattcacacataagtacttcaaaaataagtacctgaaaaattagtcatttttaaattatctactataaatacctttatataaaaatacaaatatcttgacaaaacgttgtctagtaagtagacctagatatgcagcaccatatagagagcatttctagcttgtgttccttcagatgtattttgtcaaatttctaatatctaggacctattgtttagataaaaatgcttttattaaagcaaaactttcgcttgtctttagcagatgtcgccacgacatccaccccatcatgttatttcgttgcgaatccgatacctggcagcccggaattttttaatttgtacagagataatcaaatatgcactctctgaatgatatcataatgaggattgaatcccggtcagggtgctgaagctctctgaacaaactgaaatataagacggctcttggtttcgtttttaccaaaaaannnnnnnnnnnnnnnnnnnnntaaaatcctgtaggaatggtcccataacccctattgcaagggttcccctaatttcaaaaaaccnnnnnnnnnnnnnnnnnngggtataatatttttttccggcccaaaactcttaaaaaatatttccggaaaaaacaaattcccttccagctatctttatttttctgggaatttggttcaaaagtttccccgaattaaaaacctttctctttttaaatatgttttttccaccaaagaaattttaaaacccacactggcaataaaggaaattttccaccacatcccccccccccatctttatatctctcttctcaaacaatttttggaccccccctgcggcgaaaaacaaagggccccccctttaattataattttgtggtgctttttccgctcttgtgaccaccctttgtaatataaatcccccgcggggctctcgt

SEQ ID NO: 6488 - DNA, 403 bp, Diabrotica virgifera
  misc_feature (90)..(110): n is a, c, g, or t
  misc_feature (146)..(166): n is a, c, g, or t
tttcgtccggcgctagtcagagtagtatagtgacagacgtttattatataattagagtagaaatggacttcagtagtttatagagtatcnnnnnnnnnnnnnnnnnnnnngagtagaaatggacttcagtagtttatagagtatcnnnnnnnnnnnnnnnnnnnnncattattttactatccgaagcctttaggtattctaagtatttgtgccgctgtacctagaaacattcttcagtcaaaaatttatgttttgttcaattattttttacttttgtaagcacatattacatttatatctatactggttatctctagcatgtggagtgattgttttgttaatttggggaattataagcaaaattaaaatgtttaaggattgttacataaaaataaagtattta

SEQ ID NO: 6489 - DNA, 311 bp, Diabrotica virgifera
  misc_feature (10)..(90): n is a, c, g, or t
  misc_feature (96)..(118): n is a, c, g, or t
tttcgtccgnnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 6490 - DNA, 551 bp, Diabrotica virgifera
ctcaaaactaattgtatacctgtttcattgtacaaagggttttattgtagttaaatggcttaattcgcagacgacatagttttgttctctaacaacctcaaggagatatgtgcaatgctacatgaacttcagttctgatttcccccgacggtaaaacagttgaagccgaagctgcacacggtacagtaacaagacatttccgaatgcaccaacaaggcaaagaaacctccaccaatccgatcgcttccattttcgcttggaccagaggacttcttcacagggccaaattggacaacaaccaagaattgaataagttcgcccctgctcttgaacaagtttgcgttgaaaccatcgaatccggcagcatgaccaaagatttggccatctgcatcaagggcatgagcaaagtaaccagagaagattatctggagaccttccaattcatccacaaattggcagagaaccttaaaaagaaacttaacgcttaaaacgtttattcctacgcaatccaacttaaaaagcgtatatctggaaaatggaaaaagattgga

SEQ ID NO: 6491 - DNA, 646 bp, Diabrotica virgifera
  misc_feature (449)..(467): n is a, c, g, or t
  misc_feature (607)..(626): n is a, c, g, or t
aaataagtttcaaaactaaaactaaaatacaccgaaatgataaatttgtgtagatattgtcgttcttcatcattaattcctacagcaaaacagttgtttaaagttaataccaatagcctcgtgaggaatggccagcatagattgtataacaaatcttttttaaaaccccaatctttttctagaaacatgcttctatctagtttcttacgaggaagtggaacagtttcagttcaattgagttcgagtgctccaaaaggtcaaaatgctgtaggttactggctgttgacatgcagtggaatggtctttgtagctgttgtgttaggtggtgttacacgacttacagaatcaggactgtcgatggttacatggaaattattaggtgaaaaaatgccaagaactgaagtacaatggcaagaggaatttgagaggtataagcagaattccagaannnnnnnnnnnnnnnnnnngatatgaccctttaaaagagtttaaatttatttcggtttatggaatattcgcataggcagcggggtagagccctaggagcaatgtttttattcccagcagttttatttctgcaccaggggcagacttccctcccggcatnnnnnnnnnnnnnnnnnnnncctttgggaactttaattgg

SEQ ID NO: 6492 - DNA, 1029 bp, Diabrotica virgifera
  misc_feature (129)..(146): n is a, c, g, or t
  misc_feature (624)..(653): n is a, c, g, or t
  misc_feature (664)..(688): n is a, c, g, or t
  misc_feature (717)..(734): n is a, c, g, or t
cggggaaatatttcccccgaggtgcgaccccacgcagtccgatttattgaatgaaaaacctatatagttaaaaaatgtatagttgttctttgagaaaaacaatgtctcaaaatgaaggggaaatgcatnnnnnnnnnnnnnnnnnngcttttagacattcaacatctttttacagacaaaaagctaaacttttgaaaatggcacatacagaacctgaagagctaattactcaaaatgggactaaagattttcatgaggtaaacatatatgcaacaaataaaaataaccaactataaagtagattaataaatgtattcataaatcgtccaccagattaaggcgtgtttgggcgtgttcatgacgacgaccggtcgtcaggagtcctgtcgtcaagaccaggttgtttgcgcttactttaggacgtattaggtataccaataggcaaattcgaggtgtgcaaggtaaaaataggttatacctaaaggtcggcagggggtgtccttgtccaaatcaattaaaaatgaagtgcaatttaggtcacgagtcaaatccgcccattaatgaaagatcgccatggttcagccattttttgaaacttaatgtttggcaaattttttgctagannnnnnnnnnnnnnnnnnnnnnnnnnnnnncgaatttttgnnnnnnnnnnnnnnnnnnnnnnnnnttttgaatggggtctagaacataataaannnnnnnnnnnnnnnnnncccatgaatatttcaatttttacccgttttgttccatttaaacctggaaattttcccggaggcgcttcccggatttagaaattttttaataccaaatttaaacagaaacctttcctttggggtttggaaaatttccccccgccattattgcaatgaggcagaaggcttacataaaataattttaccacagtcccccctggggttatttcccgaaataaagaaagggaacctccttaaaaaaaaattcaacacgggcccggcccgggcctcctaactttcctcggagaattaatat

SEQ ID NO: 6493 - DNA, 1028 bp, Diabrotica virgifera
  misc_feature (828)..(845): n is a, c, g, or t
  misc_feature (883)..(906): n is a, c, g, or t
  misc_feature (992)..(1009): n is a, c, g, or t
cttgtccggatatgcagaaatggttcgattttttagctaatttttattttaattaaatatgaatgattctttggaagaattaatcaaatttgttcaactaggcagtagactggactttttagctattgctgttgaaactattctgggcttaacaggttcagatgaaggtctcaagtccttaatagagaaaccccaattacttgtctctcttattacccttctagaagataaatcagtgcctatagctaaagatgccagtatgtgtttaatgaatatttccgccaacgaaaaaggagctacagctcttgttaatttagacacaaaggaatactgtccacccctacagaggcctcctgagcatatagtcaaacaagttttaagtagtattttcaatactacaagtcgaatagctgatcagtgttgtatgatcctttccaatttatcaagaccccctcatctactacagaaaataatcgataatatagaagatagtaatcataccttcgatgacattataaatatatttaccaaagtagaatataataagagtggtgctaaactacactatttaagaccaggtttatccaatcctttcaccaaagccatagggtcaggtcatttattcttgataaagacaaatgtgttgcccagagacttttaccattcactgaaaatcaagcttcctttaaaaagaagaggtgggggcataagccactttaaagaattgctggtttgaaaaggattttcatgaatggaaattaaagtgaaaaaggataaattctgcccagggctattactacccttaacacgggaaagaagaaattcccnnnnnnnnnnnnnnnnnntaaattacccctccgagttggaggtttttacccccccnnnnnnnnnnnnnnnnnnnnnnnncccaaaaattaagggggatttttgttaaaaaaccctttccccccgtggccccccccaaaaacccaaaacacaaaaacttttatttnnnnnnnnnnnnnnnnnnctatcggtttatttaaaaa

SEQ ID NO: 6494 - DNA, 1107 bp, Diabrotica virgifera
  misc_feature (11)..(95): n is a, c, g, or t
  misc_feature (101)..(122): n is a, c, g, or t
  misc_feature (335)..(388): n is a, c, g, or t
  misc_feature (406)..(458): n is a, c, g, or t
  misc_feature (478)..(495): n is a, c, g, or t
  misc_feature (504)..(518): n is a, c, g, or t
  misc_feature (520)..(537): n is a, c, g, or t
  misc_feature (540)..(560): n is a, c, g, or t
  misc_feature (581)..(598): n is a, c, g, or t
  misc_feature (714)..(731): n is a, c, g, or t
  misc_feature (812)..(849): n is a, c, g, or t
  misc_feature (853)..(896): n is a, c, g, or t
  misc_feature (898)..(917): n is a, c, g, or t
  misc_feature (925)..(973): n is a, c, g, or t
  misc_feature (979)..(996): n is a, c, g, or t
  misc_feature (1000)..(1035): n is a, c, g, or t
  misc_feature (1040)..(1073): n is a, c, g, or t
  misc_feature (1085)..(1106): n is a, c, g, or t
ctttcgtccgnnnnnnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnggatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaattggatcaacnnnnnnnnnnnnnnnnnnnnnnnnnnnnnnnnnnnnnnnnnnnnnnnnnnnnnnccccaattatataaatcnnnnnnnnnnnnnnnnnnnnnnnnnnnnnnnnnnnnnnnnnnnnnnnnnnnnntctatagggtcttctccgcnnnnnnnnnnnnnnnnnnctttttaannnnnnnnnnnnnnncnnnnnnnnnnnnnnnnnngannnnnnnnnnnnnnnnnnnnnccctttctttcccagttttcnnnnnnnnnnnnnnnnnngattatggctacctttagaacggggaaaaataccggggggcattctaatttatatcaggggggcagggcgagaatttttttattacatacaaaaagaactggttttctataatccnnnnnnnnnnnnnnnnnncgaatttcctttattaaacctatatattttttactcaaaatatccatttttttattactaatatctttcttcatttcttcnnnnnnnnnnnnnnnnnnnnnnnnnnnnnnnnnnnnnncacnnnnnnnnnnnnnnnnnnnnnnnnnnnnnnnnnnnnnnnnnnnncnnnnnnnnnnnnnnnnnnnnttttactnnnnnnnnnnnnnnnnnnnnnnnnnnnnnnnnnnnnnnnnnnnnnnnnncccttnnnnnnnnnnnnnnnnnnttannnnnnnnnnnnnnnnnnnnnnnnnnnnnnnnnnnngcccnnnnnnnnnnnnnnnnnnnnnnnnnnnnnnnnnngattaatctatnnnnnnnnnnnnnnnnnnnnnnc

SEQ ID NO: 6495 - DNA, 163 bp, Diabrotica virgifera
actagttctagatcgcggggcggcggtccactcttttttagatttctagtgctagattgcgaggggaagtctcggatatagtgtaatctgattgggaaccctgtgccttttttttacgatgctgctgtctggcaaaacgatggggttgatccaagttattcgt

SEQ ID NO: 6496 - DNA, 554 bp, Diabrotica virgifera
  misc_feature (26)..(53): n is a, c, g, or t
atttagtttgtttttaattcaattcnnnnnnnnnnnnnnnnnnnnnnnnnnnncaaaactgttgagtaactttatacctatttggatacatttagaatcattccaaaaaaatatatgaagagtaccaaaaatgagcagtgaaaaacttacctcagagcaaaaatcatttctagaagaatgtaatttagaattttcagaaagatacactgatgcagatgttgaattcatgaaaatattcgattcagaaatacctccgccaccaattgtatcaccctggtatggtagacagagattcaacaatagggatagggacagaccaggaggaagctacaacaactacagaaatagggacacaagtcgggattatagcgaaaatcacagaggtagggagtacaggcatcatcatcaaagggatgatagggagtataggcatcctcagcaggatagatttagaccttactgaatgaatataccttgtcaatttttaattgctgtttagctcaaattgtattacctatatcgattatcaataaatatcctatattttcactttt

SEQ ID NO: 6497 - DNA, 1284 bp, Diabrotica virgifera
  misc_feature (823)..(842): n is a, c, g, or t
  misc_feature (985)..(1004): n is a, c, g, or t
  misc_feature (1067)..(1086): n is a, c, g, or t
  misc_feature (1089)..(1103): n is a, c, g, or t
  misc_feature (1107)..(1178): n is a, c, g, or t
  misc_feature (1191)..(1246): n is a, c, g, or t
gcggcaaacacatcgtctttattgggaatattgcggatagccttgattacttccgccctaccttttattacattaccatcgttgtctagaattgttgttttcaaaagcctgtcaaaggttttcctgtgtctgttagatctcaaagagtcatggtaatcttctagaactctaccctgtgtttcgtctattatttgtccaaccgttttgaaattatatactgcatttccgaagaataatactgaagaagctaactgcaatattgtcaatgctgaaggcgcctgtttatggtttatccacatatcaaagacatcgtagctggagtttatgataccaataccactgattcctatgtttgccatactaattgcattgactgctaatccaacaccctgaccaatattgactccacgtgaaattaattgtgaaacagccatatttgctcctgctccaacaaatcccaaagatcctgccacaatattaatatatattcctcgcgcttctgagttaaaaatactcaagtcttcatcatgagttatcttgtcatgcaaaccaaacgcacttctagtaatactgtaaacaccagctacagctcctacagcggctgcaccaataagaacgggaggtacgataacacttgttacagcacccgcaaacataagagtaccagatcccacaccagcaacggaactacttatatcaccaacttttagcaccgggtttagaactccacagctgggagtttctcgccttttcgagaagtactccatcattatctacttggaatcttccatttaacggaaaccccttatactttccggaaacnnnnnnnnnnnnnnnnnnnncttgccaattccaatatactcctcccccccgggaacctataaaaatttcttggaggcatcccccttcttctccttcgggcacttttctaaaaaaaataatcggggaaaggaaaataataaatatgggggatttaaattttgannnnnnnnnnnnnnnnnnnnttttggctttgaatctttgggggggtcctaaacacaaaggggactggaaaaaccattttcccnnnnnnnnnnnnnnnnnnnncgnnnnnnnnnnnnnnngggnnnnnnnnnnnnnnnnnnnnnnnnnnnnnnnnnnnnnnnnnnnnnnnnnnnnnnnnnnnnnnnnnnnnnnnncatttcccccccnnnnnnnnnnnnnnnnnnnnnnnnnnnnnnnnnnnnnnnnnnnnnnnnnnnnnnnntctctttcccctcccccctttctctttttggggggtgg

SEQ ID NO: 6498 - DNA, 702 bp, Diabrotica virgifera
  misc_feature (615)..(632): n is a, c, g, or t
  misc_feature (666)..(684): n is a, c, g, or t
tttcgtccggttagcaaaccacttggtagtgtttatactagattctaatatacatggagtgcaaactgttatgcgttgcggttgcagtggcctctattgcagttgtctcttccgacaaaagctgctggggtcacaaggttgtagcagaagtaagagagttattcccttactgcaaagatattattaccaccaactctatatctgaaaatgacggtttgaacctcgataccaaagattcttccgaggaattatgccagaatataaggaaatggttagataaatcacatagcgatttgggcaaaatatcacaatttaacatttgtatgtcactaaataatgatggacttgagttttatcaaatgaagaaagttttcgaatgccttccggtccttaacaactcagtcttcgagaaaaactccaaggaaatcgtctacgaacacatcacagatagaagagtctttagatctgtaaggatttatctgaaccaagaaaagactgaagagaaccaaaaatctgtgaatgattttctagcttgtatcggttaccaaccagatagtgtcttcaatcgtcattaagcatatttatctttaaattatatttttgcattatttaccnnnnnnnnnnnnnnnnnngtagctagtgggagatttaagaaaatgattttcnnnnnnnnnnnnnnnnnnntttatattatattttttg

SEQ ID NO: 6499 - DNA, 393 bp, Diabrotica virgifera
  misc_feature (2)..(391): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnta

SEQ ID NO: 6500 - DNA, 880 bp, Diabrotica virgifera
  misc_feature (340)..(356): n is a, c, g, or t
  misc_feature (776)..(797): n is a, c, g, or t
caggagcaaaccggaaaacaaagagaaaacccttttaaacaacggcaaaccgggcaaaaaccatagaaaggcatcaaccaccgaacgaagagaaaaccctcagctgcttttatgcgaatacagatgcaaaagcagaaatacgagacgaattcagggcacttaacattagaaatcagaaaggagtacaagaaagaaggcagagaagaccaccaaatataataccacccagaaccaacgaaatgccagtagatcaagattggggcaatgtgtggccaggtccaagatcctttcatccagcatcagtccccctcccagtccgtcaaggctatacaaaaaaagnnnnnnnnnnnnnnnnntatgcaaatgctgaactaatcaaaatacctaattttctccacttaacacctccagtaatagaaagacagtgtaaagcattgaagcagttttgtacaccttggccaaaagccttggatacagatgagaaatgcgaaaaacattttccttttgagcttacgtttagtgactattgtttctcttctccgtctataagaaatccattggctagaatagtaacactgaggtttaaattgaaatctttgaacttaaatcagagagcaaatgataagtttttaaggctagttggagataggtatgatgaagccactgatacagtgacaatagttactgataggtgtccacttaggaaggagaattatgattatgctttgtacttgattacagctctttatcatgagtcatggaatgttgaaccttgnnnnnnnnnnnnnnnnnnnnnntgatatgcaatattaccaactggcaaaagaatgcctccaaaaccaagcatttgaaaaattgtttggggacatcctaatgataa

SEQ ID NO: 6501 - DNA, 758 bp, Diabrotica virgifera
  misc_feature (160)..(183): n is a, c, g, or t
  misc_feature (344)..(363): n is a, c, g, or t
  misc_feature (645)..(645): n is a, c, g, or t
ctcaagcgattcgagaacaaaaacaagttctgataagaactgctctctgacagggcaaacgccaaaatacagaggcggctccagaattattcgaaataaagaaaagtgagaaagaagcaaggtaagctagctctcgtacgggttggggctggattgagcnnnnnnnnnnnnnnnnnnnnnnnngagacgcggaacttgtggaaactctcactaagaagaaatggaggaatttataaaggaactgcgggaaaaactagatagaatggaagatagaggaatgagaatagaagaaaagttagatgggatccaaagtgagctggaacaactaaaaaatacgaatcagnnnnnnnnnnnnnnnnnnnnacttctcaaacaagagctgcatcaacataaaaatagaatagaacaaatagaaagggatatgaagagaaaaaacctgataatacacggccttgaagaaacaagcgatgaggacacacaaatactggtaaacaaagtacaagacatcatcaacaaaatggaaataccttgcaaagccaaccaagaggtcacagaaattagaagaataggagacaaaactagaaattctaaaagaccagtcctggtagagctaagaagtgcgaatacaagaacggaaattcttanagctacatggaaaattaaaggctcgaaatggtttgttaacgaagactatcccaaaaacataatcgaacaacgccaaaacccttataaaacacctgaaagaggcaaagatgaaa

SEQ ID NO: 6502 - DNA, 924 bp, Diabrotica virgifera
  misc_feature (488)..(511): n is a, c, g, or t
  misc_feature (543)..(563): n is a, c, g, or t
tttcgtccgagtatccttccatttaaccatggcgctgaaataataaatctatggaaatacgtgacatgttttttaaagagtaaatcgaagatcgcattctaccctaccaaatcacaacacttttttctatgtcataaatttttcggaaaatggagcctgtaaagaaaatttcctttggatttagcaaaacaaataaaaaaccattgatttttaacaaatctttagataaaaaagtagattatattgtaagtttagagggccaatcagtaaaattgaaggatgaatcaaaagaagttgaaaaagctccattagttatacccttaaaggataatcagacagatctgctacaaagagttagagatatgaaagccaaacaacaaaacactaggaagaatagtaatgatccagttgaagaagacaacagacctgattctgacttaacaatagaagaattggcagctcgagagatagtaaaagaggcaaaacannnnnnnnnnnnnnnnnnnnnnnntggcagtaaaaattttgttatcttcacaaagnnnnnnnnnnnnnnnnnnnnngaaggtaagatggaatcaacgttggtcgattatgaaaatattccagtgaatgagtattggaaaaaatacagtcaagacttcagctgtgaaagcaccagatctgagacctaaaggattgggattaggagcacgtgttttaattaattctgaaacttcattacagccagttatagataacaacggccaagcactggtattaaaaaaaggctgttatgcaagaataatcgctggtaataacaaaggaagttactgtgaagttcaaggactagatgatgaagctggaagggtgggtgtttaaacctcccttaaagagtaacatattgaccctaaatgaatttatgctggttgctgttacaaagga

SEQ ID NO: 6503 - DNA, 912 bp, Diabrotica virgifera
  misc_feature (72)..(72): n is a, c, g, or t
  misc_feature (303)..(303): n is a, c, g, or t
  misc_feature (329)..(329): n is a, c, g, or t
acaaggaaggagaagacaagaccccacccaaggaggaaaaacccgacgacaaacgcaggacttttaggaganggccgccccccggagaaaaaggacgaggcaggaagcgacagaaaccggaaccgcgaccaagacccagccccaaaaatacccacgacgcagacagcgccaaaccactacgcggacaaagccaacagaaacgacaaccccagcaaggggaaaggagccagcagaagcacataccccagaaaaacagagcgggagaacaccgacaagaagagcaaaagaacacaaaccagagcnggaaccaaaaccacagacaacaacgnggacaaacaccggcgaaccagccacaggaaaacacgaagacccgcaaaaggacaacaagaagacgaaagcccctgaagaaaacgagaacacccaactgctcgaagaagttaccgatcaaaaagaaatgatcaaccaaagatgggcgtcaatgatggaaagaaaacaaccaatcactgaagacgttcactctccgcaagatctgatcacccaacagaacgaaaaacttattgagacagttagcttaaccatcaaaatgccggtaacgggaagttgaactgtagattgatgaaaggacaagaccttccccgccccttgtttaccactaaaatttggttaccaacaagttcatggaataaatggacagttatactaacaaacgcctcttcatgagttggccaaaccaaaaaataagctgaagacgcgacaattccctttcaaagaaggatgtttattcacactattttttaaatattagaccaaccataggacccccaaggtttgcaccactcacactttcctaagggaacactttcaggaattgttccaacaaagaagaagttttccccccggaactcctcctcc

SEQ ID NO: 6504 - DNA, 685 bp, Diabrotica virgifera
  misc_feature (71)..(90): n is a, c, g, or t
  misc_feature (147)..(167): n is a, c, g, or t
  misc_feature (170)..(184): n is a, c, g, or t
cccctaagcactatcataataacaatatcctcctattttttaattcttgctttagcttatgcaattgaacnnnnnnnnnnnnnnnnnnnncccagaaatttcctatttgttattttactaaattgaaaatctttaatatctaaaagnnnnnnnnnnnnnnnnnnnnncannnnnnnnnnnnnnngcggaaaatatataagcgggggtttatttaaaaaccccttcactttactaacccggaaaattcggtttttcccccaacatattaattattagtcctaatttccatttcagctttttcagggtgggaatgggtcaggcctattttcctcctggctattaattctttatctccacttccaaacatttaaggggggccatactaaacgcctctaccccttcgaaaccggggatgccacccctattgcacagcttcggcccgcaacattaaactctcggaacgcgacactttatttcttcttttaagtggcaacaacaaccgatctttttttcacccccaaccccctcgatcgcgaatttcacccccccccctaaaaagggcccgacttccttcttccttccccgtccccctcgccccacaaccggtcccccccccccgctcccttctctctcacccctttcccccccatctacaccccagggggggtttttcctctaatccccc

SEQ ID NO: 6505 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6506 - DNA, 609 bp, Diabrotica virgifera
  misc_feature (106)..(120): n is a, c, g, or t
tttgtcgtccgaccttacttaacttgtagtctctcaatgatttttcaacccgttcaccaataccaaacaaacctgtagcctgtagccgccagaactaagtggtcannnnnnnnnnnnnnncaacactatcagcgattataaagaattatttgtacatgaaatctcaaaagacgctgcttttgttgcaacgcatctgtttaaacaaaaaataatctaccgcttttctttaatagtatatatgtcgtgagatgcaacacgtgtaagacattgtgaaaattcaaaagctgtagtaaaccgctacatttgtttatctttgcatatttttgttattcaccaagtttgcgcgtccaagcgtttgtggtaaacagtggtaccttaacggtttctgggtcattgcattcccaaactaaaccatggctcacctacaccacaacttcgacatgatcgaagatgagtcctgacggggggaaacctagaaagaagcagtcatgtctgcgacaaaaagcccttcaccatagccacaatgctaggaatcatttctcggggcagccgtcgctatcattctctcatactccacggaaaaatggacagagcgagaaattgtatata

SEQ ID NO: 6507 - DNA, 86 bp, Diabrotica virgifera
  misc_feature (7)..(71): n is a, c, g, or t
ggggtgnnnnnnnnnnnnnnnnnnnnnnnnnnnnnnnnnnnnnnnnnnnnnnnnnnnnnnnnnnnnnnnnntcccacttttttttt

SEQ ID NO: 6508 - DNA, 570 bp, Diabrotica virgifera
agccgatggataagactatggctgctactctttaacggcttccaggcggactgttgatattaggataatatttcttgtgaagagagagctcctactgttaaaggaggttattatcctattatgaatctccaaggtatatgtcgaagctctgccaccaaactggatgctgagaacactgacctgactaaatatttgttcctcatgattgaatactgcaaaaataaccgagactacactctgctctaacgcttaacatgctctgacatacgatatgcccaccggattcatagctgatttctttccgcattctccgatgcatactgctcacttttgtacatctcctacaccaaccactaatgcggtaagaatattgcgctctatgcgaatatatgtgataataactgtcgctgcgaggaacacatgattgctattggtacagtatcctctaaatgctatgaagatatagattctgtacgcaggagaatatgaagacattctgctgaattgcatcatccatatgaagatggagaggattgtggatatggataaactctaacgaaaagttcaacg

SEQ ID NO: 6509 - DNA, 850 bp, Diabrotica virgifera
ttcatccggatttgcggttgttgtgttgaaccacgtacgtacattcttcagccaggaaatccttcgccttcctggtcatcgttttccttctacttttccctgtaaaattaggtacagcagtccatatatctcgctgttcctcatcatgtgaccaagcctttagattttggctgtttttattgtggttaccacgttgacggacagaacgtctatagacgtctaatttccattgatgtaatgtgacacaacgtttatagacgttgcattttccctattctactttgcaaaatacataatatatggtcacaacaattgcttatacatttgacgtactgtccgtcaacgtgttaacagctctttttctttttgcatactcaacaccctggttagttacgtgatcggtataagatatcttcaggattcgacgataaagccacatttcgaaagcctcaatttttcaaaaccagagttgttgaattaattgtaactaattagtgtaaatcggaaccaaaatggagcagctgaacagagacacaaagacacaggtgaggatctcggcacaggtggctgcgctcatcaacaacaagctgcgcttgtttcagcgaaaatctagatgtgatacctgcctatcgataaggcacatcattcaacccggatctatccactgttggatataggtctccctcggtcttttccatgcatttctgtttgtttgcatctaatttttgtcgatccgttttatgacatcaggccaactggttagcgaacggcctctacctcgatatgcttcttgtcttggtctccagtgtattattcgctgtgtccatctgttatccgacattctagctat

SEQ ID NO: 6510 - DNA, 716 bp, Diabrotica virgifera
  misc_feature (663)..(685): n is a, c, g, or t
  misc_feature (695)..(715): n is a, c, g, or t
gtggaatgaatataacggatgttacaaccgcatttgacatatgggattgtgtaaaaactgaagacaatgttggattcagtttaccagcttggaccaaatctatatatcccgagcctcttcggaccacgattggaaaattttttgaagtttttacatacacgactaacatgaaacgaattataattgggccatttttaaatgaagttgttgaatacttagaatcaatggctgcaaattctagctcttctcacaaatacaaaatgtatagtgcgcacgaatcaaatatgggagcaattttaaatgcatttggtgcctttaaccctagctctcctccagcgtttgcatcgacagtttatatagaactacataaggaaaactggaagtacacagtaaaagtgtttaataaagaactggacaatatcagacaggtcagcgttaacggttgtgacttaaattgtcctttagatagctttaaagaaaatttaagtgattttattattgatgctgatactagggatacggaatgcaatagtgtagaggagaaaaaactgcttgcaggaagtgcagctgctacaattggaaaatattctgccgaagaacttgaacaaaaatttgcaggtttttccacataaaaatgtaaatttggattatttaattccaacnnnnnnnnnnnnnnnnnnnnnnntaaatacccnnnnnnnnnnnnnnnnnnnnnc

SEQ ID NO: 6511 - DNA, 837 bp, Diabrotica virgifera
  misc_feature (643)..(643): n is a, c, g, or t
  misc_feature (730)..(781): n is a, c, g, or t
  misc_feature (790)..(807): n is a, c, g, or t
cgacgaccggtttcgctctctataatatgcagagtaccttcaggtcaacggtaacaagttactaaatgctacaaataaaacccagagatagaacaatgtctggttgtaaaatatgctaaagatccataagatcaagccaatattgaacaacatacataaaagtagttaagacagcagacaaatagtccgtcagctattacttttcccgggcggtacgattcattttcaatcaaattgagtcaaaacataaattgaaacgaacgtcggtgtgtatatacattttgtatactgtatactatatacctactacacacatcggcgtacgtttcactttctgttttgacttggtttgatttaaaatgggtcgtaccgcgtgggaaagttatagcaaacggactgtacatatgcatgtacaatcgggagcggcaacaaacgtcccccaagcataacatgtacatgcacatgtatgccgtctgtaatcatgcaatgataacgtatcgtacttacattcggctacaaggagctacttcatgactattcattaacatgatatcttgctcaagttatgctaacgggatatggtggagtagacggagaatgttttaaaggttaacagatttatgaaaattcttgagggaggtgngataattggtgagagacagccaaaaaatatgtgcctgtgatgtagactgaagtgaatgtgttatatactatttttatatgtgatggnnnnnnnnnnnnnnnnnnnnnnnnnnnnnnnnnnnnnnnnnnnnnnnnnnnnaagatttcnnnnnnnnnnnnnnnnnngatgtgttggtgcaaggaagtacaatgaat

SEQ ID NO: 6512 - DNA, 699 bp, Diabrotica virgifera
atttcttatgagtgatcccattgttcgtttactgttgttccaagatgggtatactcttttactcgatccactggtgtattcttgataagcagttgggcgtctctaattttatttttgctgatgaccataaatttagtttttgatatatttacttgtagtccaaatctttcacttacttcatttagtttattacttgctgtaaactgttcaaactttctgcaaaaataacagtgtcgtctgcatagcggatgttgtttaggcgttcttcatttaggagtactccatgttcgcaattttccaaggcttcactaaatatttcctttgaatataggttaaataatataggtgaaagtatacatccttgtctaacgcctcgtagaatctggatcgcttccgttagttcatctccaagatttgatagatacctaaaccagttgacacaaaatgctcacttacacgtttacatgacaaggcatactggaaaaagaccttttgcatgtaaaaactgcatcaggctattatcaacaactactccattaaaagaacacatgaaaacacacactgcaagcagcacataatgtgaaaactaatacatagtatcggttttatacatatacatatgaaaacgtatttattcgctgtgtgcgagaaacgatcgtgcgcgagtcgcggagaaatattgtaactaaataatttata

SEQ ID NO: 6513 - DNA, 340 bp, Diabrotica virgifera
ttgagacttaataagaccaagatagcgatccacaatgtacattcatcgaggtatctaaatcgaggcagggggactagacatgaacgtcattcctgcctgcatagagggcacttaccggaaaaggcgctgttcgttcctatattacatccatcgtctcgaagaggatcatcctgaccttgaacaacattatgatccaacggcttcttatgacgggaatggtaaagacccagatgacaagccctcgtaacgacatgatcgattcgaatagactggggaccacatgcgctgcggcggcaacctctaccagcaacaactctgtttgtgctcctacgatctgccc

SEQ ID NO: 6514 - DNA, 942 bp, Diabrotica virgifera
  misc_feature (577)..(597): n is a, c, g, or t
  misc_feature (907)..(928): n is a, c, g, or t
ttaaggaaaaagattacacaattcgtggaattatcctaagatgtcaacaccgtttagacatggaacaaagtattaccaattccgaaacacagggcttcaagatcaaggtattatatatacaatggataaattagatgatgaagggaagatatttttaaatccaaatacattttctgaagatggtacagttgcattgtcaggaacatcattctctgaagatggcaaaacgtttgcttatggtttaagttctagtggatctgactgggttgaaattaaatttaggaacgtagaaacgggtacggatcatgatgaaatcctcaagaaagtgaaatattctccaatggcttggatgcatgataatataggtttcttttatgggggatacttacaccaaactggtaagactgatggttctgaaaccaaatctagtgaataccaaaaactttattatcataggttaggaactgatcagtctaaggatgttatggctgtggaatttgatgatcatcaacttagaatgggtgctcatgtgagtcactgtggagactacttaattgtaaccccaattaaagggtgnnnnnnnnnnnnnnnnnnnnnctcaaagtttaatagaactagaacaattacaggcaaactagaccttactcctatagtcacatcattcgaagccgactatgagtatgtgaccaatgtggacaccaaattctatttccgtacaaacaaaaacgcaccaaaactataggataatagttatagatcttggaaatccagctgaaaaatactggacggaaccgattccctgaacacccaaagggaggggttagattggggttctattggtaaacaaaaatatgctggaaagtttgctatctcaggggaggtaaaaaaaggccttgagcaattatannnnnnnnnnnnnnnnnnnnnnaagatccccccatt

SEQ ID NO: 6515 - DNA, 542 bp, Diabrotica virgifera
tttcgtccgcaaaaaatagtaatcgatccagaaacgaatcagtctagctgtggaagttaaaataggagaaaaaatagttactttgaaagccaaaaaagaaattattctctcagcgggcgccattaactcaccccaagttttaatgttgtctggattgggacccaaagaacacctccaagaattaggtatacctgttatcaagaatttgccggttggatataatttggaagaccatgtaatacatataggatttgacgtccgcctaaaagtagagtcgcttctaatacccaataagctgggcacgatatgcaagtatttcaggcacaacgaaggagaattagctggaatccgtatcgacgaacttattcaaacttcatacatacccagaacgattccgcatatccaaacatttgttaccattatttcttttgcccaccttttgatccttaattacttcctgaaatggctaaagttcccgggtcttaccgatgacatatccttaagtaaaaaagatgcccgcatatagtagaaccatttctttc

SEQ ID NO: 6516 - DNA, 813 bp, Diabrotica virgifera
atctcgaatatagatgggactaccaatacactggaggtctactgttggaagaacggatagactttggtgccaaaacgggtctcagcaacgcaaaatttacctacgactatgacaataattatagacttataactgcccaaggcagaatcggtggtcaaaacttgccccagcataatttggggtacaaccataagactgggtctttagagatgataggaccttttaaaataatcaaactaagaattaacgaaaccaacgtttatgatggtacggctttattttccagtactgttaactctaggttattggagaccagagttgccttaactattcatggaatggaagtgtttagaatggagtttagtcatgatatacacgggaggatatctcaaacccgtacttatacaaagaacgtaggtgttaatacatacacaaacgtgaagaactacacttgggattgtgatggtcaactacttggagttgaagctcaagagccatggggattccgatacgacgataatggcaacatgttatcattaacttataggggtaacacaattccgatggagtacaacccaatggacaggattatcaaattcggtgaaggacagtacaaatatgacagtagaggattggtaatacaaaacgcaagagaagaaaagttccattacaattccaaaggtttacttattcgtgcaacaaaacgaggaagattcgatgttcggtattattatgaccacatggacagatttatctgcagaaaggataattttggcaacgtgacgcaatttttctacacacacgccctaaatc

SEQ ID NO: 6517 - DNA, 708 bp, Diabrotica virgifera
gtagaaaatgaatcgttgtacgaagtgtaacataaactttacaaaatattataacatgagggcacatgcaaaaagaaaacatccagatatgctagatatactactgccaaataacgttcaacaaagtaaatctactgttccttgcttagaatgtaataaaaagttttcaaatctgggcaatcttagacttcatgtgaaaaggcagcatccagataaattagacgaaatagcacctgttaacaagaaaacttatgtgtgttccagctgctctgaaagttttcacaatttaaaaaaactagtttctcataaacaaactcataataatgccttaacaaaattaaagtgcacgttgtgtcaatataataattctggtcgagaaaatttaattttacattataggagtgaccatttcattaacattgaaaataattatctggaatttgatacttttgaagattttgaatcatggaaatgcaaggttgaagaagaaacattctcatcatttgtaaaaatgtatggttcaaagaaaaccagtaactgcaccacaacaaactatagttgtcataggtcgggtatatattaaaagaaagggaatgatatcaggaaacttaaaattccaggctcaaataaaattaatggttattgtcctgcaagaattaatgttaaattaatgggaccatgaaaaatatattggccaactttttgtca

SEQ ID NO: 6518 - DNA, 553 bp, Diabrotica virgifera
agagactatataatcactgtgttagaatattagatgctcttgaagcgagagctttactctttaatccatttatgaagaaaaccgtgctaacggcttgaaatttttggagatcgcgcccacccaagtatacctaacacaaggagctcacagaatggccaaaaacacttcctttcctacccagattcttgaatgagattgtatgatgtgatgcacacatccaaggaatataccccactctacaaatattcacattggagatagtcatggagcttgccaacggtaccgacactgataagattctgcttatgcacggtgatgaaggaggagcttttgactgagtcgacataagtctcttgaacacaatctcaaccgatgattacgccacgactggaacatggttcgacacaccacataaagaagcatccttctataggaacgtgaatatagcattaccaactgccagaataccaggcaatgatcctcctcacaacaccagcaagattgattccaatgcttactgcgaatactacttgtgaaaatgagactgtcaatg

SEQ ID NO: 6519 - DNA, 1236 bp, Diabrotica virgifera
  misc_feature (744)..(762): n is a, c, g, or t
  misc_feature (778)..(778): n is a, c, g, or t
  misc_feature (792)..(809): n is a, c, g, or t
  misc_feature (845)..(873): n is a, c, g, or t
  misc_feature (1050)..(1066): n is a, c, g, or t
  misc_feature (1068)..(1084): n is a, c, g, or t
  misc_feature (1154)..(1175): n is a, c, g, or t
aatccagttgcgaaaaatttagaaaataattatcttaggagttgcagagaaatcttagaagctggaaacaataagtcaggtgtatacgtaatcaaacctagaacaagtaacaagccgtttgcagttttgtgcgatatggaaactaaaggaggtggctggactcatatccagaaaagatttgacggatctcaagatttctatctaccttggagagattacaagttcggctttggtgatcttaatgttgaattttggataggacttgaaaatatttatcacatgacagcattcgatagaaacgaacttcttgtagaggtaacagagacgaacaaaaatattagttatgcaaaatactcatcattctcaatcggttctgaaatggacggctatccactaaaagaacttacaggatactcaggaaatgctggggatggtctagccaatcacattggtttaaagtttacaacagttgatgtggatcaagataaatcctctgggaattgtgctcaaatttttgagggtgcttggtggtataataactgccatagcagcaatcttaatggaaaatttatgacagtagtacttcctgaagcatataaagcacatggtcttaactggcatcctctaaaaaggagaccatgtaaatttggctggttcccagaatgatgattaaggccaatcggagaataaataatttactaattaaagaatatatgtacatcaccaaacgtgtgcctctgtggnnnnnnnnnnnnnnnnnnnctattatgcatttttnccaccaaacacaannnnnnnnnnnnnnnnnncaggacaaacacagaactttacacaattaaataccnnnnnnnnnnnnnnnnnnnnnnnnnnnnntccaaggaacccaaatttacatttagcgggggtgggcaaggcaatttctttttatttggggcccaaaaattatattttctgggcgggcggttttaaaacgcgggggagtggggaaaaaccccgggggttcccccatttttttcccttttggccactccccccctttctcccgtgggnnnnnnnnnnnnnnnnngnnnnnnnnnnnnnnnnntttccccacaaattggccacccgttaaggggaaaggggggcgcccccccgttcagggcctctttaacacnnnnnnnnnnnnnnnnnnnnnnttcccccctgtagacacacccatcaccttcttgccctccccctctcacctgcccccccccc

SEQ ID NO: 6520 - DNA, 832 bp, Diabrotica virgifera
  misc_feature (596)..(618): n is a, c, g, or t
  misc_feature (658)..(675): n is a, c, g, or t
  misc_feature (680)..(702): n is a, c, g, or t
  misc_feature (765)..(786): n is a, c, g, or t
cgtccggtaccgacaccgactatgaatacggagcataatgtaaaaatgtaaattataatttaattattgtaaacacagcatttgtccattgtaatattttgtaaatgtaatgtaaagttgtaaagtgtgttccttattattccatagggaattgtagtgatttcactttgtgtgtgtgttaattattattaatgaattacataaaattaagtgtaataaaatggaggtaaaacaagagattagtgatgattcctgtaaagtagaaacagagtataatgacttggatgatgcccttttggttttggatggcttcaaatgtgaacttaaacttaaagaggaatccagtgggctaagtacacgtggcacttatgattatttagacttgaaggaacattccataaaaactgaaatagaaaaacttgggagcaaacttagcccatttgaaaaaaaccaccaaaatgaaacagattttctccaagacaccaaaatggaaatcatggaaacactacctgaacattcatcgcacgaagcaaattatacaaatcctcatgctgaagcaaaaacattaactaaatacatgaacgaaagaccttacnnnnnnnnnnnnnnnnnnnnnnngtttagtgaagcaagtcgtttagaagtacatttgagagtnnnnnnnnnnnnnnnnnnctatnnnnnnnnnnnnnnnnnnnnnnngtttactcaaccaggtattttaaaaagacatttgttagtgcacactggaggaaaaacgcaacnnnnnnnnnnnnnnnnnnnnnngtttaatctagcaagttatctaaaaaaacatatgagagtgcacact

SEQ ID NO: 6521 - DNA, 661 bp, Diabrotica virgifera
  misc_feature (2)..(23): n is a, c, g, or t
cnnnnnnnnnnnnnnnnnnnnnncagattttcattttacattaacttaacgttacttggtaaattaacattacttattttcagtccattgctgcctaaaaaactatattatgtttctagtgttttggtcttactaacattcgagttccatataaaaagtatccatctggagatgaaattttgtccccagttcataccttttcgctttatttcttcgaagtgtttcatatttcgatgttgtccattaggattgctggcataacagttgttataccaccaaccacccattgagaagtttgcacaattatcctgaggccatttatcctgatccagatccttggtggtaaacttttgccccaaatgatagtccctattatctcctgcagtgccactataaaggcgaggcacttttaaaaatgaaaccatctagttctggtccattccaaaaaccgtcccatacttccatagaacttttaatcgtttttcggctgttaaattctacccggagctccctaacctccaatgctgggagatagaaattgtttcaaggcccatccaaaatcccccttcccagtttccaaatccaatttgaaaatcgggcccaatctcgaaaaaatcttcggacccctcaattcggtttgaatggggggcccacccccccc

SEQ ID NO: 6522 - DNA, 917 bp, Diabrotica virgifera
  misc_feature (519)..(553): n is a, c, g, or t
cgtaatgggttaaacaaatcccaaaaaggatataattaattgtaattagtacgaaataattaaaaatgaccactgaagaacaaactcaacaatctgttacagcggaagacgcgaaaatagccgaaaaatataagtccgaagctaatgaatactttaaaaaacaagatttcgataatgcaatagaactttataccaaagcaattgaaaagaatcccactgtagctatttattatgcaaaccgtagctttgcatatctaaaaactgaatgttttggctatgctttaacagatgcctcgaaatcagtagaattagataaaacttatgtgaaaggttactatcgacgagctgctgctcacatgtcattaggaaaatttaaggaagccctaaaggattatgaatatgtaactaaagtgagaccaaatgataaagacgctaaaatgaagtatatggaatgcaacaaagtagtcaaaaaattggcatttgaaaaagccatagcagttgaagacaataagaaaaatnnnnnnnnnnnnnnnnnnnnnnnnnnnnnnnnnnnagaaaatgaatatacagggcctgaattagaggatggtaaagtgacacttaattttatgaaagaacttatggaattgtataaaaaccaaggaaaacttcatagaaaatacgcctatacgatattattagatataagatcatattttacaaaacaacccaccttagtagatgtaccaatcggcgatgaagacaaatttacagtatgcggtgacattcatgggcagttttatgatctaatgaatatatttgaactgaacggcctcccgtcgggaaacgaatccgtacctggttttatgggagaattcgtccgatcgagggtccttctctgtaaaaaggatatttactcctattcggttttaactttt

SEQ ID NO: 6523 - DNA, 515 bp, Diabrotica virgifera
tttcgtccgagaccgcaatgaagctcgttaaaataatttttgacggtcgccatcgaatgaaaagtgtcaccgtacacagtattcaagcgattttttatttcgctgcggaatttcgcttccaaaaataagagtcgaatcaccatccgatattgctcttttttcattcggctgggagtttgatatagatagacggtctacaagaatgtattatttacatgatagtagatttctcttgcgatcagggccggatataaggggggcaggctgggcagctacccggggcccccacatttcgggggcccccacaaagcctcacacataaggtgttcatttaaacagatattggaaggaaatacagggactcgaccatgtatgacaaaagtataaaaggaaaaggaaggagcgtaggagtgacataatacatttgttcatggtaatgtttttcacctttcctcgggtgagtgtattgcctcgtctgtaaatttattatcaagtgttcctacctcctttttagc

SEQ ID NO: 6524 - DNA, 72 bp, Diabrotica virgifera
  misc_feature (9)..(55): n is a, c, g, or t
tttcggccnnnnnnnnnnnnnnnnnnnnnnnnnnnnnnnnnnnnnnnnnnnnnnntaaagatttatcaagcc

SEQ ID NO: 6525 - DNA, 379 bp, Diabrotica virgifera
  misc_feature (311)..(330): n is a, c, g, or t
cttgtttccagctacttcctgatctacaagttgttggggaacaacacgaccttgttgaacaaaaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtctctcaagaacaacagttgagcttgagacagccacaaatctaccaaagagtaccacgtgtgtactaaattttgttttcnnnnnnnnnnnnnnnnnnnngttttcatgttaattttgattgttgttttcgaataaatgattatctgtt

SEQ ID NO: 6526 - DNA, 1023 bp, Diabrotica virgifera
  misc_feature (43)..(43): n is a, c, g, or t
cggggaaatttcccccgggttcgacccttaaagaccgtacatngtacaagatatacggcgacccaactcctgctgtagactggatcaataatggacttataatcgaacgagaccctaggaaagacaaacacaaaatatctttacatgttactctaaaccatcgagtggttatacttggaataacttgactatcgttaatttaaattacaaagacaaaggagagtataagtgtatcgctaagaatcctggtggatatactgaaagaaatattactctagatatccttccaggggctctaactggtggtggaattgttggaacgctatcaaccagcacaactctcgtaattggacttacagttggccttattatacttctatttcttgtgctgattgcgctattctgcttttgcagaagaagtacccatggattttatttttttagaagacccaatgctactacgtcagaggaatacataaatatgagcactggacaagcggagattaagaaagggcttattacagatgttaatccagttaccaaaccgcctcgtacatcagtttcgccgtcagttgttagtggaggtactgaagtcagcgatgttaagaagactttattggataacgaatctgtttttgatggcgatgaagattctcgatcctttgatttcgaccagccccatcgaaaaggtcaaattatgctggacactggacctaatcattacccaccagatctactaccatttcctcctaggttgggtcaggtctcaccctgctggaagttctgcatctactgttgcagatacaacccgtctttcaccaaactcatgggcccgcagtctcctcttccaagtccaatctacgatcaactgaatcttttaccgtactttgccctactccagaatcccttctccgtttggaggacccccaggttagaatacctccaaacgggataacgttaacaatcccaagaaggtccaagaaatgaaaagttggaagttctgaacccccccaagggtggggg

SEQ ID NO: 6527 - DNA, 1195 bp, Diabrotica virgifera
  misc_feature (216)..(238): n is a, c, g, or t
  misc_feature (321)..(463): n is a, c, g, or t
  misc_feature (544)..(612): n is a, c, g, or t
  misc_feature (880)..(909): n is a, c, g, or t
  misc_feature (975)..(994): n is a, c, g, or t
  misc_feature (1026)..(1049): n is a, c, g, or t
  misc_feature (1056)..(1076): n is a, c, g, or t
  misc_feature (1082)..(1102): n is a, c, g, or t
  misc_feature (1159)..(1190): n is a, c, g, or t
acttgtgttaatcaatgtgatatgggattctcaaaaatagctaacagatggaactcagataggacaataaagtttagttcagttgtacctataagtcacacccgtgcttatgaaatttcaaatctttggaatataaaaataaacaagaaagtgatgcagcatatgtatcgattgtagaagaaataaatattgttggttttaaaactcaagaagtcnnnnnnnnnnnnnnnnnnnnnnncgacatatagacaagaaataaaaaatcaatgaatcgaagaaatcgggagcagcgagagtttttcttcttaaaatccattgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatatagacaagaaataaaaaatcaatgaatcgaagaaatcgggagcagcgagagtttttcttcttaaaatccattgtcnnnnnnnnnnnnnnnnnnnnnnnnnnnnnnnnnnnnnnnnnnnnnnnnnnnnnnnnnnnnnnnnnnnnnctgtgagccgataagtagaggggatttgacaattttcgtcagcgttgttagtggcagttttgtgtgcagtgaatttgaacaattttatcaaaaaagtacaagtttcaaaccgcgagagtgcgctaccgacgaaactcacagccaaaaaaaacagaggtaacctctaaatgtcacataaacttcttctttttctcaacggcctccttgggtaagcagtcatccagtcgcacgaatttatatacctattaaatattaaagttataatgannnnnnnnnnnnnnnnnnnnnnnnnnnnnntattatttctgtgtattcgtttagtaaaccaggttacaaaaatattttaggtcctaatttggggtnnnnnnnnnnnnnnnnnnnnttttctccgttccttaatttccactaccccannnnnnnnnnnnnnnnnnnnnnnncaaaccnnnnnnnnnnnnnnnnnnnnncccccnnnnnnnnnnnnnnnnnnnnncccgtttgaataattttttaaagggtaaccttttggggtcctaaaatacaagaaacnnnnnnnnnnnnnnnnnnnnnnnnnnnnnnnnaacaa

SEQ ID NO: 6528 - DNA, 160 bp, Diabrotica virgifera
  misc_feature (25)..(38): n is a, c, g, or t
  misc_feature (41)..(63): n is a, c, g, or t
  misc_feature (71)..(93): n is a, c, g, or t
  misc_feature (123)..(154): n is a, c, g, or t
aaaccggtgtgagccaggttggttnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6529 - DNA, 626 bp, Diabrotica virgifera
  misc_feature (453)..(471): n is a, c, g, or t
ccaaaatctggccagcaccttgagaagtgaacaaaaactgaacctcgacagctttgaaacgaattccaaatccggcaacagcgaagcagcactaagagcttggttgatcggagtgtccgtggtcttggggatcttggtcttgcttttactaatcactttaatactaaaaaccagacagttaagtaacagaattaaaaaactaactaccccccaatttggttctcaagagtctggacttaacaggatgggcataaatgcacccaccaccaacaagcatgccatcgaaggaacaaatccagtatacaataataacgaaatcaagaagccaaaaaatatgaacgattttgatactcacagcataagaagcggtgattctgatttggttggaatagaaaacaacccagagtttgactacaacttcaacactaacgaggataaaactacatatctctnnnnnnnnnnnnnnnnnnncttatgtctagcttaagttggtcttaatagatattaatgtaatctgatttaactataattgtattataagtattaaatatgtataaaataaacacttattagatacaactattcaaaatagatcttgtaccacgtattactaaaattaatattat

SEQ ID NO: 6530 - DNA, 824 bp, Diabrotica virgifera
  misc_feature (122)..(143): n is a, c, g, or t
  misc_feature (271)..(289): n is a, c, g, or t
gaaatacacaaaaatctagtcagagcagactttttcaatgatctaaaagatcattggagcaaagatgaaaaactatcaagtccagatgtagaaataattacagaaccttttaaagtgtgtgnnnnnnnnnnnnnnnnnnnnnncgaagatgtgttggataatgttaggcaggaatttaatgaactcgactggaatatgaggaatatggacctgtatgagttttttcagtctaaggatttgaaatatttaagttctgactatattaatgccnnnnnnnnnnnnnnnnnnngggaagccatggaatgggtagctaatctcactggctatagtctgacgcatatatcagccacgtgtagtttatacagtaacaccgattacctcctagttcacgatgaccaaagagaagacagaatggttgcttttgtgttatatttgacaggtaaaaatggttggaatgaaagtaaaggcggagcattacagctattcaacaagagtgaaacagatcaaccacaagtttgtgttcgtaatatatttcctgcaaataatcagctggtgttgtttccagtcacgagtgattcctatcaccaggaagctgaagtgaccgaccatagacgactgcagacttagtataaattggggtgggtccattgtaaaaaatacccccggttttaaagcttccatcttaaccattccccttaacaacggttggtccaggtaaaaattctattcaaagccaaaaaaagtgatatctggactaaaggtcctggtcctcccacagatatttttaattcacaatgcctcaagaaacgtaaaaaccccttacc

SEQ ID NO: 6531 - DNA, 432 bp, Diabrotica virgifera
  misc_feature (353)..(378): n is a, c, g, or t
caaaaggagaaacaacacctaggccgaatattaacagaccaggtaatcaaagacaaaccggataccaacaatatggaggatatccacaaaccaacaaaccaagctcggggacttccatatcagacaaaatcactagcggccttaaatccatagggctattctgtgttgtcttggtgtataccaggttatttagtatatgaaaatagatttgtataaatttaccaaactaatatacttaaattctacaaaaattcccggctataaatgtggattttttaataaactgcgtgtcaagtaaaagaagagatagtactgctagggaattcattttgtactccatgcatgatccatcnnnnnnnnnnnnnnnnnnnnnnnnnntaaaaagactaaatccgtttataattatgtaaattaataaagatattatattat

SEQ ID NO: 6532 - DNA, 1066 bp, Diabrotica virgifera
  misc_feature (726)..(741): n is a, c, g, or t
  misc_feature (861)..(887): n is a, c, g, or t
  misc_feature (1016)..(1054): n is a, c, g, or t
ttgatatttttcataatacaaaaacaagatagacgtattatatattactaaaaatcatgttcaatcaaagtgaagtaaaagaagaagttggtgaaacgacttgcaaaagagaaatagataatgaagtagatgaagttctagaggacacctgtaaaatcgaaattaaggatgaacctatcagggaaagtacaaatgatacatttgattatttagaggttaagaaatgtcctataaaagctgaaatcaaacaagatgatggtttttcttgtaatgacatgaaaactgctgccagtaacctcgtaacacatcatgctagaactgacagtaattttaagcagtatataacttccactaccaatgtgaacactgaaggacaacgttttatatgtatcatttgcaagaaaccattgtcaagtaattctcgtttagaactacatataaggatacacactgggaaaaaacctttcgcatgtgaaattttgcacccaaacagttttcaaccaagggtaatttaaaagcacatatgaacagtgcataccttatgaaaaaccattcaagtgtgaaaatatgcgcccaaacaattttccatcaaaggggaattttgaaaagcacatatgatagtgcatccctggtgaaattttttagtgcatcaaaatcctttgaatgggaaattttgcaataaaaaagtttccacgaaaacccagttttaaatttgattaggaaagnnnnnnnnnnnnnnnnaaatcttttaattgggaaaatttgcgaaaaaaagtttttccccttaaaacccctttttaaaattcccaaaaaaagaaattctattgggggaaaaaacctttttgaaggggaaattttgcnnnnnnnnnnnnnnnnnnnnnnnnnnntttgaaatttggtttgggaagggggccccctggggggaaaaaacctttttttaagggggaatttttccccaacacagtttttcctataaaaaagtttttacattccctttttgaggggggatttctggnnnnnnnnnnnnnnnnnnnnnnnnnnnnnnnnnnnnnnngggtgtctcccc

SEQ ID NO: 6533 - DNA, 745 bp, Diabrotica virgifera
  misc_feature (3)..(33): n is a, c, g, or t
  misc_feature (196)..(214): n is a, c, g, or t
tgnnnnnnnnnnnnnnnnnnnnnnnnnnnnnnngttttgtgtttagcacttttagcagttaacaatttacagtaaaatgagcgataacgaaagttgtaataaagatgaatctgaagagaattctgatgataatcttcacattgcaattgaaagtccaagtcgtaagagaaagccttctccagttcccacagagtcnnnnnnnnnnnnnnnnnnntatatagaagatgaattggaacacaaacttgaagaaaaagctgcaaaaagcaatttaaatgtgacaaacgttaaaaatatcattaaacatgtacttacaagtgaagatgtattaaacctaattaaagatgcagaaggttcaaaaagtggtgagaacatttctcctctttttgaactcaaatggacacgatcaaaagtgaaggaattatcttcagcatccggattaccgttacctcctgtaaacttgacagcaccaaaaccagcatctgaagttcaggttttatttactgaagagttacaggaagattcttctggagatgaatatattcctggcatgggtgatgaagataaagatgatatggaagagagtgaggatgatccagataattcattattcagtgatccaccttccattgaacctgaaactcctccggaacagcatgttgcttcacctccaccacaccccaacctaacatagatgcagatactcattggaccgaagatggggtctttaaaattccatctgcgccct

SEQ ID NO: 6534 - DNA, 792 bp, Diabrotica virgifera
  misc_feature (19)..(784): n is a, c, g, or t
aaaagttttcaactttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggcct

SEQ ID NO: 6535 - DNA, 789 bp, Diabrotica virgifera
  misc_feature (57)..(76): n is a, c, g, or t
  misc_feature (167)..(184): n is a, c, g, or t
  misc_feature (778)..(778): n is a, c, g, or t
ctttatgaatgaaaccctcgggccggacactctcgtcagcgtacgccatgaactacnnnnnnnnnnnnnnnnnnnnatatatctaccagtgactgtcaaattgacaactggcaaactgaaaaagaatcaatggaaaataagaacaaaactttctgaatttgtaacgnnnnnnnnnnnnnnnnnnctggtatgactttcacctgaaagtatacgtaatcgataactgagccggatatcttatttattgacatttttgattacaagagccagacgaaactaggtaaatcatgtttttatttttcgagcagcatggttaaaaaacaaatgaataataaactgacatattgtgggagggaaatggctaaaccatgatactgaaaataaagagatatatattttcccggaccgcacatacgtctgagttcacgcattgatgacgtaactggagaccggaagtagaatttgaattcttgctaaagtaaaatgagatttgtatgcattatatgatgaaattattcaattatcaaaataacattagacttcaatgtattgcaaaaacatttagcggctagattccaggcatgataactcaaaaatacaatatacaatacaaccgcgaacaaatctaacgaatcccacattacagatgattacgaaccattacgaacttgtcgatctccagctacgtcacgacttcctgatgtgcaatacttagacaaggaaagagagaggacgagtaatccttgagcattagtgaagccaaactgacaccagagantttgatcatcg

SEQ ID NO: 6536 - DNA, 700 bp, Diabrotica virgifera
  misc_feature (6)..(36): n is a, c, g, or t
  misc_feature (171)..(196): n is a, c, g, or t
  misc_feature (492)..(512): n is a, c, g, or t
  misc_feature (670)..(699): n is a, c, g, or t
ctaggnnnnnnnnnnnnnnnnnnnnnnnnnnnnnnngacgaagagttgaaatttttttaaaattagctaaaacattttcagtttcaaaaaccgccaaaatttttatctgatcaaaaaacccctagttgatagtattggaaccatgcaagttcggaaaagcgacacctggtnnnnnnnnnnnnnnnnnnnnnnnnnncttttaattatattgtccaattatattagttctggttactggataattgtcaaggccataaaccaaaaaacaataagaaaaagtaagatttaggttatgttattaaaaggtaaacattacactacaagcaaaataccattaattaaattcactttaataattgcatattatatcaatattgtggagcaacatataatttttacaatttataacacatcatttgcgaagtcccattttcaccaatgacagtaggtatgaaatatacgtcaatttgacaatttcaattaacaatatgnnnnnnnnnnnnnnnnnnnnngtatatgttaagaaatttgcaagatgcgtccgctattgggaccgtgcaagttcggaaaagcgacacctggtttcttcgctctgcacttttattcgcacttttaattatgttggccaatcatatggtcctggttgctggataattgtccaggccatagnnnnnnnnnnnnnnnnnnnnnnnnnnnnnnt

SEQ ID NO: 6537 - DNA, 870 bp, Diabrotica virgifera
  misc_feature (776)..(776): n is a, c, g, or t
cgaattaatagattttatttaactgaagtctaataaacgctgtagttttgttgtatagatagatgttaaagtaggtcctgatagcaaagataaataaagatagactggaagaatttaatctatttagaacaattcagaaatcacatggctggccttgaaaatgagaacgtgcaaatgataagtacgaaaattcaaataactagtgaaaacccctcaccacaacgcaccgacaccgagtatgattcaacttcaacaagagtgcaaccattcgatatagaatcacaatctcatatcgattttgcaccagtaaataatcagaatcagaacaactgtgatagtttagacgcgaaagaaatgagtgcaacgaaagaacaacaaagtacattggggggagccgataaagagaaaaaacacaagaaaggccctcgacctccgcctccccctggattaaaagatgatctaacaacaattgcacatgtttctgtggtgattttcgtagggcttatcttgtatttatgttttgcacggccgtttgaattcttcacgtggcatcctttgttgatgtctgtagggtggatgcttatgatgatagaaggcgttctcttcatatccaaagaaaacccgataggaagaagactaaacttgggccgccttttaaaagttcgtttccattggatagctttaacaataagttctattttagttacgatcggtttcgtaatagtagttataagcaaaaacaaccacggcaaggaacattttaaatccttacatgncgatttcggtctcataggtttattagggtgtatacctgcctttataaatggtactgtagctttgtttgatgtcgagctaaagcgctacataaag

SEQ ID NO: 6538 - DNA, 333 bp, Diabrotica virgifera
cctcgcccggtgtttactaaatcttaataagctagaaatttaccagttaatgcacttatggacgacatttagggcgagcatgatccgcattgacacgatagaatttcatctttatatctggactgaataaattgttccgagagtatgtggatcaaggatgataaagtcttaactacccgattattattctccgctctaaagttggtacagcattactaattttatgtgtcatttccgagcctatgatgatgatgttgtagtgaactgtcgttccttttgctttatatctaactgtagcatcattagtttcaatttcttctatgacaatatgac

SEQ ID NO: 6539 - DNA, 367 bp, Diabrotica virgifera
  misc_feature (2)..(89): n is a, c, g, or t
  misc_feature (194)..(214): n is a, c, g, or t
  misc_feature (285)..(336): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctaagggataaccggcgtaatttttattgggagagttcaaatcccataataaagaatggccaccccccaaggttggattaaaagtttttaaattggggggaannnnnnnnnnnnnnnnnnnnncggttccaacttttttaaattttttacatgtatttctggatattaaaccccgggtggggggcccccgggtnnnnnnnnnnnnnnnnnnnnnnnnnnnnnnnnnnnnnnnnnnnnnnnnnnnnaaaaaaaagaggacacccccaacttattact

SEQ ID NO: 6540 - DNA, 125 bp, Diabrotica virgifera
  misc_feature (2)..(33): n is a, c, g, or t
  misc_feature (48)..(119): n is a, c, g, or t
gnnnnnnnnnnnnnnnnnnnnnnnnnnnnnnnnagaccctaatagagnnnnnnnnnnnnnnnnnnnnnnnnnnnnnnnnnnnnnnnnnnnnnnnnnnnnnnnnnnnnnnnnnnnnnnnncggggg

SEQ ID NO: 6541 - DNA, 726 bp, Diabrotica virgifera
  misc_feature (2)..(725): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 6542 - DNA, 225 bp, Diabrotica virgifera
  misc_feature (139)..(214): n is a, c, g, or t
cccagatggttcctaccacacaagaacgtttgtggcaaactcaataccaaactctaccacgcgtgtattaaaaactgctttatttgtaatttgttgttaaaatatttgttataattgttgaaaatatataaacatttgnnnnnnnnnnnnnnnnnnnnnnnnnnnnnnnnnnnnnnnnnnnnnnnnnnnnnnnnnnnnnnnnnnnnnnnnnnnnccctcaaaaga

SEQ ID NO: 6543 - DNA, 829 bp, Diabrotica virgifera
ttcgtattttgttagtgggtgatagtggtgtgggcaagacgtcgctgattttgtcgttggtaagtgaagaatttcccgaaaatgtaccctcaaaggcggaggagatcaccataccagctgatgttactccagagcaagtccctaccaacattgtggattactcatcagccgaacaaactgaggatgacttggatgagcagatcagaaaagccagtgtagtatgcattgtgtactcagtggatgatgatgactctattgaaaggatcacctcgtattggatgcctcttattagacaaaatcaccccgatggcacttgcccagtagtgttagtgggaaataaaatagacctagtagagtattccacaatcgatggtatttttgaaataatggaggagttttcagagattgaaacttgcattgagtgttcagcgaaaaccttaaaaaatatttcggaaatgttttattatgcacagaaggctgttcttcatcccacttcaccaatttactctgtggataaggctgatttatcagaaggatgcaaaaacgcattgatccggatcttcaaaatatgtgatatagactgcgacggactcctgaacgacatagaactgaacaacttccaaagtcgttgcttcaatgcgcctttacagccacaagtgctagatgacgtcaaagccgtgttgagaaagaacctagaggacggagtatgccacaattgtgtcactctaaatggcttcttatatctacacaacttgttcatacagagaggcagaaacgagaccacttggactgtgctaaggaagttcgggtataatgataatttggatat

SEQ ID NO: 6544 - DNA, 907 bp, Diabrotica virgifera
  misc_feature (766)..(783): n is a, c, g, or t
  misc_feature (786)..(811): n is a, c, g, or t
  misc_feature (858)..(906): n is a, c, g, or t
ccccctaaaaagccgaacgaaataatgctagacaaaatgaaaagtcctatggtatattttattattggaattgtatcgtttttcatgtatgctgctgcgcaactggagaagcaacaagtgattcatttggtaatcttttatgaagacttgccattctgtgcgcatacaaaggattttattctgcaagaagttcaaccactattagatgcgggtctttcaaaatatgtaaaattcgagctactaccatatgaaacagatgcggttagagactctacccacagttggacatgcaatgcagataggcgaaccgcttgctctcttggactatttgactatactaaggtgaaatatccagatcactatcatccaaatacagagtgtttaggttctacaattaattatttgagatattttcaagatatatttcaaaaagaaataatcgatactgacgttaaaagatgtaaacttggtgacataggtcaaatttatcctaactctatgaaagataaaggaataaaattgggttcctactatccatatgtaaatagcaccctgaaagaagaggtgggaaactttctaaacaatttaactacggaaatccttggtgtaaaagattttaaagataatactttttctattatcaaatggcaaactgagaacgaatgtttagaaagatcaagaaattctgcaatcgatacaaataatcttccttcaaatattttatgggtaatggtttctacaattactttaatattgttagactgcnnnnnnnnnnnnnnnnnnccnnnnnnnnnnnnnnnnnnnnnnnnnngttaaaacttcatatttaatttctggaatacacacaatacagacatnnnnnnnnnnnnnnnnnnnnnnnnnnnnnnnnnnnnnnnnnnnnnnnnnt

SEQ ID NO: 6545 - DNA, 963 bp, Diabrotica virgifera
  misc_feature (12)..(31): n is a, c, g, or t
  misc_feature (260)..(281): n is a, c, g, or t
  misc_feature (303)..(322): n is a, c, g, or t
  misc_feature (517)..(566): n is a, c, g, or t
  misc_feature (620)..(654): n is a, c, g, or t
  misc_feature (656)..(673): n is a, c, g, or t
  misc_feature (675)..(716): n is a, c, g, or t
  misc_feature (718)..(735): n is a, c, g, or t
  misc_feature (738)..(773): n is a, c, g, or t
  misc_feature (782)..(800): n is a, c, g, or t
  misc_feature (816)..(889): n is a, c, g, or t
  misc_feature (895)..(954): n is a, c, g, or t
gcttaaaagagnnnnnnnnnnnnnnnnnnnnatgtagcattgggagagagtgcttcagtcttttgaagcaactgtttattttgcgtacctggaggatccggcagtattagttactacttagatatctactattctccaatccatcatagctcaaactttaccattgttattcgcaaactaagtattttctctattttttgtgtacatcgcaacgttattccctatttaaacatagctagttgttctataaataacctttnnnnnnnnnnnnnnnnnnnnnngtcaccattaattccctttccnnnnnnnnnnnnnnnnnnnnctacggatgaccttacgactaaaattctatcaacattgaatttttgagtaaaaactatgatgacttattgtcctattatacaacctgtccttattgatttttacatgttattattgttatttcctataaattgcttattaaaatataactctatattatttgcatctaataatgctgataatattagtatgagannnnnnnnnnnnnnnnnnnnnnnnnnnnnnnnnnnnnnnnnnnnnnnnnncatttttttcgcctgattacttacaacatgactttttgtattatatataaagannnnnnnnnnnnnnnnnnnnnnnnnnnnnnnnnnnannnnnnnnnnnnnnnnnnannnnnnnnnnnnnnnnnnnnnnnnnnnnnnnnnnnnnnnnnncnnnnnnnnnnnnnnnnnngcnnnnnnnnnnnnnnnnnnnnnnnnnnnnnnnnnnnncaaaagccnnnnnnnnnnnnnnnnnnnaagaacaccccataannnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnncccaatttt

SEQ ID NO: 6546 - DNA, 1039 bp, Diabrotica virgifera
  misc_feature (978)..(995): n is a, c, g, or t
taaaacgaattggtactatagatctggctagaaacagattgaaaaagctcgattatcagatgttctttgagttaaactttattgagatactgaatttggcggagaatcaaataaaggagatacaaaaattggcctttaaggacttatatctaacggatattaacttatcaaagaatcagataaataaaatagaaaatggagcttttgaaaattgtgcgaatataacagtgttggatttgtcgtttaatgaattggcgtcccttcccaaaaaggcgtttgacgaaaccacttatgcaacagaactacagttatcacataattactttagtaatttatcgcaaattcctctacacaacatgactggcataaaaattcttaatgtttcccacaacttcatcactactattccaaagaagacgtttcccaaattatacgaactccacacgatagatatttcgcacaacaaccttactgatgtattcaactcagtattccaaacattattttctttacgaaacctaaatatgagctacaacaacctagctactatcaaaccaagcatgtttggttcaatacccacgctattggagctagatttaagttacaacgatttagaaagtgtctccaggggctccttaacgaggttagcaagtactagacaactaaatttaagaggaaacaatttaagaaacctcttccagctacccatttctggatcccattttggactttggcttataactaaaaaaaagaaattaccaacgggacacccgggcccaggtaatgaattccttggcggagtttgggatttgaagctaacaataccattggggacaattttggaaagagggaaagtttttcaaatttggtggacttaaccgcggataaatttaaaattacaaagggtatttgaaaatcccgccctgggggaatttttatatccacctgactttctttggcaataaattctatttgggnnnnnnnnnnnnnnnnnncacaagcttgggaaaaaaaaggcccctctgggaaaaattacccg

SEQ ID NO: 6547 - DNA, 736 bp, Diabrotica virgifera
  misc_feature (726)..(726): n is a, c, g, or t
gtcttacataaacatagaagtttgcttaatgatgttaactattggcatcaattcatggttagaaatgttgatcatgcaaaacgagaacaagttcttactgcaattttggatcatgtttttccattcgatctaattccagtgtcatattgggtagaggacgactttgtcttttttcttggtcgaaattgtggctcggctatagaaaaactatgcaatggaaatttagttgtgcccaatcctaaaagtacaacacccatcgatgatattgattctctacagcatttgacagaactaaacctaacagatttatttctggatggtaatcctttatgtagcaagtatggaccagaggaatattttgccaaaatttcgaaacatcttaaatatcttacgcatttggatgggcttcctctgagaaaagacggttttcctgtcagcagacgacactatatgtgcgatctgggagcagcagatcttattaatcagttcattgaatattatttctacctttatgatctaccgaatcgggacatattgaaaatggcgtaccagaaagatgcaatgttcagtcttaccgcttcctacatcgcagatcagatatcttcgagccgcaccaaaatgccctaatactcatctttatctagaaatatgccaaaaatgtcgaactttagtcagtgtcacaacaatttaatcagagggaaatcacagattgtgaatatacttaanaacctgcctc

SEQ ID NO: 6548 - DNA, 653 bp, Diabrotica virgifera
  misc_feature (2)..(652): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 6549 - DNA, 968 bp, Diabrotica virgifera
  misc_feature (911)..(934): n is a, c, g, or t
gccaaggggtaacgcgggtcccgggaattcccccgcggccggacccattcgcgtccgataatattgtttgtttactaatttttaaaaagaatggaaaattgtgaaattctggtttctgaacagaatatttctgtaggagatgccacgttctatattaaaaaacctggtaaaaatgaaataaaacatataaataagactggatctatgtctttaacattccgaagtgttactaattttattcgtgagatatttctaccggttggttatcctgaaagcgttagtgaagactactggaactatcaagtatgggatacagcacaggcattctgcagtactattattggagcttttactactagatctatcctgaaaggtgttggggtaggaaatcaagaagccaacgccttatcagcagcagtgacatggattctgaaagatggaatgggtatgataggaagaatcgtttttgcttggtggaaagggagctttttggacacagattgtaaaacatggagattctttgctgatattctaaatgatgctgcaatgtgtatagaattatgtcttccatatttttcaaattactcaaaggaacttttatgtgtaacttcttcaatgaagtccattgttggtgttgcggggggtgcaactagggcttcaataacacaccatcaggctattaaagataacatggcagaaaatatctgccaaagatggcactcaagagaccattggtaaattttagttggaaccattctgagcatttatttattaaacgtattcactgacacccacttcaaaatggctgcttaatcttcacgctgatgtttttacatctactaaccaattaattggggctgtgaaatcctttagtatttcaaatctttcaatgaacaaaaactgaaattggnnnnnnnnnnnnnnnnnnnnnnnngaaactgtttttaaccctttgcaaaaataatgaa

SEQ ID NO: 6550 - DNA, 981 bp, Diabrotica virgifera
  misc_feature (7)..(47): n is a, c, g, or t
  misc_feature (57)..(97): n is a, c, g, or t
  misc_feature (100)..(133): n is a, c, g, or t
  misc_feature (135)..(168): n is a, c, g, or t
  misc_feature (176)..(351): n is a, c, g, or t
  misc_feature (353)..(366): n is a, c, g, or t
  misc_feature (374)..(449): n is a, c, g, or t
  misc_feature (645)..(665): n is a, c, g, or t
  misc_feature (668)..(698): n is a, c, g, or t
  misc_feature (700)..(734): n is a, c, g, or t
  misc_feature (748)..(771): n is a, c, g, or t
  misc_feature (783)..(812): n is a, c, g, or t
  misc_feature (852)..(898): n is a, c, g, or t
  misc_feature (900)..(915): n is a, c, g, or t
  misc_feature (937)..(957): n is a, c, g, or t
aatgggnnnnnnnnnnnnnnnnnnnnnnnnnnnnnnnnnnnnnnnnngaccctgggnnnnnnnnnnnnnnnnnnnnnnnnnnnnnnnnnnnnnnnnnccnnnnnnnnnnnnnnnnnnnnnnnnnnnnnnnnnngnnnnnnnnnnnnnnnnnnnnnnnnnnnnnnnnnngaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnngaataacnnnnnnnnnnnnnnnnnnnnnnnnnnnnnnnnnnnnnnnnnnnnnnnnnnnnnnnnnnnnnnnnnnnnnnnnnnnncaatggaggaaaatattaacaattacaaaatgggtattttcgcaaaaaaatctttgggttaaaaagggaatcccgcaacttttttcccccggttttcaaaacctgcctttttggattaaataaaaaggcccccccgccccccccgataaaattggaaggccccggaattttggcccggcccagggggccaaatccnnnnnnnnnnnnnnnnnnnnngcnnnnnnnnnnnnnnnnnnnnnnnnnnnnnnngnnnnnnnnnnnnnnnnnnnnnnnnnnnnnnnnnnnggtcaaaacggccnnnnnnnnnnnnnnnnnnnnnnnncccccacaaggnnnnnnnnnnnnnnnnnnnnnnnnnnnnnncatataacacttttttataaacaaaaaattttctacagtnnnnnnnnnnnnnnnnnnnnnnnnnnnnnnnnnnnnnnnnnnnnnnncnnnnnnnnnnnnnnnnctgcccccccccttttttcggnnnnnnnnnnnnnnnnnnnnngcgggacgcaccccccattttttt

SEQ ID NO: 6551 - DNA, 650 bp, Diabrotica virgifera
  misc_feature (361)..(410): n is a, c, g, or t
aatcgtaacagtggtcatggcaattttaatcctttcttaggggccttcatctctttagtaggtgctgtatgcctgtccatgttgggccttatttttccaagtatcttcgaattagttactttctacgaagaccccggcttgggtcgtttcaactggcggttatggaaaaacatgtttttgatcatgttcggtctgttgggtttcgtaacgggaacctacgtcagtatacaggaaatcattcagggttgagccattctaccgtttttcagtatttctacagtcgacttcgcagggagtctcacatacaaagttggttttccgatccggctggaacccggttgtttcttcgatcagagattannnnnnnnnnnnnnnnnnnnnnnnnnnnnnnnnnnnnnnnnnnnnnnnnntgaagtagaggccgttttggaaataaatgaatggtttttaaactgttaatgagccttagtaaacgtacccatgtagacacagtgttagatacagactgtttagttttgaattagatataatatacccaactaaaagaagcgctaaaatctgcaacgttgtcgccttactttttttactttttcgtgtctggatccgactacagtttttctgcccagtatcgggctccttccacacccttc

SEQ ID NO: 6552 - DNA, 179 bp, Diabrotica virgifera
ggaccccaccgccagctcccgcgctgatcaggacttcataattatattagcgattgctcatctctattttgtaagtcaagaatatagttgatttgctttagcttcggttatcttcgaagtagggttgagctgtatcactagtagaactgaaccgatttctacgtgaaataaataatgga

SEQ ID NO: 6553 - DNA, 162 bp, Diabrotica virgifera
  misc_feature (16)..(33): n is a, c, g, or t
  misc_feature (81)..(98): n is a, c, g, or t
  misc_feature (121)..(138): n is a, c, g, or t
aatttttttccatggnnnnnnnnnnnnnnnnnnttctttgttatggtgggggggaaattatctcccatattgaccccccgnnnnnnnnnnnnnnnnnntttccgcccccataacttatttnnnnnnnnnnnnnnnnnnggaaaaataccctcccctcttctc

SEQ ID NO: 6554 - DNA, 269 bp, Diabrotica virgifera
  misc_feature (22)..(22): n is a, c, g, or t
cccgcccctagagggggagctnattagctgcggagagcagacgagggaccctagagggaccacaaaagacaacaggggggacgacgaagacgcgagacaggccgatgaccaaggaccccgtttccctcaaacgagagggcgacggagaagaagcacaccggggcggctgccccggaaaccgcgggcacacagaggaagcacggaggcagggcgagcaacgaaaacacaggagacagacaggaagcgacgaccgcgcgaccacaccggag

SEQ ID NO: 6555 - DNA, 403 bp, Diabrotica virgifera
cggaattccccgggccgacccttttacggccgcaaaagacaaagaaaccatagaccagggctattttttgaaggggaaagctcaagtatctcaccgcccattgccgagcacggaaagcagagatcagacattctgcaggttctttttataagcgcgcgcaagaagatggacctaatgcgacagatctctaccagtgattaagtaatggaaggaagcaagatattacgtcgtagaaggtaaggagacgaaagttatgcacccaccaccggggcgccgtagacctgtgaagaatcgccgccggcttgcataaaggggatggacaaagccacctcggccaggtgacgacaggaagcacgcaaccaatccataacttaagcaagagtcccatcacgggagacgcctg

SEQ ID NO: 6556 - DNA, 693 bp, Diabrotica virgifera
attataatatgatttgttggtaggatagtagtcaatcagccagccatgtggcagaaatcaaaaattatggtttagcgatacggtgacaataaatttgaattattgtcacatttatcaagaaagtgtacttaatttataaacagtctgtgataatatagagctgaatatctagaccagttattaacatgacgattaagaatatttgttgccttggcgctggttacgtaggtgggccaacctgcagtgtgatagctttaaaatgtaaagatattaaagtaacagttgctgatcttagcgaagaacgaatagctcaatggaactccgacagactcccaatttatgagcctggattagacaaagtagtacaagagtgcagaggtaggaatttattcttcaccactaaccttactccagcaatattagatgctgacttgatatttatatcagtgaatacaccaaccaaactgaacggaaatggcaagggaagggcacctgatctaaaatacctagagggagcagcaagaatcatagctgatactgctcaaactaacaaaatcgtgtagaaaaaagtactggtccagtacgagcagctgaaagtaattcagatatcttaacagctaataaaaaagccaaagtgacacatcagattttgtctaatccaaatttctagcgaaagtactgcaatcatgatct

SEQ ID NO: 6557 - DNA, 890 bp, Diabrotica virgifera
  misc_feature (10)..(41): n is a, c, g, or t
  misc_feature (43)..(552): n is a, c, g, or t
  misc_feature (554)..(649): n is a, c, g, or t
  misc_feature (654)..(678): n is a, c, g, or t
  misc_feature (681)..(697): n is a, c, g, or t
  misc_feature (702)..(727): n is a, c, g, or t
  misc_feature (742)..(764): n is a, c, g, or t
  misc_feature (777)..(812): n is a, c, g, or t
  misc_feature (816)..(846): n is a, c, g, or t
ttacgtccgnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcnnnnnnnnnnnnnnnnnnnnnnnnnagnnnnnnnnnnnnnnnnncgagnnnnnnnnnnnnnnnnnnnnnnnnnncataagttttttagnnnnnnnnnnnnnnnnnnnnnnncatttacttgggnnnnnnnnnnnnnnnnnnnnnnnnnnnnnnnnnnnncacnnnnnnnnnnnnnnnnnnnnnnnnnnnnnnngataaattacttagggatacagcgtattttattgagagtcaatc

SEQ ID NO: 6558 - DNA, 260 bp, Diabrotica virgifera
  misc_feature (50)..(75): n is a, c, g, or t
  misc_feature (83)..(144): n is a, c, g, or t
  misc_feature (146)..(158): n is a, c, g, or t
  misc_feature (185)..(197): n is a, c, g, or t
  misc_feature (200)..(214): n is a, c, g, or t
ttcgtccgcaagtagtgttccttttattctaagtttaatttcgaacagtnnnnnnnnnnnnnnnnnnnnnnnnnnaaaatggnnnnnnnnnnnnnnnnnnnnnnnnnnnnnnnnnnnnnnnnnnnnnnnnnnnnnnnnnnnnnnannnnnnnnnnnnnaatttacaaatgggggggtatcgacgnnnnnnnnnnnnngannnnnnnnnnnnnnncccaagaaatgggtaaaggctcattcacatctgcctgcgtattccc

SEQ ID NO: 6559 - DNA, 291 bp, Diabrotica virgifera
ttatcgtccgctcataaacaacaaatattgcctgacagctccccttatgcgttaacaaccggaaaaggccaatgtattggactggtttttggggttggtagggataaggaatcctgatcccaatgcaacacctgtggagcctacgaagatatgtccaaggtgtacttgaggcaaaacgtttaagaacgtgcggctagagtttggaatagaaacaaaggtgaatgtttattcgtgaatgacagcacttttgtataaccacagatattactggggggcgggcctcataaacaa

SEQ ID NO: 6560 - DNA, 760 bp, Diabrotica virgifera
  misc_feature (44)..(759): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 6561 - DNA, 774 bp, Diabrotica virgifera
  misc_feature (73)..(91): n is a, c, g, or t
tttgcgtccgataacttctaaaggatgaagaggaatatcctccagtaaaaagtatttatcaattaaaacatcnnnnnnnnnnnnnnnnnnnatgatgaggatggtaaagaatatcggtgggaaactggatatgaaaagacatgggaagctattaaagaagacgatgaaggatttttacaagccagtgtagccgatatcgttcaaagggcaaaacgaaaacggcaagccctaaaacatggaagtcaaaagttggggatgatgagacatttattcttgcttttagattgttctgaagcgatggccagtcaagatctcaaaccaaccagacttatatgtaccttaaagcttctagaaatattcttagaagaatttttcgaccagaatcctataagtcaactcggaattatacttatgcagaataaacgagcagagaggatcagcgaactagcagggaattgtaggaaacatataaaaatgctcagcaatttaaacagaaccagcttgcagggtgaaccgtctcttcaaaatggtttggagatggctttatcttcattgaagctactaccgtctcatgctagtagggagatcttggttgtaatgggtagcttaactacttgtgatcctggagatattaccaaaagtattgaaaatttcgaagcaagaaagtgttaggtgttcagtgatagggttggcagctgaagtacatgtgtgtagacaactggcgaatcaaacccatggaatttacaacgtaattctttgacgaacatcactttt

SEQ ID NO: 6562 - DNA, 740 bp, Diabrotica virgifera
  misc_feature (124)..(138): n is a, c, g, or t
acaatgttgaccaatcagggcttgcagaacttccagaataaccagcaaacccagcaaggcggtcccaaaccagcaactttaactgcaggcatcgaagaagctagagaaagcccgaaatcatctnnnnnnnnnnnnnnntcagtgtcaactcaaacggcagtaaatcagaacgtccaggcgatcattaccaacacctcgtgccagacgtcgacgatttcagccgcaagtccaccggatacaacgaccatgagtcctgttccagtggcgtccgagatgcagagtcccattcttgccgatactaccacccacaccgatgacggtctctcccctgtaccgttgagctgtactgcagtaagacacgataatgttagatccgaatctcaatcctgcaccatggcgatggtccattgtatatcgagcagtgaaccagatccttcagacgggcagaatcccgatcatccagactggaagcaaacccttcaaaccaataacagtaacataaatgagacgtatacaggcggtatgggtcatcttggtaaaatgtcatcgtcctccacgcaattggtatcagccgaatcgtcgtcttccgtcacgagccttcattacagcgcatctgatcaggagccgatcagcagttcccaaactttttgacagaaagaaaacgccggattgttgcgtcgtcatggaagcacatcccgagcagctgtcgctgttctcccgagctggtagtatgctgaacg

SEQ ID NO: 6563 - DNA, 555 bp, Diabrotica virgifera
  misc_feature (13)..(66): n is a, c, g, or t
gtcgtggttttcnnnnnnnnnnnnnnnnnnnnnnnnnnnnnnnnnnnnnnnnnnnnnnnnnnnnnngaaccccaaaccatgaaaaacagactaaaggtaacggaccgcggttattccctccattttttgcgggattatgggtagccggggggaatttcccccaaactccttcaccggttggggaaaccaaacccatttccgaagtgtgggcttcgaaaccggccccctaagaaaaaaccccaaaagggggaaacgtgggggaattaggatttttctggcattcctggctcggaaaccggagggggggttatcgctcgggaaggggggaagggggcctctctagaaccaacgggccttgggctcgaggaacttctcgaatgccggggggcccccggaggaccccctccggaaaaggagaattttggggccacattgccctccccagctttcctttggagttttccggaatggacgattttaaccccccgcaaacgggtggggtttccctttgggaatgggcaatccccattcaccccgtttttctctgagggttgg

SEQ ID NO: 6564 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6565 - DNA, 741 bp, Diabrotica virgifera
  misc_feature (578)..(598): n is a, c, g, or t
caccccgttcttttcgaaaatgacggaatcacttgatgacgaacaagtcaaattgctaaaaagggctttctccatgttcgactctagcaaaaagggcaacatcgacctagaaaaagtaagaacaatcttgacaaccctgggacatcattatgacgattctgaactagatgctttgttatcaggggaagatccagaaaatacaggaactgtcaatttcgattcattctgcagggtggctggacattttttggaaaatgaagacgacgaaactttacaaaaagaattaaaagacgcttttagattatacgataaagaaggtaacggatatattccaacatcgagtctgagagagatcctggcagcgctcgacgatcagctcaccaacgatcagttgaacgaaatgatctcagaaatcgataccgactccctcgggcaccgttgatttccaaaaatttatggaaatgatgactggaaaataaaatggagacgtagccaaattgcggaaaaaatataggttatatttttaaaaatcaaatagtttaatttgttataccattttttaactaacaaaaagtaannnnnnnnnnnnnnnnnnnnnggcgggccgttcaaaaggatctccgcttacgctcccccggccctgccgcgttctaaacttttctcatagggtccccccaaattttcatttccctggccccccgttttacatcgtccgcgctgggaaaaaccttggtgtaaccc

SEQ ID NO: 6566 - DNA, 624 bp, Diabrotica virgifera
ggcggaatggccgggacaaataggagtgtgcgaaccgagaagagtggcggctatttctttggctaatagggtagcggatgagacgggcactctcgtgcagcaagatactgttggatatgcagttcgattcgatgcttgctacaacaaaccaaaaattaagtacatgatagaggcggaatggccgggacaaataggagtgtgcgaaccgagaagagtggcggctatttctttggctaatagggtagcggatgagacgggcactctcgtgcagcaagatactgttggatatgcagttcgattcgatgcttgctacaacaaaccaaaaattaagtatatgacagaaggaatactgctcagagaaatgatgtctgatccacttcttaaaggttattctgcaattatgttggacgaagctcacgaaagatcattatacacagacatcttgatgggtttgatgaagaaaatactaaagagacgtaaagatcttagacttatagtggcctcagcaactttagatgccaaagagttacaggactttttcaataataataccaccgatgataagataaacgatactgcccgtatcatgtcagtagaaggacgacaatttcctgttgagatatt

SEQ ID NO: 6567 - DNA, 430 bp, Diabrotica virgifera
  misc_feature (81)..(105): n is a, c, g, or t
  misc_feature (241)..(273): n is a, c, g, or t
ctcacttattaagggaaaggctgggtacgccctgcaggtaaccgtgtccagaattccccgggccccccccctttagtccgnnnnnnnnnnnnnnnnnnnnnnnnntagcagcccccgtattttgccaatctaaacggggtgacccactatgtgtggcctatgtggaggaaaaaacttaaattcttattctacctcatattaatacaccccggcgatccctattcctgctcggctttgaccnnnnnnnnnnnnnnnnnnnnnnnnnnnnnnnnncaaaaaatatgggtacattatcaaacatcatcccttatagtttcacaaaaaatctaaaaggcatcgctccttgatttctggaaatttttcctgggatgtcccttcttcataatgtcttcgattattatccccctcgcaagagataacatcgagatcc

SEQ ID NO: 6568 - DNA, 225 bp, Diabrotica virgifera
  misc_feature (6)..(73): n is a, c, g, or t
  misc_feature (75)..(97): n is a, c, g, or t
  misc_feature (121)..(141): n is a, c, g, or t
  misc_feature (155)..(188): n is a, c, g, or t
  misc_feature (190)..(215): n is a, c, g, or t
ctttannnnnnnnnnnnnnnnnnnnnnnnnnnnnnnnnnnnnnnnnnnnnnnnnnnnnnnnnnnnnnnnnnnngnnnnnnnnnnnnnnnnnnnnnnnctttagaattaaatttattcatannnnnnnnnnnnnnnnnnnnncgacaaaacactannnnnnnnnnnnnnnnnnnnnnnnnnnnnnnnnncnnnnnnnnnnnnnnnnnnnnnnnnnncaaataaatt

SEQ ID NO: 6569 - DNA, 547 bp, Diabrotica virgifera
ctgcgaaatgtttacaagaaaatctttcatagtgttgtttttagtgagtgtaggtttggatatagcattttgtgtccaaattaactacgttaatgtacctgtagctgaaaaaaatgattcaaatgtttctgacatcatggattgcaactattctctaagacctgacgatacagaattagatgtcaaatggtacttgaacgatgatctggtctatcaatggattccccctcaactaccacaaagcttcggaaaattaaaagatagagtcgatttggagtatgcggcaaccgatgatcctaaaagtgtgtatcgagcgatgaaaatttttaatccaacagacgaaattgccggagagtataaatgttttgtttccacattcactgatgaagatttcttcatcaagacgatgcgtgtctttgttccagagaaaatatttggacgttttcaaaagtggatgagatgatgatgttgaaaactttacctgcttagcatcgtaagtgtatccaaaaccgagtctacaattggttaagagtttcagcgataaata

SEQ ID NO: 6570 - DNA, 641 bp, Diabrotica virgifera
  misc_feature (348)..(348): n is a, c, g, or t
  misc_feature (498)..(498): n is a, c, g, or t
ctcgccgaagacattttttattttacagaataaacgcactatgatttttaaaacctttacaaaactcagaattcagaatcaattattgagaatatactgtattatgtttaaggtcataagtttttgatgcgaatttttaacgaatagcatctcatttcattataataggtgaatattttattattgttttcgtgaataaacaagtaagtccgaaaagtgaagtcattttacttactttttgacgaagaacagaatatcactaatgatgcacttttctttaaaacctagattaagttttttcgtgaacaaacacacaaaacgaaaagatatactattgcagaaagtatntcattaattttaaattgattaatttcaagatgtgttgttatgtctgcaaacaaacaatgttattgcctgtaaggacttgaagcaactggtagtcgtacgattgttcatgaaagatggctgccgaaaatcaacgcaatctacataatgganctatttgtgtggcgccagcgtctgccacgttttccgaagatactgaatggtgagaaatttatttatcaagatagctagaaggccgcatttgcgatatccgcctgtgtgtcttaactaagaaaattgaactaattttggaattg

SEQ ID NO: 6571 - DNA, 955 bp, Diabrotica virgifera
  misc_feature (782)..(782): n is a, c, g, or t
  misc_feature (816)..(816): n is a, c, g, or t
  misc_feature (858)..(858): n is a, c, g, or t
  misc_feature (860)..(860): n is a, c, g, or t
ggagatttgagatttaaggctccacaacctgctgataactgggaaggcgttcttgatacggtagaaaacagaaaagtttgcgtatcacaaggagtggtggatgatccagctctagaagaaacagaagattgtttatatttgaatgtctacacacccaggtatccctcttcaaatgagtcgcttcccgtgatatttttcatatacggaggaggttttgttgttggatatgcaacctttgacgagattggtcctcattacatgatggaacatgatgtcatcgtagtaacagcaaactatagagttgggctcatgggatttttgtctactgaagatgaatctatacctggaaacttcggtctgaaagatcaacatctcgctttcaaatgggttcaggaaaatataaaggcatttggtggtaatccagctagagtgacgatcatgggacacagcgctggtagtgcctctgtagcatatcaacttatgagcaagaaaaatcaaggcttgttttggggaggtgttatgctcagtggttcgtcattgtcgccgtggagctaccaaagaaatgctagaaaatatgcttatatgatggcgaaaagtttaaattcaagtatcgatgagaatactccttcccgcgaagttagagatttatttttaagagtatctgcaaacgatctaaaacatgcaagttggaaactaccagcatttgaagaccagttgatcagcggtttcatgtttgcaccctgtatagaacctgaaggtgaagatgctttataactgaaccnatgtattctgcactttgatacggccacatgctgncagtacccattatgattggaatatcgtctgaggaaagaattngngatgctgcaaacgctactagttttaaagcactcctgggaacataccgacacaacgtaacgaaattttgtaacgatgacatgcacctgactgatca

SEQ ID NO: 6572 - DNA, 120 bp, Diabrotica virgifera
  misc_feature (10)..(38): n is a, c, g, or t
  misc_feature (45)..(116): n is a, c, g, or t
gtaaaaagcnnnnnnnnnnnnnnnnnnnnnnnnnnnnnccctatnnnnnnnnnnnnnnnnnnnnnnnnnnnnnnnnnnnnnnnnnnnnnnnnnnnnnnnnnnnnnnnnnnnnnnnngggg

SEQ ID NO: 6573 - DNA, 539 bp, Diabrotica virgifera
gtactatgtagtattttccatattccgcctggttacactatttatagatcgattattgttgggaatcagaactgcactttataatatacctgtatattccatatttttatggatattaaatacttcatctgtcgcaggcaacatccatattacctggaaaagttatgacgaagaaggaaatgtaacgatagaagcaaaattagaaaaactaccgtttataacgagcattgtaaaatttgcacctgattctgttagtactacgacaaaccaggtgcaaaattagaaaaactaccgtttataacgagcattgtaaaatttgcacctgattctgttagtactacgacaaaccaaagaactctgagagacatctttcaaagtactattactggaacagtattatagtaacaaatatagaatcggagatatttgttacattatgtaattataatgaaacttataaagaagctgcagcttttggtagataggagacaagacaggaaataaaaagaactgaaattttgtaaaaaatttacactaat

SEQ ID NO: 6574 - DNA, 832 bp, Diabrotica virgifera
  misc_feature (140)..(798): n is a, c, g, or t
ggctggtaaccacctgaatctacccgaattacatccctcgttccacatctgccttactacagatgaggtccgaaccaataggccctcaccaatcgcgcttacccagaatggcgaatgctaaacgcccagtggcaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaatatggcgcgccaaaagaaaaccgcgggat

SEQ ID NO: 6575 - DNA, 228 bp, Diabrotica virgifera
  misc_feature (13)..(67): n is a, c, g, or t
  misc_feature (79)..(100): n is a, c, g, or t
  misc_feature (183)..(200): n is a, c, g, or t
  misc_feature (208)..(227): n is a, c, g, or t
aaatgaagggggnnnnnnnnnnnnnnnnnnnnnnnnnnnnnnnnnnnnnnnnnnnnnnnnnnnnnnncgttaaaaagcnnnnnnnnnnnnnnnnnnnnnntaagaaaaaaccccaataaaagcttttaataaacatccttaaaataggtttttttaagaattcaacattcttttctataaaannnnnnnnnnnnnnnnnngggggggnnnnnnnnnnnnnnnnnnnnc

SEQ ID NO: 6576 - DNA, 829 bp, Diabrotica virgifera
aagcagtcgtggcagcgatgcagaaatcagaaaaaagtgatggagatgatgacgacgaaaagatttggcctcaggtgttagctattttgatagcatcgctaggagcattctctcagggagttgcctttgcatggacatctccttttatagtcaaactagtagaagacaaagtaaactacgatatctccgaggaagaagcttctaacttaacgatcgttcaacctttgacagtaatcttcacatgcctgatttttagcaaaatccctgacatcatcggcaggaaaaagacccttcttttgttgagcatccctcacatcaccttcctcatcatcgctgcgtttgctaagagtatttatgtgttctatatttccaggatgtttgttggactggcgaatagttttttatggacagcgatgccaatgtacattggagaagtagcttcgcccaaaattagaggagctctaggtactgccatcacatttggacttaacgttggacagtttggtgtaaacgtagtaggtagctacaatgatgtgtttacaacatcttgcatcttcttacctgtgccaatactattcgtggctttgttttcattgatgccggacacaccatactattatttaatcaagcacgaagacgaagctgcaaggaaatctttaaggtttttgactaggaaaagcaacgttgaagctgatttaaaaaagctaaagagtgacgtggaacgtcaaatgtccgagcaggggacctggaaggatctgtttttgtatagaaaagcacagaaaagctctcttagctggatttttttctaagaatttcgcaaatgtttagt

SEQ ID NO: 6577 - DNA, 864 bp, Diabrotica virgifera
tggaggtcgagtttagtgagtgtagtgtataggtactgccatttaattatatttatggatagcctttggcgtaactaaacagcaaggataaaattatcaattcaactccaaccatttcctctgtactcatgttcttgcccgcaccgtgatgagtgaatttaggcctaaattcttaaagccttcagataccactagttttctggatagggatgattcctacagcgtagagaccacagatttcgtttacaacagatatttgtctcagtccattcaaacgcaaagacagaggttgcccattttcaataacagaaaccatatactttatcttctggagaagtatcaaactttgattctaatcggagaaactggctgcggaaagagcactcaaattccacagtacatgatagaggcggaatggccgggacaaataggagtgtgcgaaccgagaagagtggcggctatttctttggctaatagggtagcggatgagacgggcactctcgtgcagcaagatactgttggatatgcagttcgattcgatgcttgctacaacaaaccaaaaattaagtatatgacagaaggaatactgctcagagaaatgatgtctgatccacttcttaaaggttattctgcaattatgttggacgaagctcacgaaagatcattatacacagacatcttgatgggtttgatgaagaaaatactaaagagacgtaaagatcttagacttatagtggcctcagcaactttagatgccaaagagttacaggactttttcaataataataccaccgatgataaaaaaacgatactgccgttatcatgtcagtagaaggacgacaatttcctgttgagatattttat

SEQ ID NO: 6578 - DNA, 562 bp, Diabrotica virgifera
ccggattgtaactttgttttgaaatcgtattttatttaatttggcagtattatggcaggaccaaagaaaaagtccagagtaccttccaaatctgaatccgaaggatcaagtaacgacgagagtgattcgggaacttaccatggacagaaggaaatccaagcaacatttgaaggacggaatcctgaagtacaagattttcatggtattaagcaactactaagtcagttattccttaaagctcacatagacctgtcccaaatgagtgatttactgatttcgcaacatggtgtaggttccgtattgacacaaagctatggtgacagcgatcgatggggacggagatgttcgcgtattaggcgggaagcatgcgagagatccctacgctccgacaaggtctctttctgctgtcaactggacattcaaaagctgcaggcacgtagagaggaggcttaaaatcctgacttattgtgtgtttttaagatttgcaagagattggtgtaaaaagaggtatcgtttaagagcaagaggccaagggaatatatggggctgttgatgataatag

SEQ ID NO: 6579 - DNA, 208 bp, Diabrotica virgifera
  misc_feature (7)..(44): n is a, c, g, or t
  misc_feature (61)..(61): n is a, c, g, or t
  misc_feature (80)..(80): n is a, c, g, or t
  misc_feature (116)..(138): n is a, c, g, or t
  misc_feature (168)..(199): n is a, c, g, or t
  misc_feature (202)..(202): n is a, c, g, or t
taacagnnnnnnnnnnnnnnnnnnnnnnnnnnnnnnnnnnnnnntggcgacctcgatgttnggattaaagtttataattnggtgtagcagctatattaaattaagtctggttcgannnnnnnnnnnnnnnnnnnnnnnagtttaaaccggtgtgggccaggttggttnnnnnnnnnnnnnnnnnnnnnnnnnnnnnnnnganagggac

SEQ ID NO: 6580 - DNA, 531 bp, Diabrotica virgifera
gggaatctagaaaaaatgtttttcggaggacaatgggaggtttttgaagcggagcgcgccgcgccggcaaaacagtcggatgaacgcgcgtatttaacaattaaaggacaacggtgtacattgaagttggacgcgatcactcttcagaatctggaagctgaatgtgtagacttcaatttaagtgtctggcagcctcaaaggtgctagtttgaatatgagtttttgagcctcgaaaatgcgtgttttcgcatttttcagattttaaatcgcctataactcggaaattatcaagttttgagaaaatttacaagatacctttcttgttcaaaatgaccgtcaaaactcagacatatatgttccggagaaaggaagcgtgatcttttgtatatgtttaaaaaagatgttagaacaatttctgcccaaaaattcctgcccggcacccttcagattttgtttaagggctatatgtttgagtacggatgcccaggaaaccgattccgcagttttttctgattggaaaggacaccacct

SEQ ID NO: 6581 - DNA, 417 bp, Diabrotica virgifera
  misc_feature (258)..(274): n is a, c, g, or t
ggaattccccggggtcgacccttttacgcgcatgcccttgccgccgccgccggcgctggcctttttcagcaccgggtagccgatggcgtcggcctgttccttgaggaattgcgggtcctggttgtcgccgtggtagccgggcaccagcggcacgccggccttttccatcagcgacttggccgcggacttgctgcccatggcggcgatggccgaggccggcgggccgacgaaggcgatgccggcctgttcggcggcttnnnnnnnnnnnnnnnnntccgacaggaagccgtagccggggtggatggcgccggcgccggtgtcgcgcgcggcttgcaggatggcgtcggcgcgcaggtagctggcgcgcggctcggggccgccgatatgcaccgcgacgtcgcaaggggccacgaggtg

SEQ ID NO: 6582 - DNA, 814 bp, Diabrotica virgifera
  misc_feature (768)..(788): n is a, c, g, or t
aaagaaaagacaaaacaggagaggaggaaggagaagcaaaaaagaggcgcaaagagaagaacgaggcgacggccaacacccaccgacccgaaggaaacggccacggcggccccccgggagcaggaccaaccaccaccaacgaaggccccgaccacagaccggggccccagagcaaaggaacaggacacgaaccagggaccccccccccgatttggccagaccgacgacgaagaggacacccaggaagacaggaccacgggaaattttttctcccccgcctgggatcaacacgctgcccagctaccagtagaacacgcatacactctctagcaaagacccagaagaccacggccacgttatctccagtggcacctgaagcgaagggggcccatgcgccccccgccaggccccaacgaacgccactgttcaccaaccacagcagaagaagtacacaggcctaccctaggaggagcccccccgataatgcatcaccaccaaagaccacaaaccacaccacacctccatcaaccacgccaaccacacccccacacccaggacccggatgaccgaccaaactcccgcccccgcctaccgacacccccagaaccggagccacgtcccaacgctcccaccgtaccgccctctccaccggcctccccagccggagaggccccccccctcaccacacccaccacccccccaccccccaccccgctacccccccacccccccactacgccccaacccccacccacccccccaccgcannnnnnnnnnnnnnnnnnnnnaccgcccccccgcaccaccccccccc

SEQ ID NO: 6583 - DNA, 96 bp, Diabrotica virgifera
tcttggcatttcccgggcggcgttgatcacgatttctatcggctcatcgatatcaaaggaacacggaaacagcacatagggcgtctcgcgctcagt

SEQ ID NO: 6584 - DNA, 957 bp, Diabrotica virgifera
atggcgacctgaagtgttgtggtgtttagttatcctgttcggggatttaacccttttgttttttatagtgtcacagttaaaagtgcaatagaaaaatactggacaaccctaattgccaatgtcaagccaaccttaccgatttctgccacaaataccatacttcaaacctggtatagcatctcctgctccagtaatgtcttcccaacgtttttgtcttcgatggaacaaccatcaatccaatttactttcagtatttgatcaattactacatgatgagagttttgtagacgtaactcttgctgttgaaggacagttgctcaaagcccataaaatggtattatcagcatgcagtccatactttcaagcactgtttatgaatcatcctgacaaacatcctattgtgatattaaaagatgtcccttataatgatatgaagtgtttgcttgacttcatgtataggggtgaagttagtgttgaccaagatagacttacagcatttttaagagtggcagaaagtcttaaaataaaagggttaaccgaagtaaatgaagaaaaatgtgatagtatagcttcctctctcacccaacaaaatttacacaatttgccaaatttacaaagattgcaacaaaccaaaaggtttggaaatagtttaaatatgttaagcaatgcgttactacaacctaaaaggaaaagaggcaggcctcggaaactttctggatgttcaaatggaccagatgattatgacaaggacattgttcaaggtagcccggagatgttagaagttaagatgggaatggataatttcacagggaaataattctgacacgagcgtgaaaaatgaagttgaagcagacgatgacaagtttaaaaaacgaagcaaaatccagtggcctggattttccaaatgacccaaacacccaaggattaacccatccccaatccccccacgaacttttc

SEQ ID NO: 6585 - DNA, 620 bp, Diabrotica virgifera
cccacgcgtccggtgaggcgacgatatgcaagaatatgtgtgaaaaatatttaaaaagaagtggtcttaaaaaaagtactaattgacggcgtgacgaatttgtgggattacgaaatgtcgcgttacatgatgtcatggaaccatattctcggaatgatactgtaatgaactataatgattttctcaccaacgctgatattattaatgtgtgaagacatgtagaaagcagagtgcacaatgctcgagaaacatcgtgggcaaaatttatacttttttcgacacattatcatccggcctcaaaagtccactgctgaacataggcctattcctcgtgtttccaaccctgtctatctcgcaccgctctcatctaggtttttagcctttttaattcgtcagtccatcttgtagttggtcgaccaatcttgtctttccttggtctccaatccaataactcctttgcccatcgcccatctgtcgttccaggtatgtgtcctgcccatctccattttggtatgataattctttcaatgacagtcttcgcgcacacctattcgcacacttattcttatcattgattgctgttgacacgatgatgcgttcttgatgcggccactgcaaat

SEQ ID NO: 6586 - DNA, 606 bp, Diabrotica virgifera
  misc_feature (425)..(447): n is a, c, g, or t
taattgtgctagttctcatctttatgtcattgcatctcaagaagaaatttgcggtacatttttgtaaatttttatggtttttagttatttttcgggtgtaactagaatgaaatgcaaaaaatgatgttgcctcgcagatttaaaatgcgtttatctcgagaacggttgagtttggcgagatgagtgtggcatatattttttgagtaaaaatattgagagagtaaaggttctgattccaaaagtatgtacagccgtgcactacaaaagggtgaacctactgaatggccgctgtcgggagcgatggaactgaacacgatccagacactcctcattcgattttgccagatttacaaggatttgaatatcccggcatacaggactatggagatagagaactagaggtatggtttctaaaaactgtccannnnnnnnnnnnnnnnnnnnnnnctctatgggttgcccgagacgagcatggtaaagctattccagtcaaatatgatatgaaaggataccattcgttatcggcaagcccctacgatcattactatttactatacacatcgaagcctaacatgacttccctcttttgatctcctccgtttttga

SEQ ID NO: 6587 - DNA, 185 bp, Diabrotica virgifera
  misc_feature (46)..(69): n is a, c, g, or t
acattaagattaattacaatgttttacataggaaaatcgtatttcnnnnnnnnnnnnnnnnnnnnnnnnagcaggagtctgggttatctactacgaaatcttctacggagagatgtgcggtcgattagaagtttgacaagattatctagatcgtcttgtggagctattggtgactcgttgcgagg

SEQ ID NO: 6588 - DNA, 172 bp, Diabrotica virgifera
  misc_feature (5)..(61): n is a, c, g, or t
actgnnnnnnnnnnnnnnnnnnnnnnnnnnnnnnnnnnnnnnnnnnnnnnnnnnnnnnnnnccaccagcgagatgctgaccttgctcaacagctcgccactggccatgccgtcgtagaacgcgctcagggtctgcaggaagctcggcagcagcaggtcattgttttgataac

SEQ ID NO: 6589 - DNA, 1306 bp, Diabrotica virgifera
  misc_feature (699)..(718): n is a, c, g, or t
  misc_feature (863)..(885): n is a, c, g, or t
  misc_feature (931)..(948): n is a, c, g, or t
  misc_feature (1066)..(1121): n is a, c, g, or t
  misc_feature (1131)..(1200): n is a, c, g, or t
  misc_feature (1209)..(1236): n is a, c, g, or t
  misc_feature (1248)..(1273): n is a, c, g, or t
  misc_feature (1283)..(1305): n is a, c, g, or t
gggtttgaagaaagtatctttattctttgtttatagagtttaattaatatgatttaaataatggaatcagaggcttatattcaatggaaaagactctttgacgataatgttttacagtcatataataatgagaaaaaagaattacaaaatgcggctatgttgcttacagctttaaaaacagaattccaaaatgtttctcgagtattagagctgcaatttgatcgattaaaaagacaattaaaagacaataccgaattaaaagaacaaattacttcaccaggccaaccaattttacaatcaattcacaatagtccaaaattggaacttaaggtggacttgcctaacaatgagactgaccatagaccaggactaagtgatttggagagccctgatatctttataaaccagtctttaaaacctgtggaacaagtatctcccacttccgttatagatctctcaaaatcagatgatgatacttctatagaagacagccctacacttatatcaaaaagaaagaaagatgtcacaaaaaaagacaaaatagactgtctaaaaaaaaacatttttaggggcattgataaagaaaatttttatattgaggtgtactccagaagccaaatcccctaaaaagattggtaagaaaagagggactggtaagaaaccccagaaatcaacaattaccccagttatttaatgaannnnnnnnnnnnnnnnnnnncgtcttcagagcctcctgtggtggatccccgaagcgaactgaataccaagcttgttgaaacaagctattttatatacaagaaaaaaatcttctattaggtccggagtgcggaatcccttgggcaactatctggttgccctgggcnnnnnnnnnnnnnnnnnnnnnnnccttctgatttattttgtcgatgggttagatacaataaaaaacccnnnnnnnnnnnnnnnnnntattaaaacttttcattgaagttttcccaaccgaaaccttttaaagtcccttttcttttttcaatttccccactggaaaaaaaaccccccgggcaaagtaaaaaaggggcccggactnnnnnnnnnnnnnnnnnnnnnnnnnnnnnnnnnnnnnnnnnnnnnnnnnnnnnnnnataaccccgnnnnnnnnnnnnnnnnnnnnnnnnnnnnnnnnnnnnnnnnnnnnnnnnnnnnnnnnnnnnnnnnnnnnnngcggggggnnnnnnnnnnnnnnnnnnnnnnnnnnnngcggtgtgctgnnnnnnnnnnnnnnnnnnnnnnnnnngcttttttcnnnnnnnnnnnnnnnnnnnnnnnc

SEQ ID NO: 6590 - DNA, 390 bp, Diabrotica virgifera
  misc_feature (7)..(24): n is a, c, g, or t
ttttcgnnnnnnnnnnnnnnnnnncttaaaaaaatagttatatttaaagaaagtaatttacaaacttttgtaaacaatgccatacagtgaccaatcctaaggtggaaaacaatctacttattgtgacattttatttcagattttaattacaacagataaataaatgaatcagatcgtttatagtaacagaaatcggataagacactgagtatgtctttgaagcttatagataacttgctttaagccaatacaagtattttaaaccaatcggtgttttattattttatatacaaagaacaagtgaatattctaaaaacatgtttcattaacttcatttatcattaagaatacaaatatatactatcttactgtataataaggccgtaatat

SEQ ID NO: 6591 - DNA, 434 bp, Diabrotica virgifera
gggccccccctttcgggcgagttcgcatgattgactagagtgatcttggtcttttaaatagcggacgtgatatacaatacaaagatgcttgcatgtgctatactgattgcccctgccaccagatgcctttctcgttgtacacgaaaaacaatacttgagggcactgatcaatagtgataaaccaaatgtcagatacaggtacagaatgagccacgacacaagcaacctaccctcctacgcgctatccgcagactccaaattacaccagacagcaaagagattgactctgcagctagattactctggtggtggagctgccacagttggaggatatggatcaggatgtggtattgaaaaagtgttacggttcactcatcatcggatacgccaaaaaccctatcctagaacgaacaacattgtctcatacgccatct

SEQ ID NO: 6592 - DNA, 751 bp, Diabrotica virgifera
gtgtgaatgtacaatatgaaggcacaaaaaatcagtttaattatgcgcgcattaaaaaataacattatatatttcgtttattacatgagacaagtactcctgacgactctaattgtgggggtattatacttatttagcaatacagattagaacctttagtgtcaaaggttagtgagattatcttgtatattagaataaaaatagaagagttttgtggattttcaaaatgactttacacaattctgtctgtgtattgttgcgcacctttaccataaaatctaacctgaccataagtgttgtcaagaaatattcttcggctccactgcttccaggagccacaacaacatggacagaaaaattggagtttaccggacctcacacgtatgcgcccattccagtttacagagtattatatcgacaaggaaacatcataaacactaaagatgatccgaatttatcggaagacatattaatcaagatgtacaaagacatgacacttctcggagtaatggatataatcttatacgatgctcaaagacaaggtataatatctttctatatgacaaactacggagaataagcttctcacataggtagtgctgctgcattaactaacgaggatgtttgctacggtcaatatcgagaagcaggtgtattattgtggagaggctctaccttgcaacaatttgtagatcaatgatatggtaataaggataacttggagaagggaaaatctatgccagtgcattat

SEQ ID NO: 6593 - DNA, 957 bp, Diabrotica virgifera
  misc_feature (380)..(422): n is a, c, g, or t
  misc_feature (653)..(674): n is a, c, g, or t
  misc_feature (817)..(849): n is a, c, g, or t
gaaatgaccagttggtgataaacaccagtctgatttttgcatgagagtttaatgaaatggtaacaaatcaattggaagttctgtccgataaaatacatggaacgttttcgtagtctgacgttccaaatttgaacctgttcctcaattaaaactttccctgttccagtgttcccgtacatcagggtttgtccgactagacactgttaagctattgacaaatgttcagcttgctgttaatcaacttttttttggtgcgtgggatctaggtctatgtcttattcagttttctactaaaggaatcaatgctagcagtattattcatatgagagccttagaagtaaaggagttataagtgacaaaaagaaaattttgagtaaacnnnnnnnnnnnnnnnnnnnnnnnnnnnnnnnnnnnnnnnnnnnaaagctagtttttcttcttgggttaagtaactgtaggcattattatttttcgttgcaacaaaaaatcataattttattggctactcattttggagctatttttaggatactaagtagcacttgtacccttttatttctaagaaatgcaacataaaggcaaaaaatgtaaaaatatcataacgcttttgtacaccatgttgtatgtgttgtttattcttcaccatagcactnnnnnnnnnnnnnnnnnnnnnnctgattcatcgacaacagtatcgtaatggtgatccacattgtcattttcgacatctgcttcttcaaagtttgctagttctcaatgttgttgaccatcatgtcgcagatttatgaaaaactcatggaaaattggaggtacgtannnnnnnnnnnnnnnnnnnnnnnnnnnnnnnnnagcgggttaaaaaaatcactaaattcttatatatgctacctccagttgttttttttgaaaacagggttaaagggttgccctggttgaaaaggtaacattggatattgg

SEQ ID NO: 6594 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6595 - DNA, 412 bp, Diabrotica virgifera
ttcgtccgcccgcgtcgcaagtggtgctggacaccgggctttttggagaaataccagcaaaatatcgaacaccagcaccccaccgaacaaggatctgataatgtacaaggcattttttttacagccatatagcaaaaacatgcatagtcttaccatgctaggtgtcacggagaaccaaaaatctcgcacatagataaggacaggggagaggctaatacataccgaattgaaggaaagggagacggcgttcttatgggaacacgatcaattactacctacgaaggcctagaccaatgaccccgggtcgcgacgctaaggagctaggatacgagctggggtgcgcccaatcgattttggcaaatttatgacgattgtgatatcctggaatgcaggagcacagaaataaagaact

SEQ ID NO: 6596 - DNA, 325 bp, Diabrotica virgifera
ccgagcttacaaagataccatctattgtgatgtcctttattgataatgatttatcaatattatttcctgtccgttgatggatatgaaacgacccatcactggtattaagatatcaccgccgaacaaatacatggtaaataaatattgacgattactctagtactcgcaagcataagataatccagattgacaacaagcctaaacctgccaattataagcatgctaaatatgcgaatgctgagattacacttaattaacatcaataatcttaagaatgatcgaattaacattatcaaaatcacatctgtcactaatacacatagac

SEQ ID NO: 6597 - DNA, 65 bp, Diabrotica virgifera
  misc_feature (3)..(62): n is a, c, g, or t
tgnnnnnnnnnnnnnnnnnnnnnnnnnnnnnnnnnnnnnnnnnnnnnnnnnnnnnnnnnnnngct

SEQ ID NO: 6598 - DNA, 785 bp, Diabrotica virgifera
  misc_feature (179)..(197): n is a, c, g, or t
  misc_feature (556)..(573): n is a, c, g, or t
taaaagcgctgtattatacacagaataaagaatatgagatccctagtatggttttagattaaaaggaagatcaactatatatcctatccatacgctaaaacaagcgaaagagaaaattgtaagtacgacggagaagcacatattatacttttcctagacttacaggggtttgacgaatnnnnnnnnnnnnnnnnnnnattcaagcctcacaagagagaaaaataacaaataaatctgtaagtatatacagagaaaataaataatggagttaggcaaggaaatgagctctcaacagtactattaatttattctgtcactagacaagataacaaaaaaaatttcaaacgcagaaactataaataagaatgcagtacaaataatatgatatgcggacgatataaccatagtagcaacagataaaagggcattaaagaaaaccctccaagaaatagaaaacgtagctaattcgttttatattatgatattcctttaattgtggtaccaatcttacctgtgaatatgttttatgcaacctagtatgttacattttgtacgnnnnnnnnnnnnnnnnnngtatgagtccctttcgggttttgatctgcaaattatttacaattcctcaccttacatcactattttgaaagtctttggaaactggcaatacagtacttaatgtatatgtccccattgcgatgattttggatcgtcccaaaaacgtgagataaatatggcaacaatgtattcaaataaaatctttactttacatctttgtgcttttgggatga

SEQ ID NO: 6599 - DNA, 722 bp, Diabrotica virgifera
  misc_feature (20)..(21): n is a, c, g, or t
  misc_feature (31)..(32): n is a, c, g, or t
  misc_feature (38)..(39): n is a, c, g, or t
  misc_feature (51)..(53): n is a, c, g, or t
  misc_feature (66)..(66): n is a, c, g, or t
  misc_feature (68)..(69): n is a, c, g, or t
  misc_feature (205)..(225): n is a, c, g, or t
gaaagctggggtacgcctgnncaggtaccgnngtccgnngaattccccggnnngtcgaccccacgncnngtccgcactcattggatacggtgctaagagactaagagcatagcaacaaacaacaaatacatacttttctcaacctcccaatgaccaacacaatatgaatgaatggcccccgtgctaaccgatgaccacgtagagnnnnnnnnnnnnnnnnnnnnntaatagcatgccttgccccaaactgcagataatagcacctgactacccctccccaaaagaacgtggtcttcgctgaatctccattaaaggcgccgaaaggggcaataccaaggtgaagaaagacatcactcgttaccacaaaaggcccgaaaacaacgagaaacgacacgactgcgaaaatgcacagctacactcctccccagggacataattaacacggcaaaaaaaataataacagaaaaaatcccaacggacccacaccatctatatctgctttcttctgtgtcagcaatgatcaacgactgaaatgaaagctaccaatcctgagtatgctgatgtagacgttaccacataactattcacaatgagcaataaaacggatcaatatctcacggctacatcatgaaggttagattgacaaagacaaatccaaatatcaaaaaaacctgactgtctatagacagaagagccatccccccttgcaacaatcgaaacac

SEQ ID NO: 6600 - DNA, 809 bp, Diabrotica virgifera
  misc_feature (231)..(264): n is a, c, g, or t
gatgcattggacgatgtggggtagacaatttaagtacctgggtaaagaacagaaaagaagagtggaatgaacacataagcaggatgtctgaatcaaggatagcaagaatagccaaggacaagtcaccgttaggcagaagaagtataggacgcccaaggaaaagatggaatgacaaattaggggcagaacgaaaggcaccgttgaagaaaaataggcagtactgcctatatnnnnnnnnnnnnnnnnnnnnnnnnnnnnnnnnnngaacattatttggaaaattgttaacgttataaaggtaaaaatatttgttacttttcgttaaatagttattttattccaatttcctgattttattaatttcttaactttctgttttgttttattatttttcttctaaaaatagttggcgcttaactctaagagcccgttcacatgacaggcgctcaactcgcgttttgataacgcgcgattactacttcatacattttaattgagaccgttcacatgttaacgcgcattttaatcattaaaatgactatgaaaatgaaagttctttttgcagctctaaaactggaagtcagattttcaatttcttatctttaataccaaccttttggatataagcttgcattcggcacctcatttgtcattcaatctgtattaataacggagaagttgtattcgcggacgggcgaacagacgaacagtcatgaaaaccggagaaaccggaaagctactagaataatatatcacttggactattctggggaactttaaaacagtactttccgatttttatttctaaa

SEQ ID NO: 6601 - DNA, 884 bp, Diabrotica virgifera
  misc_feature (342)..(359): n is a, c, g, or t
  misc_feature (583)..(600): n is a, c, g, or t
agtttttatatgtattcgaatgtctttttgttcatcacagataacgcaaaatctattgctaatacagtaaaacctcgatataacggacgtctatttatcggaattctaatataacggacaaagaatccggtcaaatgtaaaaaaaataattattctctggtatccgccccttcttatgttaggggcggcgacggcttcaaatatttatctgtgatgaactagaacatgtgctaggatgctcctgatcgattccctttaaaaagagtgttttaccacgtgcattacactcaaaatttttagccctaatagatttatgatcatttttaacatatgtttcaatgnnnnnnnnnnnnnnnnnncacaattaacgcaaaatctacaactattcgagtcattattctctgatatctacccctctatatgaggggcggcgagggcttcaaatatttatctgtgatgaactagaacacgtgctaggatgctcccgagccattccctttaaaacaatgttttaaccacatgcgttacagataaaatttctagccctaataggtttatgaacattcttaatgtgttgcaatgnnnnnnnnnnnnnnnnnncaattatcgcaaaatctacaactaatacggtcattattctctgatatccgccccgatgtggatggagtttctgcgatcgttttttggcgagcgattcccttaaaaaaaagttttagggcatacatcattattttttgatatccgcccctctctatgtgagcatgaggcttttacctgtggtcgatgtgtgtgcgaaaattctaaaaaagaaacagacttatcacttaaatatttcgtgttggtatcatgtgacgtcacatgctatgaaccggatgacgttcaac

SEQ ID NO: 6602 - DNA, 547 bp, Diabrotica virgifera
acccgggtctcggaattccccgggtcgcccctttgagggcgttttgttgttttttagtttgttttgttactatttttaagaaataaactatgactctagtatacatgatattgactatgtgagatatttatgcacacacaataacagatgttattggttggtgaaacgttaaaaagggaccatatggccactaacttactattaaccactacacccatgagccaagaaaatgtatttaaacagaagatccggaaggaaagggataagtgaatggcacaaagatctgacaacaaggagttaattctaactccaaaagtgagaaccggttaaagaaatcagtgcccaaagggacctttacgacttccaaccaacaaacattctcattagacgaaaacctaatccacacagattcgcctcttacatgcgatgcagcctggactctctagtctccggtgtcatgtcccaatatacctatatatgaaatttaggaattcaacatgatattaaccacgattcaccaatactttggaagctaagtacatgcaag

SEQ ID NO: 6603 - DNA, 779 bp, Diabrotica virgifera
  misc_feature (632)..(651): n is a, c, g, or t
ctaataacaaatatattaacaataactctattatacatatattgacaatgtaatatataaatcaaaacacaataacagtggtagtgggtggtgaaacggtcaaacaggaccaaacagccactaacttacaattaaccactacacactgcgctaagtaaatgtattagtagaaaatccaaaagcaaaagtccgtgtgaatagcacaaagttcttacaactaaaagttagtaatatttcctaaattgaactcgtctaatgagatacgtacacgacaagaacgctacggttaccaaaaattaagtatctcatctagcaaaaatactaattattatacaattgacttatataaatgagctggtcagactcttaatatacaatgtaaaaacccactagacatattccctattttaaaagctcgacaaaattttacccccgattccctatcaaattttaagctacaattatttatgattattattaaacaagacttacttaattagaaaaaactactatttataatatggaacaaaacaaagacctgaaaaccctatctgtcacgaaaatatgtacctagttccactcgattgtatgcatacaaacagtttacagtgcaagcaactatagagtacccnnnnnnnnnnnnnnnnnnnngtaaaacaaacttatctttcaccacagttcctatttagaattcaagatgaaagtcataggagagtccttttggcacgataaactggttggatgctggggtgggcagtcctactgaaaaatcctaaatg

SEQ ID NO: 6604 - DNA, 945 bp, Diabrotica virgifera
  misc_feature (8)..(41): n is a, c, g, or t
  misc_feature (49)..(406): n is a, c, g, or t
  misc_feature (426)..(441): n is a, c, g, or t
  misc_feature (444)..(465): n is a, c, g, or t
  misc_feature (515)..(546): n is a, c, g, or t
  misc_feature (567)..(652): n is a, c, g, or t
  misc_feature (656)..(683): n is a, c, g, or t
  misc_feature (688)..(706): n is a, c, g, or t
  misc_feature (727)..(757): n is a, c, g, or t
  misc_feature (761)..(774): n is a, c, g, or t
  misc_feature (776)..(802): n is a, c, g, or t
  misc_feature (806)..(855): n is a, c, g, or t
  misc_feature (858)..(875): n is a, c, g, or t
  misc_feature (890)..(915): n is a, c, g, or t
tttaaagnnnnnnnnnnnnnnnnnnnnnnnnnnnnnnnnnnccttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtaaaattgttgtttaannnnnnnnnnnnnnnngtnnnnnnnnnnnnnnnnnnnnnnattgattgaggaatgattaatttgaatggaaggggtattttgttagtggnnnnnnnnnnnnnnnnnnnnnnnnnnnnnnnnaaagtgggatgtaagggtggnnnnnnnnnnnnnnnnnnnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnnnnnnnggggnnnnnnnnnnnnnnnnnnngtttataaatttagaaattgnnnnnnnnnnnnnnnnnnnnnnnnnnnnnnngggnnnnnnnnnnnnnngnnnnnnnnnnnnnnnnnnnnnnnnnnngggnnnnnnnnnnnnnnnnnnnnnnnnnnnnnnnnnnnnnnnnnnnnnnnnnntgnnnnnnnnnnnnnnnnnnaaagggaagaatagnnnnnnnnnnnnnnnnnnnnnnnnnngatttggggaaaatagtataatttataatt

SEQ ID NO: 6605 - DNA, 917 bp, Diabrotica virgifera
  misc_feature (674)..(674): n is a, c, g, or t
aatacgacaaaaagacaagaatggatgacagagaaaattttaagtctcatggaggaacgaagacagtttaagggaaaatgcaaacaaaaatacaactagatacacaagcaaattagagatgaaataaggtcagcgaaagaaaacttttacaaaagaaaatgtgaagaaattgaagaactgcaattaaaacatgatacgtttaacctacataaaaaggtaaaagagttggcaggtatacaaaaaaggaagcatcccaatgtcctatacaacgcaaatggacaaataataactgacctacaagaaaagcttacgacatggaagaattatatagaagaactctttgccgatgaaagagaggatcatgatattggtaacatacaaggtgaggaaggaccaaaaatctctaaagaagaaatactatatgctataaaaacaatgaaaaatggcaaatcaccgggtccagatggacttccatcggaacttcttaagcttgtggaagatgaaacagtaaatgttttggttgacctctttaactgcatttataaaacgggagaaatacctaaggaatggcttctgtcaacttttgtgactattccaaagaaaacaaacgcaaaactttgcaccgaccatcgcacaataagcttaatgggacacacactaaaagtatttcttanagtgatacatacaagaattcacaaaaaactagacgctgacatcagtgatactcagttcgggtttcgaaacgggcttggaacaagggaagcactatttgcacttaatatcatgtgccaaagatgcctggatgttaaccaggatatatatatatgtgctttattgactacaacaaggcgttcgataaagttcgccacgaacacctgatgagactgttggtagagaaaaacttggataaaagggac

SEQ ID NO: 6606 - DNA, 570 bp, Diabrotica virgifera
attggtttgagattactgagacgttctctagtcaagccaaacgagatgtcttatttactgagagtaaattaggatcggactagagtgttttgcttatatcggggacacagtaattattggaagcctgcgtatctggcgatgttaccgcctacccttctctcttttagtttgccgtgcctctaccacacaacaatacccttcatcgtgtaagctagccattacggtaagcttttttgcagtgcactgctatccgagtttggacctctccatgtatgtgccatgtgacttgattggtgtggtaactatataaattgatccaggatgagctcctactgatatacacgcaagcatgtccttcaacaatgaagtccgtgccgcctaagctcgaaggattataaacctgaatggagaacaaggcatctccctagacagaaatgctgaccccgatcgcatcatcatagggaagcgaactccagctgccagagagtcctgacatgatacacggcctctcgttgcaatccccgcgcctcactctctctaattctcgtcccagtctgtatctctgtgctg

SEQ ID NO: 6607 - DNA, 891 bp, Diabrotica virgifera
atacaatcatactgaaacgtaggcaaccagttattcgatgcaaaatgtaggcagttttttcgtcttttttgcataacgaattaattaaatactcgtttaggtatcctatatttcttaaccatcactgtctacactgatttgtgattgattgttctatttctcagtcgacttctggtgctagatatgttcaagtcacaaataaaccattttgtggtggtttattgtaaacacttatattgtttgttctatattttgttctttttgactgtgaacaacacagtatctctacaaaatggtcaatttgtactttttgtcatattatttgtagtattttgatttctattaatgtatatatatttaagcattgtattaatataggacaattgttttggaaacacgtatagtttgttgttggcgcagtacagtaccaacagaatgaggtgtttggactcgaatcgattaactaatttttttaagataatcccttgttaatccagtaagcggcagatatgaactgataatacatttacgaaagcaccacttcgtactttgtattttcttctgactcattttgtaaataattaaacgaataacatctcctaatctctctggatattgtcttttttcctgggaaaactaggtaaatttctctagtatgttcgcaattttccaaggcttcactaaataattcctctggatataggttaaataatataggcgaaagtatacatccttgtctgacgcctcacagaatctggatcgcttccgtcgggtcttctccaagatttatttttattgtggctgattggttccagtataaattttgtattatacgcccgtctttataatccatttggggttttgttaagacatcatcattttttcggggtg

SEQ ID NO: 6608 - DNA, 265 bp, Diabrotica virgifera
  misc_feature (51)..(78): n is a, c, g, or t
  misc_feature (143)..(155): n is a, c, g, or t
  misc_feature (158)..(185): n is a, c, g, or t
ccccccctggagaaaaataacccccggaaaaaggcctcccaaaaatattgnnnnnnnnnnnnnnnnnnnnnnnnnnnncattttttccgggggcgcccctttttccccttttttttggcatttttcccttcctgtttttttgnnnnnnnnnnnnnccnnnnnnnnnnnnnnnnnnnnnnnnnnnnaacgtgggggggcaaaaggggttttcttcccaatggggtttccccctgcggcaaaaactctttggaaaatttttcccccc

SEQ ID NO: 6609 - DNA, 1198 bp, Diabrotica virgifera
  misc_feature (944)..(1006): n is a, c, g, or t
  misc_feature (1055)..(1158): n is a, c, g, or t
aaagtgttttaaacttgtaatgatttttaataaattgatatgtggttcagggccggagtacctcaggcggtaggatgtctgacttccatccaggtgaataagcctgaataaaatgagtaccttgggtaaaaccagaggtatttatagagcactggctctacttcttaccttccttgtatactgtaggccctagatatagcagactaccctgctataatcccaaaaccgcattaacggtataaagtttcttctttaagtaccgtgcccaaattttaggcgtgggtagctttcataacaacttgccgatatcgttctcgatctttgcccacattgcccattctcgaactccacattgcccttccaaggcttcgttaaaaattatttctgagtaaacgttaaaaaaagttagggataacgcacgaccctgtctgaaacctctttgaatgcaaattttgtctgtttctttgccgtctaccagaatagaagcttcttgattcaaatatagatgttgtaaagtctaagatctttatcatctattccaatcatttctagatattcaaacagcttatcatgttgaaccctatcaaacgccttctcaaaatctataaagcacacgtaatttggattctgtacttccgatgatcgttgaagtaacgttagcattgagaacaaagcttctcttgttctcaatccttctctaaaaccgaattgtttgtttcccattgtctcttcacatttctgcttgattctattaagaattatcttaagaggtagcttgagagagtggctcatgagactggttggtctaaagtcttttacttgatggatgtattgggtattttttggaagtgggataaatggagactccaaccatattttgtggcattatttcccagtttcttatatgtggttggaaattggttgttagttctgagaactttgtnnnnnnnnnnnnnnnnnnnnnnnnnnnnnnnnnnnnnnnnnnnnnnnnnnnnnnnnnnnnnnntccaaatggataaataaattgtttgaaattgcccaataaaaatggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacaccccccccaccttttgggcgggcgccaaaaacac

SEQ ID NO: 6610 - DNA, 783 bp, Diabrotica virgifera
  misc_feature (319)..(334): n is a, c, g, or t
aacagagacgtgtcgaatgtttaaaaagtgaacaaacttagtataaggtgtgtttctgacgaagtgcttaataattgagcaaacaaaatgtgtaataaatgatagatactcgtttgtcagtatttcgttggtgatgtttgcccagttatcgatttattctgctatgtaatgaataatggatacatggtttcgcgctgttgcaataattgaaacaaggacccagcatgtagctgagatggactgtgacaatgagaatttttagaaatttgaaatttttggctatttcatttattgcattgtatcggatagtagagtcgcnnnnnnnnnnnnnnnncagaaaatatgggtgtacatggcacggaggatcaatggcgaagttatcttgcaattgcgaaaacggagcagagatgacaatcaaagcagactccattaactccttttcgacttcagaaatcttaatcaatggatgtaagtcagttaaaatggaagcaaatgctgtagcagacatgcgaaacttaagggcattatctctaagtaaaattgctaacattcaactggatacagacagtattaactggtatggatacaaagaaaacagcggacaaatagaagaagaacggttcgacatcactgtcccttctctaaaattaacgtttataagagtaacatatcccaaattcaaagtcatgctttcgcaggtagaattagtgaaataacttttgaagatgtgaatgttgaacgtttagatccctttggggtccgttaacttactacagactgaaa

SEQ ID NO: 6611 - DNA, 847 bp, Diabrotica virgifera
  misc_feature (135)..(175): n is a, c, g, or t
  misc_feature (668)..(668): n is a, c, g, or t
ttgcgtccgcttatatgagaaaaatagactaataatcatacttaccttgataataacctgtaaaatcaataatgtttagaataaaactaacgtgaaattcacactgggattgcaagtacggttaagataggaatnnnnnnnnnnnnnnnnnnnnnnnnnnnnnnnnnnnnnnnnnagagcaatcaataactggtgaaaaccgacaaccttgtgcgtttattccccattagaaatgtattgctctatcttagccgtactgcattctcggtgtgaatttcttagtagactatgtttaaattaacattatgaatatgttaggacaacttttagaaatacagaaagagctaacattcgcgtcaagaaaataagtactgtaaggtttagagatgacacggcgtcataatggaaagtgtagaaaaaatattgtactatcttaatagtaaaataaatagacgttccttaagctcaaggtatgtattcaatgaaagccctcaatcagtggatcgacttctgcgccttatcaaattctgctagttggcggtacccgaaacatccgaaaaaaaaacaccttcattactaacctaaaaaaagatacctgccatctgctagaaatggtgaaaagtcaacgcatgcaggtggaccttatatttgatttataacagcattanaaagattaaacttaagtgaactgtaacttgtggaatgcaactctcggacttaattcatattaagaaaaccagtcagtaaatatttatgccatataaaaccatgtcattattcctcgacaaaaacttgcgattatgtaatggaattattccactatgacataaaaaggtaacatactaat

SEQ ID NO: 6612 - DNA, 497 bp, Diabrotica virgifera
  misc_feature (160)..(196): n is a, c, g, or t
  misc_feature (229)..(255): n is a, c, g, or t
ctactacccaaggactaggtacgcacgtgacagtaagagcacttggaaatgtgaaactagacgcctctcaattttcccagattgacattcgtaaaagctattacaagccaagaactgtccacgtctccctttgaagtgcaaatgctccaacccgaaatcnnnnnnnnnnnnnnnnnnnnnnnnnnnnnnnnnnnnnatattccaacctccaatgtgtcaacaaccaagnnnnnnnnnnnnnnnnnnnnnnnnnnnatcttttcagtgaatatgagggtattggatatgagcaaaccttctaactgatgttgaagaaactaccaacatttggacaaagaaggaagtgtcaacagagtatcgcttggatgtttgaactagattgagatacacgaggtgtacaaggagttaatgacgttgtctctctgaaaggactctctgaggaatcccacttgcaaggaaactcaaaaagaaactccccatttcaaggaaatttaaaa

SEQ ID NO: 6613 - DNA, 71 bp, Diabrotica virgifera
  misc_feature (27)..(27): n is a, c, g, or t
gggattatgtaacttttttgagactanacaatggcaaaaatcaatacagcacttgcagttcttttattcat

SEQ ID NO: 6614 - DNA, 886 bp, Diabrotica virgifera
  misc_feature (30)..(49): n is a, c, g, or t
  misc_feature (141)..(159): n is a, c, g, or t
atttcagatgtttacctgatgcatttttcnnnnnnnnnnnnnnnnnnnntataaatgaaataccgattaaaaatagcacaaaatcaatgtagctacacctgaaaatgagtttttaagtgaatctaacttgtgaatagaacnnnnnnnnnnnnnnnnnnngaacaaaaatggtttgtatccaagttcaaatagggctcaaaagcttctttttgtcattcgcgttagtagcaattgtagctttcgtacaaatatattatagtattatacacttttggataaatgttttgatgttttctgccgccggcgttatagattttgtattagtaaaagtgttcttcaggagatattttccatttcaaattgctgttagagctgcattcttaggctatgtatttgccttagggatatttgttaaattagttgttccatcccatatacaaatatttgggagttacatttgtgtgatgtcattcttccattttagtgaatttatagctatagggctagtccaacctaaatttgtatctactgactcctttgtcttaaatcacagcccacagtatatagctgctgcagtttcttcctgggtagaattcttcgttgagtactacttctttccaggcatgaagcaattttattgggtatccaatattggattgggtatatgtgttcttggagagctattgagaaagactgcaatgttgactgctggatcaaattttaatcatttggtccaatgtgaaaaatttagtaatcatactctggtcacgtatggagtgtatggctggttccgacatcctagttatgtaagatggttttattggtctataggcactcagattttattataaaaccctctatgtgtacccgcatatgctttggccag

SEQ ID NO: 6615 - DNA, 77 bp, Diabrotica virgifera
  misc_feature (2)..(75): n is a, c, g, or t
gnnnnnnnnnnnnnnnnnnnnnnnnnnnnnnnnnnnnnnnnnnnnnnnnnnnnnnnnnnnnnnnnnnnnnnnnnnga

SEQ ID NO: 6616 - DNA, 1146 bp, Diabrotica virgifera
  misc_feature (836)..(848): n is a, c, g, or t
  misc_feature (850)..(885): n is a, c, g, or t
  misc_feature (908)..(926): n is a, c, g, or t
  misc_feature (1043)..(1069): n is a, c, g, or t
aattttttccaatttatgtacttccaatatgtaggtatatatttcttttgtttttcaaattacaataaaaaatgttggattggtatgaagaagttgaagaatttttagagtttatttcttatattgtagaagaaaatcgcccggaaagtatacgaaagccatgtgataaaattatatcaaatccaatggaattttacaatattgaatttcatcagctgcaataacttaaacaacaaagattttatgctactttataggaatataaccagtttttatgaagttgcccatttcaaattacagctctttcatgttctagaagcgagattatgaatgttgttggttgttggtgaacaacagggtcaagttatgttggcttaatatttgatctaagtgcattaagaggtatcatgagaaagagtgaaattccaggattacgtagatacgcatgcaaatactatctatttacttcagtattacagccagggtaatgatcaagaaaaaagatacaatagtggacatgtaagaacaaaaaaggtggccgaaaagctatttggaacctggaaaaaacagtttccctgtctttcaaagttctaccaaccgaaataaatatataaccttgcgaaaatgtgctacaaacagaccttataaaattataatccgcgggggcagaaaaaaaacatggagggggatggagaattttggtaaaaaaactttattttttccggcaaagggaaaaggctatggatgtgggaacatggtttaaaattttaggagggatttttttccgacaaaatttctttttgggaatggggaaaaaactatttgaaaaactgggnnnnnnnnnnnnngnnnnnnnnnnnnnnnnnnnnnnnnnnnnnnnnnnnnttcttctggggaattttttggcnnnnnnnnnnnnnnnnnnntccagaacacaagggggtggaacaccctttttttttgtggtttgggcccccctccccaaacaaaaacccccccccctacaccatacttgaaaaaaagaaatttttgtggcttctcannnnnnnnnnnnnnnnnnnnnnnnnnngagcgaacaccaattatattttccctccccccaaaaaaaactctcttggtctccccccccgcgccagggggcaacgg

SEQ ID NO: 6617 - DNA, 173 bp, Diabrotica virgifera
ccccccttttcgttctacaaagataatgaaacccgagtactaacaccaaatgtgttatcaagatgtaatggaacctctgtacaatcaaagtcaatggagaccatgggtgcggattatgcttaacatcgaagatatacaagtgttcgagcacacaacgcgtgcatgcatggacc

SEQ ID NO: 6618 - DNA, 847 bp, Diabrotica virgifera
  misc_feature (203)..(227): n is a, c, g, or t
  misc_feature (373)..(390): n is a, c, g, or t
  misc_feature (557)..(594): n is a, c, g, or t
agaagtgtctagctcttctttccctacaaacccttatcggagctgcctactacccatgtactgttaggtaggtgacagtatgagtagctggaaatgagaaactatatcagatctctaggttccctgattgacgttctgagaagatccttacaacccatgaactgtcgacgtcaccctcacaattacaaatggtcctgcctaannnnnnnnnnnnnnnnnnnnnnnnnacggacatctacttggttattcccacctccaatgtgtctacaaccaaggtggcaaccgggctgatggtcttgctgatcttttcattgatatgagaggattgtaaatgacctcagcttcatacagctcgctgaatcaaacttcaacnnnnnnnnnnnnnnnnnngatcttccccaaatcattcttggatgttgtacagaaactgagatcaacaaggcgtacatatgtcgttagtgacattgtgctctctgctaggactctctggttatggcaacttccaaggacaatcatgagtatattccccactactagagatcttatctaatacatcnnnnnnnnnnnnnnnnnnnnnnnnnnnnnnnnnnnnnnccccactccaatctttgcagatcatcttgctgcacatgcatcaaccacatgcacttcaactggaattattgagacaatagcaatacttgcctctgcagtatttgaacgctgagtatctccaaaaccgagacattgtgaccaaccatatcttaaacctcatctacagacgacagcaacaacttggacaaggcataccagtaccactataccactagcaacagattgatacatgccaaatcttaaacctcatcta

SEQ ID NO: 6619 - DNA, 323 bp, Diabrotica virgifera
  misc_feature (14)..(57): n is a, c, g, or t
  misc_feature (60)..(75): n is a, c, g, or t
  misc_feature (77)..(110): n is a, c, g, or t
  misc_feature (112)..(139): n is a, c, g, or t
  misc_feature (163)..(222): n is a, c, g, or t
  misc_feature (226)..(314): n is a, c, g, or t
cgtggctaaagggnnnnnnnnnnnnnnnnnnnnnnnnnnnnnnnnnnnnnnnnnnnnggnnnnnnnnnnnnnnnncnnnnnnnnnnnnnnnnnnnnnnnnnnnnnnnnnngnnnnnnnnnnnnnnnnnnnnnnnnnnnncagaaaaccctatagagtttatcnnnnnnnnnnnnnnnnnnnnnnnnnnnnnnnnnnnnnnnnnnnnnnnnnnnnnnnnnnnncggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaggg

SEQ ID NO: 6620 - DNA, 889 bp, Diabrotica virgifera
cgagggttgaagtgccatgatgcaattagaaaaaacaagaaagtgtcgaagtgtcctcctcgaaataaaaagttacctgtgttgtgttttgtgttggcaaattttttaatgtgtctttagtatgtcaaggagatttcagcaaagaaaacggggtgattaccaatccagaaacaacgaacaaaatttactcttgtcagtgggtccatcagcgtacagatgtagcaaaagaaagaacatttgctgtagccctcacagtaaatactagtcacgaaaaatctggaagtgcatgttcctattcgccagtcctcgttgaaattactgccgctgataagaagacgagtttgttcaaggtgtgtgccacaacaactgctcccgttgttataagatctccgtttttggttaccaaactatcggctgcagctgcaatgaaattcacactgaactttacagcaacttatagcactcacgactgtggtggcatggttcacgaccagtcaggagttatctcaagtcctggatttccaaacaagccatccaagtcctatgagtgtgcttggcttctttcagtaggtgcaggccaaactataaatataactactctgtcgctatctcttggagatgattgtgaaaagagttacttagtagtttataatggcgaacttcctactcatcctagaataggcaaattctgcaagaacacaaagcctgaagtattgatttcgcagagcaacaaactatggattgagtacaaacatgaccaaacctctacaggtacaggatttatgttgaaatatgaagccatgagttcaggttgtggaggcgtttttcatgatctaaaacgtacaattaagacaccaaattatggcggtggcgactatccacataaagc

SEQ ID NO: 6621 - DNA, 109 bp, Diabrotica virgifera
  misc_feature (2)..(14): n is a, c, g, or t
  misc_feature (16)..(31): n is a, c, g, or t
  misc_feature (33)..(54): n is a, c, g, or t
cnnnnnnnnnnnnncnnnnnnnnnnnnnnnncnnnnnnnnnnnnnnnnnnnnnncattacatatacccctcccgcctgccccactgcattaatttcgaatggcccgcgt

SEQ ID NO: 6622 - DNA, 585 bp, Diabrotica virgifera
  misc_feature (334)..(348): n is a, c, g, or t
  misc_feature (350)..(376): n is a, c, g, or t
  misc_feature (378)..(400): n is a, c, g, or t
  misc_feature (411)..(431): n is a, c, g, or t
  misc_feature (433)..(452): n is a, c, g, or t
  misc_feature (457)..(564): n is a, c, g, or t
agctgcactcagtgatcctctcatcatcgtcgcctactctcctgtgcatgaattgtgatgtttaatattttaccgctccctactataagaaatatccaatgtcatatgtatattaaacttgaccatgctgatgatattatcattcaaaaattggatattcatgaagaatatatagaggtcctccaaggaattcaatcccattttttccacctgttccttcgaatcctgtcgttttgaaataaatagaaaggctcgcctgcccactgatcactgtgactggccgcgtgattgtgaccgcgctagcggaccataatcattagatgttttattgagnnnnnnnnnnnnnnncnnnnnnnnnnnnnnnnnnnnnnnnnnncnnnnnnnnnnnnnnnnnnnnnnncgttaactacnnnnnnnnnnnnnnnnnnnnncnnnnnnnnnnnnnnnnnnnnggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttgatcccaatttttt

SEQ ID NO: 6623 - DNA, 56 bp, Diabrotica virgifera
ttttggcgtccggatcgataagcatctacgttaagaagaaatattttaccacaaat

SEQ ID NO: 6624 - DNA, 94 bp, Diabrotica virgifera
aatcttttttgaaaaacctttttttttctcgggggaaaaacgggttggtttgacaaaaacaaaaaataaccaccccctccacaagggggggggg

SEQ ID NO: 6625 - DNA, 717 bp, Diabrotica virgifera
gtccggtgacttttatgtattctttcgtataaattataactcctcctgtatgacgactactagaatcacaacgcgccattacatattcagggatctgtagctcagaatctgaaaaatcgctagtgatacaagtttccgttaaacataaaatgtgtgggtcatatacctgaacataaagtttgatttcatcgcaatgtttatagtaactttcagcattaataccagaaagaaggagattatctgtacacttttttatttgtgcgagcaatatttgaaggcgtctttgatggctagatattataccctattctttctttgacttttaataactgtcttttgataactactacaatttctatcaaatacattatggatataattaacatgttcaagtttaagaatttcattcgcctattttacagcttacacaagtaaaattatcgttagtaactcttcttttttgtgtttgactccccataatggactaacatcctgtgaaagaacattttatctgccaaatgtcccaatttcccagaacccaaaaaacaacgaataaaaattaacgcggtccaaaaaaaactggaacctaatttccctctcccttttggatttttttacctttgccattaattaagaaatttaaaatatatctcggcgggaaatttttcccatttataaaattataaggggttttacggggtaatctatattttcccg

SEQ ID NO: 6626 - DNA, 898 bp, Diabrotica virgifera
  misc_feature (823)..(823): n is a, c, g, or t
  misc_feature (850)..(850): n is a, c, g, or t
tgaaaagtgttggtagtgatttaatgttgatgtaaactactttaaaatgtctggtaatgaagaaaacaacaagtgtatgaggagatggacatttatttgcggtaccgtgacagctatggcagctgttttggtcttcttgggagtaggaataaaagcaatccacgtcagtggaattcccgacagagaactgaaaatggtccatatagttatgagacacggtgctagaactcctgtcagtacttatcccaacgacccctacaaaaatgatccattataccccactggatggggacaactaaccaacgaaggtaaaaaagctttatacgaaataggaaaatactacagggaacgatatgggaaattccttggagacaaatactcacccgacgaatactacacccaatcaacagacgtagacagaacgaaagcaagtatgatgttggtaaatgccggattatggccccccaaaggtgaacaagtatgaggacccttggactggcaaccaatcccagttgcttctgaacctctatcacaagacatgcttttacttgtaagaaaaccttgtcccaaataccacgttgagaagaagaaagtttttgaatcgaaagaagtcaaagatatgcttagtaaatatgaagatctctacaaagaattgacagacatcacaggtcagaaaactgaagattttgcatggagttcaggatatttatactactctcatggctgaggagaaatccacctaaaattacctgactggactacaaattattatcccgataggatgtatttccccacagtaagaagctttgtattgaatgcatancatgaccagatgaacatgctgattggnagtgtatcggtaaaaaaacttattgaagactggtcagctaaatctgaa

SEQ ID NO: 6627 - DNA, 222 bp, Diabrotica virgifera
cccccttttaaacgggaataacaagaagaacttgagggcgcccgcccctttaggatcgaataattatagaagaaagaagcagcttcacatgcgatgagtactagaactccaagcatggagcgacctcactcgaccagggaagcctgcggaatgtctgtcctgcggaggcactcacccttgtgtatcagtcactaacaaacgcgacgcgtatagtagtgcgaa

SEQ ID NO: 6628 - DNA, 591 bp, Diabrotica virgifera
  misc_feature (33)..(67): n is a, c, g, or t
acttttatcaaaacaaaaacatgtttatatgannnnnnnnnnnnnnnnnnnnnnnnnnnnnnnnnnnctgaaatagcccgtaaacgaaagttattggaagaaaaagaactcctaggcactgataaaaagtattttaaaagaggagaacttatagccaaagaacaagaagattacaggaagaagtattattctcttaatgaagcagacgataagtcctccaccatatcagatggtgacaaaatcgagtctgatgttcaacatagtattttacctcgacaagaagtgataacgcggttaagagatagaagcgagccagttcttctttttggtgaaacagaaatagatgcatttacgagactacgaaaatgcgagcttctagaaccggaagtgaacaaaggttttcgcaatgactttcaggaagccatggaccaagtggatcaagcttacctcaatgagctgctgaaagattctgaggcaaccaaaagtatagagaaagttgacaagaaaaaacatgaagcaactattggatatgaagcaatcagagaaatggctaagagtatggggagaggcaacagggaacatgacatgact

SEQ ID NO: 6629 - DNA, 1110 bp, Diabrotica virgifera
  misc_feature (495)..(577): n is a, c, g, or t
  misc_feature (836)..(853): n is a, c, g, or t
  misc_feature (902)..(924): n is a, c, g, or t
  misc_feature (944)..(965): n is a, c, g, or t
  misc_feature (969)..(989): n is a, c, g, or t
  misc_feature (1077)..(1089): n is a, c, g, or t
  misc_feature (1091)..(1103): n is a, c, g, or t
agccaacatgaatgctcaagtagggttatgtagaccaggtgactatggcagtgatgtatctcacttgaatctacataaaaccttctgtattcctcatggtggaggtggtcctggaatgggtcctattggcgttaaatcccatttggctccttatcttccaggtcatccagtagtaatgcctcttggccataatggtacttctgaaggagcagtcagcgccgctccttatggatccagtgcaattttacccatatcctgggcttacataaaaatgatgggacccaaaggtttaagaaaggctacacaaattgctattttgaatgctaattatatgtcgaaaagactagaacctcattacacaacattatttaaaagttcgacatcaaatctggtagcacatgagtttattatcgatactagggattttaagaaaactgctaagattgaagctgcagatatagcaaaacgattaatggactatggttttcacgctcnnnnnnnnnnnnnnnnnnnnnnnnnnnnnnnnnnnnnnnnnnnnnnnnnnnnnnnnnnnnnnnnnnnnnnnnnnnnnnnnnnngatttcgttagtatctataagacaagaaataagagatatttgaagaggccgctctgacgctaaaattaaccctcttaaaatgcctccacacaccccaagaacaagtgataagaagttcgtgggaaagaccgaattctagagaacaggttgccctttcctgccccttttgtaaaaccgaaactaaaaggtggcctacagaactaaaataaaatggacatttttttggaaacaacatttagttttgtaccggccccccaannnnnnnnnnnnnnnnnnaaccaaaatcagtttttaatggggctttatatggggtaaggtaaagggnnnnnnnnnnnnnnnnnnnnnnncccggtgggttggggaatannnnnnnnnnnnnnnnnnnnnngggnnnnnnnnnnnnnnnnnnnnncttgatacattttttgggaaaacttggaaattacaactcctcctccccctaaaaccctccgaaaggggtcgaaaacaaaaagagaacnnnnnnnnnnnnncnnnnnnnnnnnnnatttttt

SEQ ID NO: 6630 - DNA, 791 bp, Diabrotica virgifera
  misc_feature (660)..(660): n is a, c, g, or t
  misc_feature (671)..(673): n is a, c, g, or t
gtgcgcgtacagtgtatttaatagtaaaatcgagacaatttaaacgttcatagttgaattgaaatgccaacatgcagaatgtttcgcaagaatcctctacagataatccgaaaatagataaagtgactgttctacacgaactagggaactcatcgtctactccccaatcgacgacatccaattcaagtccagctaaatcagaaacagaaacgtattccgaacatcgcagatatatgtcagaaacatcagaaagcgaggaagatagtgtatcagaggtggaatcatttatgattgatcaggagttcgaagacgatccccaagtagaggcggccaaatttctcttgaaccctgacgaagaccgagccgtagatcccgaaacccaggcgagactagagcagctcttacaagcagccggtgagttagaagagtgtacaggggatatttagtaatttataggtattggccagctagcccgccaagatggtaagcatttaggcgaccccgaagtgcttcgccgtctcacatccagtgtaagttgtgcattagacgaagccgcagctgcgctgacgcgcatgcgctccgataatccaccgaacagatccagtaacaccagtaacggcagtaccgcctcagctgcgacagtagcgaacggaacgaacnggtcagccggnnncaacacacaactcacacagcagcagtcagagaagacttctttggttgaggcgtgtaccgatggtgatgtccgaactgtgagaaactgctcacagaggtcgatccgtacacgaaacttc

SEQ ID NO: 6631 - DNA, 939 bp, Diabrotica virgifera
  misc_feature (571)..(608): n is a, c, g, or t
  misc_feature (739)..(739): n is a, c, g, or t
  misc_feature (769)..(769): n is a, c, g, or t
  misc_feature (783)..(783): n is a, c, g, or t
  misc_feature (815)..(815): n is a, c, g, or t
  misc_feature (824)..(825): n is a, c, g, or t
  misc_feature (887)..(888): n is a, c, g, or t
  misc_feature (909)..(909): n is a, c, g, or t
cgaataaaacataatatccgtactaatcctgaaaatgccagtccgatttatactagaaattatcggcaccctcacgttcataaaaaagaggtcaataaacaaataacaaaattattagagcagggaataattcgcgattctgtcagtccttggaattcgccattttttattgtccccaaaaaacctgacgaaaataatgttcaaaaatggaggatagtaattgattttagaaaattaaatcttatcacggttgacgatagatttcctatcccgaatattagcgatattttcgaccttctcaatacctctaaatttttttctacaatcgatctggcgtcgggttttcaccaaattcccatgaatcccgaagatatcgaaaaaacagctttttccacagaaaacgggcactttgaatttactagaatgccgtttgggcttaaaaacgctcctagtacctttgctagagtgatgaatgacatatttcgagagcacataggcaaaacatgtttcatttatatggacgatattttaatttttagtaatacagtcgaagatcatcttaaaaatatcnnnnnnnnnnnnnnnnnnnnnnnnnnnnnnnnnnnnnngatcgaacctgataaatgtaagtttttaacggatgaaataactttcttaggtcatttattgacaccggaaggtattaaaccagacccgaaaaagattcaagctattttagattttccagtcccgcaaaatncaactgaatgtaaatcatttctcggcttantttggctatatagngaatttgtaaataattttgctgatttaactanacctctaanncgggtttgtgaaaaaaaatataaagtttcatggtacacccgaagtagtggaatgctttgacnnaatgtaacattttttgactcngaaaaaattctgggttatcctaatttctct

SEQ ID NO: 6632 - DNA, 807 bp, Diabrotica virgifera
  misc_feature (579)..(579): n is a, c, g, or t
gaaacatgtgccaagaagaccaagtcgcgttgttgaaaggagggtgtacggaagtgatgatggtcaaaagtgcaatatactatgatactaaaatacaaagttgggagattccacacacgagcgaaaaattcatggtaaactcaaaaatactgaagctaatcaataaaggaaacgtatataacgaacacgaaacgtttattaaaacgtttagtcctctttggaaaggcgatgaaaatattattctaatactatgtatgattcttttgttttcgccagacaggccgaaggtcgtacatcaggatgtgataaaactagaacagaatgcatattactaccttctgagaaggtacctcgaaagcatctaccccggatgcgaagctaaatcagttttcttgaagctaatgcaaaaacttggtgacgtgagaagagtcaatgaggaactaatcagcgtctacttaaatatcaatcctacagacgtagaacccctattgattgaaatatttgatttgcatcgttagcaaagatattatactaggtaacattttctagaagaagtcgagatattgtttcatgtaactngaacggtgagatcattcctttaaacgaatttagtctattagttttgtcaagtcgattgacgttcaggcgataggaagaaagaggtttatgtagaatgctagtcatgtggaggacttcgtctgtagaatttcgtgagtcagtgaaagttgcaagaggtaaaatatctcatttggccacccgttacagttaataaaatattcatttgtgccatttttatctatattgatt

SEQ ID NO: 6633 - DNA, 651 bp, Diabrotica virgifera
  misc_feature (414)..(435): n is a, c, g, or t
  misc_feature (528)..(552): n is a, c, g, or t
  misc_feature (595)..(612): n is a, c, g, or t
aaaggttgtaggccagggctctttcgtggccgatcaaaatccactgaggttcagagtgtatttttgtaacttgtagcttgcttttgtgtcagaaatgacgggaatttgtttaaattataattcataaactaacaaacatacataaatcatttttacataatgcagtttgttcctctaaaaaagacctacaaaatgatgtttggtaaaccttgatcaaattattagaaccagagacattgcaaaattattgcaagaacattgcaaaattacggcggttaggcgatttttcacttataacagctatctcgatataatactttataacagctcaaattaaaggaaaaactaccagctttaacattaaaccttaagtataaacgaaactaacaaagataaggaaaatatgcacgaatnnnnnnnnnnnnnnnnnnnnnnctgaaaatgttccactatgttgtattttttatacataacttttattttttacctttatacacacttacgggtttttattataatattacaaannnnnnnnnnnnnnnnnnnnnnnnntagaaatttttttccaccatattgaaaaattgttccattttgnnnnnnnnnnnnnnnnnnctatacattactctataaagggtgggtttttaagaatga

SEQ ID NO: 6634 - DNA, 745 bp, Diabrotica virgifera
  misc_feature (429)..(453): n is a, c, g, or t
  misc_feature (504)..(531): n is a, c, g, or t
catttgtcaaaataaaactataattacaaaaatggctgagaaaaagagaggcaagaaaagaaaagatgagtacgttcacccaggagaagaaatcgatgacaaaccgacaaaagaagagattaccgtcgccaaatggatgagaagtaatgttcagattaagaaaactaaatttgctaaccacaatgtggaatattttacaggagctcgagcagtcgacgcactccttaactcaccttttgcaaccaaagacgatccactcttcaagactcgagaaggtattgccgattatctccacgtcatgctaacgcacaaactcttccatcgggcacgtaaagtaccggtagacgaacaagaattgaaaggaaagaaaggcaagaaaaaagataagaaagaagataaagagaagaaggattctggagaggacgagannnnnnnnnnnnnnnnnnnnnnnnnggtgactgacgcggaaagcagtgtcgttgaaggtagcaaggatcaaaagcnnnnnnnnnnnnnnnnnnnnnnnnnnnntaaattggaaatgcattatgaccaacgttttgaagataatttagatgcctacgtttggatatatgatccaattcctttccactattggataatcggtactttcctagttttgggagctattggaatctgtctcttccccttatggccaccatctgtcagattgggagtatactatctcagtgtgcctgcagctggcttcctggtatcgattatt

SEQ ID NO: 6635 - DNA, 649 bp, Diabrotica virgifera
ctattattcagatgtgccacaggtgaaaattggcctagcataatgttatcgtgtgtgaaaggcaagatgtgtgacgaaaattcgggaaaagacggacaccagtgtggtcacaatatagcttatgcctattttgtgtcatttatattcttctgttcgttcttgatgttaaacttgttcgtagccgtcattatggacaattttgattatttaacacgtgatccttccatattgggtgctcatcatttagacgaattcgttagaatttgggcagaatacgatccaaatgccacaggaaaaatccactacagcgaaatgtacgacatgttgaaaaatatggatccgccactaggctttggaaacaagtgtcctaatcgattagcgtataagaaattaattaggatgaacatgccagtagacgacgatgggaaagttaattttactacgacattctttgctctcgtcagagaaaatcttagcattaaaatgcgaacagctgatgaaatggaccaggccgatgacgaactcaaagagacaatcaaaaacatctggccgatccaagccaagaacatggtggagctgttggttccaccgaccaaccagctcaccaccggaaaatgtccgtcggcaagttatacgccggtcttctgat

SEQ ID NO: 6636 - DNA, 199 bp, Diabrotica virgifera
  misc_feature (7)..(44): n is a, c, g, or t
  misc_feature (64)..(77): n is a, c, g, or t
  misc_feature (80)..(97): n is a, c, g, or t
  misc_feature (110)..(131): n is a, c, g, or t
  misc_feature (137)..(137): n is a, c, g, or t
  misc_feature (163)..(188): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnaggtctgttcgannnnnnnnnnnnnnnnnnnnnnagtttnaaccgtgtgagccaggttggtttccnnnnnnnnnnnnnnnnnnnnnnnnnnaacgaaaggac

SEQ ID NO: 6637 - DNA, 600 bp, Diabrotica virgifera
  misc_feature (36)..(53): n is a, c, g, or t
ggcagaggacaaaacgagactaccccataaaagccnnnnnnnnnnnnnnnnnngcctattcgacggtgaggatttacatgaggaagaagacgaggccattgaagaacaggatgagacgcgcgaagacgacgtagttcgaaggggatgatgacgaaatagaggctgaagatgaagaggacgcacagggcgagggcgtacaagaagacgaggatgatgaccgcataataaagcgggtgccgtcgaaaccctcgcgatctttttttttttcgccccctctctcatctgcatacgcctacgtcgttactttgtggacatctttattcttcctttctcaattagttcgctgctccgttcgcgccttaataccgctaggtatgctctcccgttcgcccaacgtttgtctatggactcccattccacatcaatactcccatcccttcgactcatccctttcctcctatttatctcacccggataccctcggagacctttgcccggccggcgctcagggctcttcaggcgacccgtgagaactggctcgtgacctcgcgtgaacctgacctatctctaacttactaacggcacccccttccgatttgt

SEQ ID NO: 6638 - DNA, 934 bp, Diabrotica virgifera
  misc_feature (725)..(744): n is a, c, g, or t
gaacaatgtactagggtggtccgataagtattttgccttcaaaagaaaagtggcgatttatttttcaatattgtctccttctagctcgatacacgtgacccagcgaggcttcacccagcttcagctgcttcaatttctgaaggtctgtaaagtagacatcaatagcagcgatgaactcactaaatcgacttacatttctgcccgacgagtgacttttcaaatttggaaacgaaaagaaatcgcacagggccaaatctggagaatacagtggatgggatagtagttagtagtccgaatcgaccaatttggccatggcgacggcgaaggtgtaagcgggtgcgttgtcgtagaagagtactttttatcttccccaattggggctgttttttctgcaaatcggcgtcgaatcgatccaataatgcgccaaagtaaagccctgtaaccgttttgccctttttttcaggaagctgatatatatcacactttgtgaatcccagaaaacggtggtcatcactttttcggtcgttaggacagtctttgccttcttcgttcgcggtgcgacgtccactgtatcaactgttccttggtttctggtgagtactggtggatccaagtttcgtctatgattatgaaacaatgtagaaactccttcagattacgcttaaacagccttagatattgctctaaggtggtctcatggtggcgcttattgtcctgggtgaacnnnnnnnnnnnnnnnnnnnngggataccacccaatttaatatatacacaaaatattataattatctagtgatacaataaatataaagatatagtaaatatgtatgacaaaaattggcgatgcagcaatatagaaaaaacaaatgataaaataataagtaaataacaatataaatcacataagattacaaatttttttaaacactgtctac

SEQ ID NO: 6639 - DNA, 1330 bp, Diabrotica virgifera
  misc_feature (114)..(133): n is a, c, g, or t
  misc_feature (387)..(405): n is a, c, g, or t
  misc_feature (923)..(940): n is a, c, g, or t
  misc_feature (1008)..(1027): n is a, c, g, or t
  misc_feature (1108)..(1147): n is a, c, g, or t
  misc_feature (1149)..(1193): n is a, c, g, or t
  misc_feature (1212)..(1238): n is a, c, g, or t
  misc_feature (1282)..(1313): n is a, c, g, or t
gaagatcttgactttgatccaaatgcgaatatcgacggctgtgaagggtgcaaacgacaaacaatgtttaagaaacagcagacacctactctagtaaacaactgtattaagtgnnnnnnnnnnnnnnnnnnnncaggtacaggagtattcttagatccagacgtttatactttcaacaactactcgaaagttgccaaagaaaataatgaaaatcaactcgatactgtcctatatccagaatattttcgaaaatcggatagtgttaaaggttccaacgagaataccgtcagtccgtttgtcattggaataatagaagatattaaagaaccaaaaaataagaatatcaagatcgaagtcagaatcttctttagaccggagcatactttnnnnnnnnnnnnnnnnnnntatacaaaggacttaaattatttgttttatagtgatgaagtgattactgtgccatttgacaaagtaatgggcaaatgctatttgtcgtacggatataattttgaatctccaacagaatggtctgaactaggaccatatcggttctatttcaccgaagcatacgatccagaaaataagaaaataacagagcttcctacaaatgcgaaaaatataggcataaaaggaaaaggataaggtggcggcaaaataaaaggtaaagcgaaactagaaaacgatcttgcggacttaccacccgtttgggataaagttgatagaccactaagatgtatggatgtattcgctgggtgtggaggtctttcagaaggactaaaaatgagtaatattgctgattctcgatgggcgatcgagaaaaaatacctgcagcaaattgcatttcaaatgaaaaatcccaaattggaaagtatttcacggatggcctgcaataatttggttaaaattgaatagggaataaccgaagnnnnnnnnnnnnnnnnnnaccccaaaaaaagggaaaagccgagaatataaggcggggggaaccaccctttgtcacggggttttcgnnnnnnnnnnnnnnnnnnnnttccaaaaaatattttttcccttaaaaaattccctttggtggtttcctggtaaagtttatggggaaatttaaaaggccggnnnnnnnnnnnnnnnnnnnnnnnnnnnnnnnnnnnnnnnncnnnnnnnnnnnnnnnnnnnnnnnnnnnnnnnnnnnnnnnnnnnnngcccctcttcacaccgggnnnnnnnnnnnnnnnnnnnnnnnnnnncatcccaacactgggcgaaaaaggggggcgcccacccaaccatnnnnnnnnnnnnnnnnnnnnnnnnnnnnnnnncccgcccccctcccccc

SEQ ID NO: 6640 - DNA, 1007 bp, Diabrotica virgifera
  misc_feature (65)..(82): n is a, c, g, or t
  misc_feature (906)..(927): n is a, c, g, or t
ccggattctaacctaactttgtttgttattgtttgaattttgaatatttttaattcagttccaannnnnnnnnnnnnnnnnnctaattacaataaaaatgtatgaagaagtaaaagcatttttagagtttattgataatattggagaagaaaatcgcccaagtatacaaaagcgatatattcaagataaaaatataatctaaaatacaatgatattacaatattgaaattcatcagcgaatcagcgcattaacttaaacaacaaaggttttatgctacttataggaatataaccagtttttataaggaagcccactttccaaaaatgtacaggtactagaagaaaaattatgtatattattgtattgttcaacaacaaggttatcaagtcattcaatatttgatctaagagcattaagagtgaaattgtgaaatggaaagaagtgaaattccaggattattaataggaatagatgacagtagtgggtatgcatgcagacactatctacttaccccagtattacagccaggtaatgatccaagaaaataagatagttttaccatagtactccatgtgagaacaagaaatgtagaaaagctatttggaacctggaaaagagagtttcctttgccttcaacaggcctaccaacccaatttatataccatgtcttgccataatatgggctaccgcatatattaatctagggaaataatgatctgggggaaaaatagacatggtaatgatgtggaacaatccctcctaaatttttgggggaattttttttcaacaatgtttttgcatggaaatacattttttgaatacccacactctttattggggtttggattttttttggccgaattaattttctaaaaagggcccatcttgaacctttggcccaacannnnnnnnnnnnnnnnnnnnnngggccccttgggggagataccgccccctcttcccgactacatttccagggagtttggctctcaacaaatttttatttttt

SEQ ID NO: 6641 - DNA, 589 bp, Diabrotica virgifera
  misc_feature (366)..(386): n is a, c, g, or t
tgtgttcgataaattctagatctccatcttatgtgtatactctgtgtactgcgaaattacctatttacattgctgtaactatttgatgagacccataagaatcgatatattgcacacctaccgtataggttatacggggtgaggcatgattaattgtatataagctgagtgcttactcaacaaaaatacataataatacgtgtatatatcctaattctagcatccatcgtaccaaaattggtgaaggtgataacgttactctcctaatgcgtacctacaaataaacgtcttatatcgactgaatactatgattattgaaatattatatataagatatgaaaagaagttatagatgacgacttgtgnnnnnnnnnnnnnnnnnnnnnccaaacatgttatacctaatgttataccagttgtcacccgttagctaatgtctaattaaataaacttcccttcttcttcttatgcaatccactaatggatgtccgcgatcacgtttgaccatttttctctatgtattgtaaagagtttatattgttataacatataaaaatcaggaattgacacatgaaattgctgaaacacc

SEQ ID NO: 6642 - DNA, 658 bp, Diabrotica virgifera
  misc_feature (9)..(42): n is a, c, g, or t
  misc_feature (44)..(459): n is a, c, g, or t
  misc_feature (466)..(503): n is a, c, g, or t
  misc_feature (523)..(536): n is a, c, g, or t
  misc_feature (539)..(561): n is a, c, g, or t
  misc_feature (569)..(591): n is a, c, g, or t
  misc_feature (621)..(652): n is a, c, g, or t
ttaaagccnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6643 - DNA, 976 bp, Diabrotica virgifera
  misc_feature (116)..(838): n is a, c, g, or t
  misc_feature (848)..(883): n is a, c, g, or t
  misc_feature (885)..(897): n is a, c, g, or t
  misc_feature (899)..(911): n is a, c, g, or t
gacccccttccgccgtgcccggccgcatcaggggattgattaagttaataatttatatactttatctatttctcgaatttaaaagagctaacaaattaacaatttgttattagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccttttcnnnnnnnnnnnnnnnnnnnnnnnnnnnnnnnnnnnncnnnnnnnnnnnnnannnnnnnnnnnnnccctaagggatacaggcgtaattttatttggaagaggtcaaactcgataataaaagattgcccac

SEQ ID NO: 6644 - DNA, 1072 bp, Diabrotica virgifera
  misc_feature (212)..(228): n is a, c, g, or t
  misc_feature (950)..(974): n is a, c, g, or t
  misc_feature (999)..(1044): n is a, c, g, or t
accatagattgaggcaacatatgcaacaactccatcattttcagcgtctctttatgttgtctattgattattttgtttcattcaagagtctaatattttactggaattctattatcacaaaatttattcaatgactccgatgaaagaagcttcgcctcctgtatcggcgatggccaccccaacaaatagcagtggaaatcttgtggacgaannnnnnnnnnnnnnnnngcattgtttaaacgtcctcaccaaagaagaagctctacctacctcagacaaagacgaagtcaaagtagaagtagaacaaactactcttcgttttatagacttagctaggcaaatggaagcattttttctacaaaaaaggttccttttatctgccctcaaacctgaaatgaatgttaaagaagatataagtgaacttagactggagttagctaggaaagaggaactgttaaaaaggcattatgaaaaaatagctgtgtggcaaaatttattagctgatattcaaagctattcgaagagtcctgcacaaagttctgctacaccaggtactagctcaataccaccttcacctttgccaagtataccaggaaaccaaacacccaaccaaatgatctcaaatataccctgctacaatgcaacaacaattacagcagcaacagctacaacaacagcaacaacaggtgcaaatacacagcagatgcaacagatgcagcaaccacagttacaacaaatgcagggagatcggcgttaatttaatatttttgggaaaattaaggtatatttttttcatggggcggtttatttgggttttttcatggaaaaaatttcctccaaataaaatttaattggggattatccaggaggggatctctattttttctcagggttttgaaaaggtattcttgtcaaaaaaattccccccaaaaggatgactgaaaacctcnnnnnnnnnnnnnnnnnnnnnnnnnaacaggaaggtactttatttgaaannnnnnnnnnnnnnnnnnnnnnnnnnnnnnnnnnnnnnnnnnnnnngggtttttccaaaaaaaaccttgggaag

SEQ ID NO: 6645 - DNA, 671 bp, Diabrotica virgifera
agcagctatccttgtcctgcatggtgaccctgatctgtgtgatcatcatgaccatgatctcgtataccatcttcaccatgaacatgatgatactcacttacagctccgaatccagatagctgcagaccttctatgtgaatggtgattttacccctcacgatcttggaaattaagatgcaggttagaggcacaccaaaaacgaattatccggacacctccatgatcatgaaaacggctaagaaaaatcttatgatcattggggggctatctgtagcgaccaacgccctgattctgctgatgctgcacctgaactcgaacagcccggatatggcctcaaccttggccatggacatgcaccggaacattctagacatgctcgatcatgacatcttaaagaataccccactctgactacctatggagatggcggatcatctgcaaactcagaagatactacaagccgacaatgtcgtcgattggaccgatacgaatactgaaccattccatatcggagacgtgacctccgttataacaacctacagaaatcatcaaaggtaccaatgagaatagcggtcgtatctccaatgaacaagacaataataatgcagatgacaatatcaccctgaaggctgctactgagaagcacgatgtcccattagcaagcgcatccc

SEQ ID NO: 6646 - DNA, 549 bp, Diabrotica virgifera
  misc_feature (17)..(68): n is a, c, g, or t
  misc_feature (84)..(263): n is a, c, g, or t
  misc_feature (266)..(278): n is a, c, g, or t
  misc_feature (291)..(319): n is a, c, g, or t
  misc_feature (331)..(419): n is a, c, g, or t
  misc_feature (421)..(436): n is a, c, g, or t
  misc_feature (469)..(508): n is a, c, g, or t
  misc_feature (518)..(541): n is a, c, g, or t
gggggggttttgttttnnnnnnnnnnnnnnnnnnnnnnnnnnnnnnnnnnnnnnnnnnnnnnnnnnnncccccccgcgcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnctctcttccctcnnnnnnnnnnnnnnnnnnnnnnnnnnnnnaggagaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnncaaacaacaccccccccctctcttttcttttcnnnnnnnnnnnnnnnnnnnnnnnnnnnnnnnnnnnnnnnngtcctttttnnnnnnnnnnnnnnnnnnnnnnnnggggggga

SEQ ID NO: 6647 - DNA, 685 bp, Diabrotica virgifera
  misc_feature (2)..(30): n is a, c, g, or t
  misc_feature (35)..(62): n is a, c, g, or t
  misc_feature (64)..(96): n is a, c, g, or t
  misc_feature (98)..(133): n is a, c, g, or t
  misc_feature (175)..(217): n is a, c, g, or t
  misc_feature (297)..(349): n is a, c, g, or t
  misc_feature (352)..(377): n is a, c, g, or t
  misc_feature (390)..(448): n is a, c, g, or t
  misc_feature (450)..(476): n is a, c, g, or t
  misc_feature (586)..(618): n is a, c, g, or t
  misc_feature (653)..(677): n is a, c, g, or t
cnnnnnnnnnnnnnnnnnnnnnnnnnnnnnattcnnnnnnnnnnnnnnnnnnnnnnnnnnnncnnnnnnnnnnnnnnnnnnnnnnnnnnnnnnnnncnnnnnnnnnnnnnnnnnnnnnnnnnnnnnnnnnnnnggatgagcttacaaataaaattttatcaaaattcaatttccnnnnnnnnnnnnnnnnnnnnnnnnnnnnnnnnnnnnnnnnnnntatcattcattttcatatcttattattttccatccttatcaattctctattaaaatataaatttcaattatttctattcnnnnnnnnnnnnnnnnnnnnnnnnnnnnnnnnnnnnnnnnnnnnnnnnnnnnnccnnnnnnnnnnnnnnnnnnnnnnnnnncttttcacctgcnnnnnnnnnnnnnnnnnnnnnnnnnnnnnnnnnnnnnnnnnnnnnnnnnnnnnnnnnnncnnnnnnnnnnnnnnnnnnnnnnnnnnncaggtatcataatcatcatcttttctattccaagctggaatgaaggggtggatgaaccataaactgtctttatttacttcatcaacaatcttatttttacgttatgaagnnnnnnnnnnnnnnnnnnnnnnnnnnnnnnnnncgagttttatcatattattcataagttttcttacnnnnnnnnnnnnnnnnnnnnnnnnngtatttaa

SEQ ID NO: 6648 - DNA, 434 bp, Diabrotica virgifera
ggcatggggatttgttagtattttggggagtttttcaaaggagagtaccgtttatgtagactggtgtgatttgagtgtgtagatctataagaggtccttaactagcttaagaatatgagtgagcgtcatattagggatcatgatgtatatgaatagcttggtcgaaaagtgaggcattgaggccgagaataagaagtaacaaagcaaaatatgtgacaaaaagaccatcaagttgaacagatgggacgaatacatatgcgctacatcaagtaggcagacgcagagttggatgcgacggcatggaactggtgccaaaccaaaatataggataagaccctggcgcatggataggaccagtagagaacaggagtggattgggtcaactttttgttttttttgacgaggaccactaagagaataactcatgtatttat

SEQ ID NO: 6649 - DNA, 52 bp, Diabrotica virgifera
actatacctaaatagcggacagccgctctacattatccttatttactgagct

SEQ ID NO: 6650 - DNA, 936 bp, Diabrotica virgifera
  misc_feature (36)..(54): n is a, c, g, or t
  misc_feature (115)..(135): n is a, c, g, or t
  misc_feature (510)..(539): n is a, c, g, or t
  misc_feature (810)..(810): n is a, c, g, or t
aattcagggaatgcacatttaaaattattcctttannnnnnnnnnnnnnnnnnngcattgcccgaattagtaatttttggaaatcggaatcacagtataattaaaagtgtattannnnnnnnnnnnnnnnnnnnngaaacaaccacatctataaagaaaaaacgcaaagtttccaacccagaacatgaaggcgataatgatatatataagaagaaatctaatgaaataaaagatattcacgcagaaatagttgtcaaaatgtgtatggtgaaaaaactgaacagaactgacaagattaggcatgtgcatggaaaggaaaccctaactacagaaaaacagaaatgtgacagcatcaagctgacgtatcagaacttggtgtatgaacgtcaccatttggtgacagaaactaacaagtgtttagcttttagatctaaagatgaagacatagaacttgtaccgtttgaagaatttatgagagaagcaccagaatcattgtcctcgaaattttcnnnnnnnnnnnnnnnnnnnnnnnnnnnnnngcacagtttacgtctcgctagattggaatgggaattaacccaacgtaagaatttggcacaattgtgtaaagcttttttggaacagaagaagaaactgagcgaagatctgttattaagaaaagacaagctaaccgccctcacaccgctacttgtcaatgtaatcaacgccaccaagccgcttcaagatcatttggaaatgtctccgagcggcctgagggttgaacataaactagcttatcttctaccagaccccctatacatattctatgtncacgtcgtctcttataaagtcgtttacgatattaatctcgatgtggaaatcatcggcgacgaagagaagctaaccgatggaaagatttaaaaattggaatgggattcgctaatgacgatgagtctg

SEQ ID NO: 6651 - DNA, 814 bp, Diabrotica virgifera
  misc_feature (226)..(248): n is a, c, g, or t
  misc_feature (313)..(336): n is a, c, g, or t
  misc_feature (524)..(549): n is a, c, g, or t
  misc_feature (742)..(759): n is a, c, g, or t
  misc_feature (779)..(800): n is a, c, g, or t
ctgcaaaattcatgaaagggcagataggaggtgttgtcgcctcaccgacgatatataagtttttaatatttttgaggttatacttctttaggcgcgattgagagcgaatttttattataccacgcgcctgcgcacaccgacagtatggagttagttgctaaatctttcaatttatgtatgtatcagcgcaagtaaagtgcgaaaaggatatattagtgtttttagnnnnnnnnnnnnnnnnnnnnnnngtgtctttggatttttcttgctcgggagtaagataataagtattattaaaccgattaagtaaagnnnnnnnnnnnnnnnnnnnnnnnngaaaatggttattcatttttgattattattaaaccatttttatttttatacttcacttgatctatttgtcaccgtgattgtaattatgtccgagaagtgatgtaaacagagccgtggtaggtcattggtagagcattcgactacagatcgagaggtcccgcgttcaaatccggacaattcatattccnnnnnnnnnnnnnnnnnnnnnnnnnnggtgttcttttaataaacatttttgagcgtacaaaagtactaacacattcttttttttgggataacttgagtccgtcctgcatattttcaactttttatctttgcggggtattttgcaattcatatttttatgatgtattgcgcttaccttggggttatgggtcgattctatttacgccaatgatagcgttcnnnnnnnnnnnnnnnnnnctgatacgctgctcacaccnnnnnnnnnnnnnnnnnnnnnntagagaataaactt

SEQ ID NO: 6652 - DNA, 615 bp, Diabrotica virgifera
  misc_feature (566)..(611): n is a, c, g, or t
ggctttaatgaataaatccaattaaaaactatacatttaaattacaaaatatgatcatgttttagtctctagattgtctaaaaacacgaggtttcagttacatttttccagacccagaccccccggaaggttccccacataatcctccttgcccccccccccgaaatcatgccctggatccgccactgtaggacacagctagaagtatagatatacgacgaagatgcaaggtagagaacaataataactgggtaagaagcaaaaaagtagaatggaacgaccaaataagccgaatgacaacaaatagagtagtaagcccctattcatcggaggaccaagactcccttctttatcaacttttaccccaccttctactggtggttgattactcggtctccggtggggttgctctggttacctgtgtgtatctacttggaggtgaaagtaggaatttaatttaatttacaggcttacgtatctaggagccgtttttttaaaattattatctcgtttaaacgcaccttttaccgtcaagtgacgttaccagtggtgtacctggaataggnnnnnnnnnnnnnnnnnnnnnnnnnnnnnnnnnnnnnnnnnnnnnnccaa

SEQ ID NO: 6653 - DNA, 638 bp, Diabrotica virgifera
  misc_feature (14)..(434): n is a, c, g, or t
  misc_feature (441)..(464): n is a, c, g, or t
  misc_feature (467)..(479): n is a, c, g, or t
  misc_feature (499)..(512): n is a, c, g, or t
  misc_feature (515)..(537): n is a, c, g, or t
  misc_feature (545)..(567): n is a, c, g, or t
  misc_feature (604)..(631): n is a, c, g, or t
ataaagggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaacccggtgtgagccaggttggtttcctatnnnnnnnnnnnnnnnnnnnnnnnnnnnncaaaggg

SEQ ID NO: 6654 - DNA, 727 bp, Diabrotica virgifera
gtcatttgaggtttgcggacgacatagtattattcagtacagatataaatgaactggagcaaatgatgaaggaattaaaccagcagtcaaataaaataggtttcaaaataaatcttcagaaaacaaaaataatatgtacctaggtaatttacaaactaatcttgttattgacaacgtcagtcttgaaaatggagaccactatatttatataagtatcttgaacataccattaaaatcggcaaagaaaaccaaatagtcgaaataaaaagacgcatacaattgtcttggataactttgtcttaagctttatcttgaagaataaatatattataccaatgtgtctaaaacgtagaatttatgacaaatgtatcttcctgtaactacatatggactggagaccatggcctttacaaaaaaaaacgttagagcagctcagtacaacccaaagagcgatggagagggccatgctagggattagtttgagagacagaattcgaaatatcgacattcgtgaaagaacaaagattactgatgtcgcagaacgtatagcaaggctcaagtggcaatgggtcggacatgttgcccgagataataccgaaaaatggataccgagattaacaaactggagaccaatagagaacaggcgaggagtaggcagaccgcagaagaggtgggcagatgatattaaacaagtcccgtgccaagcaagggaatgagaatttgccaa

SEQ ID NO: 6655 - DNA, 631 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggaaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggagcaggcgagactttatatttaatacaaaaagacatgtttttaataaacaggtgaaaaaatgttgccgaattcctttattaaac

SEQ ID NO: 6656 - DNA, 377 bp, Diabrotica virgifera
tacatttagcgcgcttattttttgtttgtaaactgtaaactcgtccttaaattatagaaatttagattataatggggagaaaaacagcagcaagcagtgcaaagagtaaagaaaaacgtttgtaaaggaaagaagaacaaagcaggataagtcaagctatgactattgttgcaaatgctaataaattgcaggatcctttagaaccctttccggtcttccggaaattcaataaaaatggtgtagaagctgaagttttcgtaaaaaaggcggctgacttggatcaaaatggtaaagactgggggtttatcttcactaaaaaaaacatgcaggtaaaatatgaaaaatgcacatggggctggtgggataggatcaatgtt

SEQ ID NO: 6657 - DNA, 127 bp, Diabrotica virgifera
gaaaaactttattgggagttttcggacatcacttttcctaatggagatacggaactactgtaatatatcggctcaaagacaacagtgataaagtgaagatcctattgcttcaactacacaaagtcac

SEQ ID NO: 6658 - DNA, 162 bp, Diabrotica virgifera
aaatggctaaaaatcaagttggggggcacgaaggggggtatcatccaaacttggatttccccaaccgggaaaaaatcctttgaaaagttttccccccccaaaaaaaggtttctccaaagggttgagcaccttttttaaagtttctgtgtttttgggggcggg

SEQ ID NO: 6659 - DNA, 689 bp, Diabrotica virgifera
cctcttgcgagtatctgggtgatcaacctaagctatattgaagagactgataagatgtcgaaagtgacttgctctgaacgagtggaaaaactatatcggtaactatatccatgccatgaatgccatgaactgtttgcatcgactgccggtatacccgtgatttaatttaaaactcaaattttggactatgaatacctaaatcatattagatttgaacactctacctttttaataagattgactgccgaatcatagtaagtaatcaatttattactgatggaaacaaaacacgcttaattttgcgaacacatcatatacaatactttcatgagaattttactctgattaaatattatagaccttatcttgaaatttataactccatatgataaaataggacttcttctctcatactgtatcgagtacactgcagatgtgctccctaacttttactatgccttctgtctaaaagatgctgaggatatgacccgctattagtatgttgttatcacaggtccttgacactcggatgaatataccattgaacaaagaacatttctgagctaaaccacctgtataacttcacgttatgtagaatgttcctaaacttgaatatcatcatcatgttcaaccatataagaaatttcacgcatcagattatatgtacacatagtgctcattatgttttg

SEQ ID NO: 6660 - DNA, 769 bp, Diabrotica virgifera
  misc_feature (366)..(385): n is a, c, g, or t
  misc_feature (437)..(454): n is a, c, g, or t
  misc_feature (732)..(732): n is a, c, g, or t
aaaacaggaacgaatggagaaaaattgtagaagatgccaagtcacacaaccaattgtaaaaccaaaatactaatgtggactgattcaccttgacaaatgaatcagaagatcccaaagagggggcaatcactccgccaggagtgtagtagatgccatgatgatacatattgaatttgttggaccattaggacaactaatgtttgtagctgcaaatataaaaattaacaatttatcaaatacagatcctttatttttaaaaaacacttgtagcaaaagcaaactctccaggacttaattcagataattcattttgagaaaaacttactggtagtatattatcatgcctcagtgtcagaagaatattcnnnnnnnnnnnnnnnnnnnntttgctttttcttcaaatatttttcatactgttttattgacctcgaagctcnnnnnnnnnnnnnnnnnncaattttgtatttcttctctgtagctctaagatttcctctacatgaatttgacgacaatttctctttttggttagttttagccatcaacggaatgatgacaataatgtaatcagacatttcatctttggagcttccaggttacttgaaatgttagctgtatctgtcagatttttaatattctgcttcattttcctgacttttgtcttcatcaaacacaattcttaattattccactcaatatcatctacttcttgctcttgttcagttactgaagaangtaaaaaaggtgaggggtgagggttctatgtctgccc

SEQ ID NO: 6661 - DNA, 844 bp, Diabrotica virgifera
  misc_feature (379)..(457): n is a, c, g, or t
  misc_feature (512)..(512): n is a, c, g, or t
cataaagattgtttaacgaggaaagatgtctataaagagttgcgtttgcgaggctataattacagtggcgagttccaaaatatccaagcatttaatccatctgacaaatcaggtcttattaagtggactgataactggatagcatttttggacaacatgcttcaactgaaaattgttaccactgacaccagattactttacgtgccgacgtatatttccaagcttacaataccatctaaatcagtacttgaatgggtcaatagaggttatctgcagaagcaagtagagccaattctaccagtttacattaacgaagagacatctgaaataaaatgtggaaatattgtgattcaaggtcttatagcaagttcaattgccnnnnnnnnnnnnnnnnnnnnnnnnnnnnnnnnnnnnnnnnnnnnnnnnnnnnnnnnnnnnnnnnnnnnnnnnnnnnnnncaattagggtcaatcttcaaattatttgcgaaaatgcattagcaagaaagtctanagttatcgaacttattgatgaatatgcagcacaagaaagtattttaattcctttacttcaaaatgcatttggagaccaaccacttcttcaagcacttgttaaagtattagcaaaaactagacctgaatatgttccagaagagattgaagtagaagataaagaactggctactgaaactgattgccaaataattattggtttcaagcttaccgagagaaaagaagttttaaaaactgcagccaaatgtctaaaggatcatggatttcttatatctcgagaagacatcaacttcgatagttccatgagtgacgtagaagattttactgtattta

SEQ ID NO: 6662 - DNA, 446 bp, Diabrotica virgifera
  misc_feature (13)..(13): n is a, c, g, or t
  misc_feature (15)..(15): n is a, c, g, or t
  misc_feature (19)..(19): n is a, c, g, or t
  misc_feature (27)..(28): n is a, c, g, or t
  misc_feature (30)..(31): n is a, c, g, or t
  misc_feature (56)..(56): n is a, c, g, or t
  misc_feature (62)..(62): n is a, c, g, or t
  misc_feature (65)..(65): n is a, c, g, or t
  misc_feature (69)..(69): n is a, c, g, or t
  misc_feature (82)..(82): n is a, c, g, or t
  misc_feature (92)..(92): n is a, c, g, or t
  misc_feature (100)..(100): n is a, c, g, or t
  misc_feature (115)..(115): n is a, c, g, or t
  misc_feature (121)..(121): n is a, c, g, or t
  misc_feature (126)..(126): n is a, c, g, or t
  misc_feature (140)..(140): n is a, c, g, or t
  misc_feature (143)..(143): n is a, c, g, or t
  misc_feature (145)..(146): n is a, c, g, or t
  misc_feature (155)..(155): n is a, c, g, or t
  misc_feature (158)..(158): n is a, c, g, or t
  misc_feature (160)..(160): n is a, c, g, or t
  misc_feature (168)..(168): n is a, c, g, or t
  misc_feature (174)..(174): n is a, c, g, or t
  misc_feature (182)..(182): n is a, c, g, or t
  misc_feature (185)..(185): n is a, c, g, or t
  misc_feature (197)..(197): n is a, c, g, or t
  misc_feature (221)..(222): n is a, c, g, or t
  misc_feature (230)..(230): n is a, c, g, or t
  misc_feature (252)..(252): n is a, c, g, or t
  misc_feature (255)..(256): n is a, c, g, or t
  misc_feature (264)..(264): n is a, c, g, or t
  misc_feature (267)..(267): n is a, c, g, or t
  misc_feature (288)..(288): n is a, c, g, or t
  misc_feature (303)..(303): n is a, c, g, or t
  misc_feature (307)..(307): n is a, c, g, or t
  misc_feature (313)..(313): n is a, c, g, or t
  misc_feature (317)..(317): n is a, c, g, or t
  misc_feature (337)..(337): n is a, c, g, or t
  misc_feature (339)..(340): n is a, c, g, or t
  misc_feature (348)..(349): n is a, c, g, or t
  misc_feature (352)..(353): n is a, c, g, or t
  misc_feature (374)..(374): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (391)..(391): n is a, c, g, or t
  misc_feature (396)..(396): n is a, c, g, or t
  misc_feature (403)..(403): n is a, c, g, or t
  misc_feature (411)..(411): n is a, c, g, or t
  misc_feature (415)..(415): n is a, c, g, or t
  misc_feature (417)..(435): n is a, c, g, or t
actaaaagccgantnattncggatggnngnnctttcttcacactttatagaaatantataangantggnaaaaagaaataanaagtatgagngatgtganaataaaaaatagtantgtttnattanataaaataatttgnagntnnaataaaggnaangngtttgttnaatatntatgtaanganaatattaaaaangagttggaaaatattgaagattannttaaagantttttgatatatggtaatattnttnngttggtanaanttagggttaggaaagggtttnaaagaatgggattanttanagatgntganttaataatgaaaaaagtttnanntaagttannatnngaaataagatggagagtattngantanttgganatgantgatnttaaaantgtgatanaatnannnnnnnnnnnnnnnnnnngattatttgtt

SEQ ID NO: 6663 - DNA, 333 bp, Diabrotica virgifera
acaatttgtaacttttgtttttggtacatatttcggtcctctacaaatacgttctcgtgacttttgatgtaaaatgtttggggaaccaggagttcagcagtttggaattttacattgagtttcctatggcccggtttgcgattcaccaccctgtataatatagaacatcagaccttactgcctaattttttctgtcgtaacttagttgttctccaatttttaattccagtagtgttaattccttcatctatgagatgaattttgggccatttgcttctttaaaactcttttctcgtgccccctccaagccagggatgttgtctcctaaacctc

SEQ ID NO: 6664 - DNA, 775 bp, Diabrotica virgifera
  misc_feature (160)..(194): n is a, c, g, or t
  misc_feature (658)..(676): n is a, c, g, or t
cggcttaaacacaatctagctcatccaagaggtttatgctcaatcaaaagtatccttcgcccctagtgtacagttaataaagaaatgtatagaatcgctgatagataaacaatatatcgaaaggacgccccaatctagcgaggaatacagttatgtagcnnnnnnnnnnnnnnnnnnnnnnnnnnnnnnnnnnnttgtagaagacagactgatggacgctgtgcgtttttacaaaagacatatttttctttgatttgcattgtgtatttatgaaattttacgacaattatgaaatgctgttcataattttcttacttataataacttattgtatttttggtactttatatttttcttgttaattttatactattttcctttaaattcttccttactattaaccataatgtaaattatttaaatttgtcgccactgaataactgaaaagtacagatcagtggaaaaacctgcaaaaatagggtgattgttccgtatatttttgttgtacctaacgaagattgataaattattttttacaatctcttaatattattttagctgaattagtgcgccaccaaaaatctagagatcactgtctcatatccggttcgaaggactactgttgtgaaaaattccgaaaataaacatttattgaccnnnnnnnnnnnnnnnnnnnccttcttgctgcaaaaacatacgctacactcaacaacgaactgcttctaaggacattataactactttttaaattatgaaccttttccctccttttttt

SEQ ID NO: 6665 - DNA, 87 bp, Diabrotica virgifera
  misc_feature (24)..(43): n is a, c, g, or t
tcctataaaagggaaatttccagnnnnnnnnnnnnnnnnnnnnaaccccttagaaaggttataaagtaaattgtttgttggaagatg

SEQ ID NO: 6666 - DNA, 435 bp, Diabrotica virgifera
  misc_feature (283)..(314): n is a, c, g, or t
tttgagtccgcatagggcagcataccgtatatacttatatattttaataccagtcttttgttgttagtttcttgcaagctttgttttaattatacagtaccaaagatttgtggctgtccaaattttataaaaatggttgagaagaaatttttggttacatcaattacgaaataacttccaagtcacgggacaaagggtccaactcagactttatttaaatacagtgtcttatttatgttacaattaatctcgcctacatggcggagtgattttgatattgtgnnnnnnnnnnnnnnnnnnnnnnnnnnnnnnnnggcgtgttttttacgaatgttactatgtgtatgtgtaagataggatagactttctagtcatcggtcgtatagttttcctattacattccctgaattacttattattcttattactgctttt

SEQ ID NO: 6667 - DNA, 711 bp, Diabrotica virgifera
  misc_feature (37)..(448): n is a, c, g, or t
  misc_feature (582)..(607): n is a, c, g, or t
  misc_feature (625)..(647): n is a, c, g, or t
ccccctttaatccgcgtgaaagtcgtggaagccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacttctttaaaacgtttttccgtactgaggcattaagcgcctcgaaaaatgtttcatgatcagtgtttaaagcatctttatgcaaggaactaaaagtagcccttgttcctgtacaaattaaataatcaggnnnnnnnnnnnnnnnnnnnnnnnnnntgtataaaatacttgttnnnnnnnnnnnnnnnnnnnnnnncggccacaccaaaaaaacccaaattacaaaccggagaagcaacggattaaatctctaataggtg

SEQ ID NO: 6668 - DNA, 803 bp, Diabrotica virgifera
atttaaccaaatactacaacaactttttagctgtgaatgggttgtctattggaattgaaaagtctgagtgctttggtttgttgggtattaatggtgcaggaaaaactacaacatttaaaatgatgagcggagatgaaactgtatcttacggtgatgcatggatcgaaggaaagagtgtaaaaactcaactgaagcaagtacaacggaacatcggctactgtcctcaattcgacgctttgctggatgatatgacagcaagggaaacgattatcatgtactgcctactcagaggaatagagtttaaaagaacccaaagaattgcgaatttcttgtctcgagacttcgattttcatcgtcatttggacaagaaagttaaagagatgagcggtggaaataagaggaagttaagtactgttttgtcgttgataggggatccgccagtactatttttggacgaacctacaacaggtatggatccagcaacgaaacgttacctgtgggattcattatgcaaaattcgagacaacggcaagtgcatcgttctaacttctcacagcatggaagaatgtgaagccttgtgcactcgaatagccattatggtgaacggcaatttcaagtgtcttggatccacacagcatcttaaaaacaaatttgcggagggatacaccttaaccataaaactaaagaaattgccagagagcggtggtctggtacatgcagatacagagtcactggagaagtatatcaaagataaattttccttatgctcatcttagagagaaacatcagaactattgtattat

SEQ ID NO: 6669 - DNA, 635 bp, Diabrotica virgifera
ctataaatgcctgtcagattttacacaatctatctaatctctaactactgtcaatatgaaagttacttcattgtatatactagataatatgctgacagatctcatcgtaacaaatttagatgtaaatactacacattatacaatccatctccaaaatctaccagtgaccttataatctcttcaaaacctacaacagtccaaaaaaaatacatctgaacttctcagaatgatacatctacttcgtcaatccttggtattgagcttgtatctcccttataccacatctactctgaatacattatcaggagcaataatttatattctgaagtgattaccgactgtatacaagacagaatagatgataaatctaaaatacacatttcttcactctgtaaaaggagtctaacttacttgcaatatataccaagaattctaaattataaacctctcgataacaacacttgccatcgaatatcccgatcaagttactctaatcatgggaagaaaaccatactcaggacctaatatactgcgtgcgcaaataactctttcaccacaagaaagtcaacgaaaagaatcattctgactacatatctccacaatcaaatatcatatccagtgctacaacaacatac

SEQ ID NO: 6670 - DNA, 636 bp, Diabrotica virgifera
  misc_feature (197)..(215): n is a, c, g, or t
acaggatgctgcagttaatactcaatggaaagatcgacggaaaaagagaaattggtcgaaagaaattttcatggctccgaaaccttcgtcaatggactggcttatcagcagatcaattgttacatgccgcacaagatcgagaacgatatcggcaaattgttatggaagctacccacgcctaaatttgggcacggtannnnnnnnnnnnnnnnnnnttttatatcttcctcagttgtttctttgtttgatattataaaacctaaatacttgtacttatctgtctatttaaagttgttttatttctgtattctccgttgttaggtattcagttttctttaggtttatttccatcccattctttgtatattcctgttccaattttttcatcataaaactgaggtaatcttcgtcttgtgcgatcactatttggtcgtcagcaaaacttagggtatatagatactcattacttactggtatatccattccttcgcactttctttttccatggtttcagggtcttttcccaggaatatttttaatagggtaggggatgtggagcagccctgtagtaatccctttgtccgcttaaatggactgcatattcgattgcccattttgatagctactgtgttattt

SEQ ID NO: 6671 - DNA, 674 bp, Diabrotica virgifera
  misc_feature (435)..(457): n is a, c, g, or t
caagtcacaaaataagctactttatctctatcagtttcacctgcagtttaaagcttacatcttcaaatacttccttcatagataaggtatatatatgacttccttcttcttgaagtgcctatccgcgaagaatgtttttttatctcgctctaacaaataggtttttatggaaggcgctgttaccagatgttatgaagtgcacacgtgcacagtttttcaggagatctagggaaattttatttttgtggtcccgtgacggtatagtcactttacttaaggcctctttggcaatccatcccctagcctcaaaccctttattactcgcatttataccattttgagctaccttcttcccaacaacccctcatacgtcacgatccaacgagccgttctactccattacaaaaagcgcccaaaaacgagcagaatggaccnnnnnnnnnnnnnnnnnnnnnnnccctagaatttgcggaaaatttgagtttttatctcgctttaacacatatgctgttattgaaggcgcctgttgccaaatgttgtgaaaagcccaatttttcccggcaatctagggagggcagtatcccttccccccttatagtacgtttcggggaaagggaaaaatatgggcttgaaacatgatttggggaaaacctaaacgtatcctttttttgggg

SEQ ID NO: 6672 - DNA, 73 bp, Diabrotica virgifera
ttattagggggaacaggtcggggccccctcgcacggtaaccggcccacgacatcccccggggcccccccccct

SEQ ID NO: 6673 - DNA, 762 bp, Diabrotica virgifera
  misc_feature (28)..(47): n is a, c, g, or t
  misc_feature (502)..(524): n is a, c, g, or t
  misc_feature (529)..(547): n is a, c, g, or t
  misc_feature (690)..(710): n is a, c, g, or t
gtagcgccatctatcaacaactagaagnnnnnnnnnnnnnnnnnnnnatcacggacgtaccttttcttcggttacttgtggcgcactgaaaaaaacctctgagaagcacaatatacgaactttaatttgatgcaaataataacgtcaattatttcgcgtgttgaatatggcaacaatggttacaacataaattcggcttcgccatactatacagaacttttgagataacgttgcttttgaaataaccaggttcaagtttagatcttactttccttattgctctaccgtcccatgatttgttaaatgtgactctaacctgctttcataaatgagttaatgttttaatttttgtgtattcataaaatagatgtccaacgacaatagttctgtattttatacagtttgataaaacaaaaatatctgctgctcaaattaactggtaatttttagttacgacagacttattggatttcttattaaaattcaaaaataaactgccgannnnnnnnnnnnnnnnnnnnnnntagcnnnnnnnnnnnnnnnnnnnctaatgtttttaaatataaataggaaataaaacacgaatttacctctataactttctcacaaaatattccctattatatctgttgttgatgctcatattttgatgatttttagatatttattattttgtaaagtcaaaatggnnnnnnnnnnnnnnnnnnnnnccgctcgaatattttattttctattataattaaggagtatcgtttttggaag

SEQ ID NO: 6674 - DNA, 306 bp, Diabrotica virgifera
  misc_feature (4)..(42): n is a, c, g, or t
  misc_feature (56)..(78): n is a, c, g, or t
cccnnnnnnnnnnnnnnnnnnnnnnnnnnnnnnnnnnnnnnngtttaattggtcgnnnnnnnnnnnnnnnnnnnnnnnctactattcgtcgtcagtgaaacctgctccattagcataggcgtatctagtgggcggttttggggtttataacaccccttttggatgtacttcgagttctatacgcttaacaccattattattccatacccccagagacctttcacgtcatgcaagctccccccaccaccccttaagatcatcctgcaaacgcatctgacctttacgtttttgccgctactaaccgca

SEQ ID NO: 6675 - DNA, 1136 bp, Diabrotica virgifera
  misc_feature (983)..(1005): n is a, c, g, or t
attttagattgtcaatgtgagatagtcgacgtgtttgatatcacctatattctagctgtcaaaattaatttgagccacgttggaagtaaaattcttcattattttcagtctgtttgaattgtttatggatttcaatttaacggacaataagttatcctcctaaagatgaaggtaaaagatatagaacgcaccgccagtgtagcttggtctcctaaaaaccaacacccaatatatttagcagcgggtacagctgcccaacaactagatgcttcctttaataccagtgcagctttagaaatttactccttaaatttgacagatcctggacctgatacacagctggtttcatctgttcaaagtgaccaccgcttccataaaatcatttgggggagctacggaagcaaccctgtaaatagtactatcataggtggttgtgatggaggattaatccaaatatacaatgcctcaaagttactcaaaggagaagatgccatcattggtaagcaagagaagcatacaggaccagtacatgctttggattttaacaatttccaacagaacttgtttgctagtggtgcaggagagtcagaaatctttatatgggatttaaacaacactagtactccaatgtcaccaggtacaaagagtcaaccgttggaggacgttttgtcagtagcatggaacaaacaagtacaacacatcctagcctcaacttttccctcaaaatgtgtgatctgggatctaagaaagaatgagccaattatcaagttaactgacacagtgtctagaatcaggtggaaaagttgttgcatggcatccagaggtagccacacagctgtgtctggcatctgaggaagaccaagccccagtatacaactatgggatcttaagtttgcactttcgccttaaaaacccttcaaaccctccaagaagtattctttcccttggccggtggttctgaggatggcaatttataagtatcnnnnnnnnnnnnnnnnnnnnnnngggatggttggaattcccatttcaaaatcccccaaaatgggaaaaagggggtagcttgggggaaccaaaaaaaagaattcaagggggaggtttttggaggggtgtgggggcgggggccccaataaaaatcc

SEQ ID NO: 6676 - DNA, 227 bp, Diabrotica virgifera
cgcgaattaccgcgggcgacccacccgtccgatcagcagacttaaggaaaacggaggaaagagattctcttggcggcccgtggcattgatgctattgacgccctggggaaatattcgtaatctcatctcgtcctctatggccacgtagctgctgtatcattaccagttgcatgactacacgcatgccagctacacactgattgctggaaagagtgtactctctggat

SEQ ID NO: 6677 - DNA, 891 bp, Diabrotica virgifera
  misc_feature (450)..(469): n is a, c, g, or t
aattattgaattttagtgttattttatttaaagttaagtaataataattagtattattacattatctctattttaaattacgccttgagctggtggtgtgtaaaggttcaaaatgaagggggatgatagtaaagtaagtcatttttattttaatcgatcaacatgatgctgacgcggcttattttagacgcgacaatttgattattttataacaatatgttttatatcttttaccatggaaatctatgagctatatcttgtatttttttaataatcaagaattggaatatattttttaaacatcacgcagctatttataaattataaagtattttaaatttcagcttatatgtacggtctattatttcgtctaaaattaccatatttttgttagatgggaaggtgttctaaataagttctctttgaaaataagagaaaaataccgattcnnnnnnnnnnnnnnnnnnnncgcagttttatcaaatctaggcaatttctagtttctgttgcagtgttgccacagtttcaatatttccttaaacataattcgaactaagccaatttaaatacagtttaacccttaactaactggtcctgatccgctactgtaacagtagcgtaattggtccggcgtcgtctgcgaaactgttttcaagaaagcaaaacaacactcaaaaataatttttttctacgagcgtgcaaaaatgtctacttttgcgcacgcattttaggttagaaagtttttttccgcacgcgtgttacttttccgcacgcggtttttacttttccgcacgcggtttttacttttccgcacgcggtttttacttttccgcacgcgggttttactttttcgcacgcggtttttacttttccgcacgcggtttttacttt

SEQ ID NO: 6678 - DNA, 958 bp, Diabrotica virgifera
  misc_feature (479)..(495): n is a, c, g, or t
  misc_feature (497)..(513): n is a, c, g, or t
  misc_feature (745)..(766): n is a, c, g, or t
  misc_feature (871)..(871): n is a, c, g, or t
gaatcacaaaatctacatccaccctactggattatgtgatcacatcaagtgaggataaaataatttcagttgaaataaaacatattcctgaaataagtgatcatgaaatgataatgttaaaggtaagttgtgaggttaaaaccaataaaacaaaatttattactggtcgtaactttaaaaacttaaattataatcaatttaaatctgatctggagtccataccatggagaaatatttatgacctcacagatgtagatagtaaagtaacttttttgtctgaaaatattgttacattgcttgatattcatgtcccaattaggacttacaggattacaaagaaatatgctccatggctgactgatacgattagagctttaatgctggatagggacaaagcatttttaagttacaaaatttctaaaaatattgcacattggaataactacaaaaaattacgtaatttagtatcagcagtcacnnnnnnnnnnnnnnnnncnnnnnnnnnnnnnnnnnatgttagatctgtcaaagatatgtggagcaatttaaaatatttgataaatgacgataagcatgagaaaagttttgatgtaagtagcaaatggaatataaatgacattaataaacactttattgaagttataccaaaaatgaaagaggacttagatacaaaaatgttttatcaaaacaatgttaaaacttattttaacaaattgcttaattttaaaccagtctctgaaactgnnnnnnnnnnnnnnnnnnnnnngataaagagtaaagctgttggacatgatggtattaacatattaacattacagttgtgtattccctatcttcttccgtatatcacgcatattatcaacttttgttnaaaacattctgtttttcctaataactggaaacgtgcgcatgttattccattacctaaaaactaaaattcctaatagtttaaatgatc

SEQ ID NO: 6679 - DNA, 119 bp, Diabrotica virgifera
acgagcgagtgtccgttcaaaaggatccagggttacttaaccgagcctgcgaggtaaaacctctccgataggggaaccataaattcagttactcgcaccgtactctttaaagagaccaa

SEQ ID NO: 6680 - DNA, 1072 bp, Diabrotica virgifera
  misc_feature (104)..(121): n is a, c, g, or t
  misc_feature (969)..(1000): n is a, c, g, or t
  misc_feature (1007)..(1019): n is a, c, g, or t
  misc_feature (1022)..(1035): n is a, c, g, or t
  misc_feature (1042)..(1064): n is a, c, g, or t
gtgaaatattatatttactgaaataatcaaaatacaatattaaagaagtatattatccttataaaacacaaatgaatgtgcaaactatacagaaatattcttcnnnnnnnnnnnnnnnnnntcaaattcatacacgattaatttaagtcaaacctgcacaaattctatccctaattaaattcagctaaagcttgattttctgcttcatttacatcaacgacagttcgactacatcttcagaagtagttgtctcttcttgtgaattattggtcacctcagttgcattcgcagtgctttcttcattaggtttatctttttcttcagatggcttaggctcttctacacatcgtcttttgctattcaaaggacattccaattcatgcgttgccatcctctttactccgcttctgaatttacaactcttagattcaaagctgcaaggtatttcaacgccttctgcaatgtcttcgaggatgaaatttcgagtgtcttcaatactgccctcgcacgatggacatttttcaacctttgccttgcaaacattgcatagagtatgtcctgctttgcattggtggattggaggtatcatgtagtcctttgcagatgggacattcaaataattgtttatcaacttatctgttttatcttctttgtactcctttagtacgatctggtagttcaaagaattagtcctgtattttacggcatctctgttcaacttagtagttagccgacggaaaaattcttttctctttactttataaatgtggtcccaaattttaacagttcccccttgaacatttgaaaccaatggtccttaatatttggaatttgataatttttctggtcttccacccaataagaaaaattttcttggttatcctggaaagtaacattaaaatccaaaatgtttccccccgggggccttcaatttaaaataaccctaacccccaaaatgtggggccattnnnnnnnnnnnnnnnnnnnnnnnnnnnnnnnnaactccnnnnnnnnnnnnnacnnnnnnnnnnnnnntcccggnnnnnnnnnnnnnnnnnnnnnnncccccttt

SEQ ID NO: 6681 - DNA, 959 bp, Diabrotica virgifera
  misc_feature (4)..(19): n is a, c, g, or t
  misc_feature (21)..(36): n is a, c, g, or t
  misc_feature (740)..(740): n is a, c, g, or t
  misc_feature (823)..(824): n is a, c, g, or t
  misc_feature (835)..(836): n is a, c, g, or t
  misc_feature (858)..(858): n is a, c, g, or t
  misc_feature (926)..(926): n is a, c, g, or t
tccnnnnnnnnnnnnnnnngnnnnnnnnnnnnnnnnttatgaacactttggcactatctactgagttcccccataaaattacattatagcacatgtggctaaaaaacgttaattaatgccgatatgggtagtgtgtttttaattctagatatagcataaaaagctttattcaatttcatgttcactgaattcacttgctcagaccatttcagattacaatcaatgaacacacccaaaaactttgtagagtgagtggaagataacatattgtttctatcatggatggttaagttatagtcattggtagatgagttgtatgaatgaaaataaataatttctgtcttgtcaatgtttaatattagtctgttggtattacaccagcatctaaagcagtcaacaacagtcttcattgtcatttttaattcctcgagtgtacgtgcagagactattaacgaggtatcgtcagcaaacattgatattataagtgcccttatgtgatctggtagatcgttaataaaaattaggaataataatggtctcagcacggatccctatggtactcctttgtttgtcgtgtatggttctgagcttgattctttaattttcacaacactcttcctgtcacttaagaaatttattgcgaataaatgttatgtctaagcagtcaaaagctcgtgatagatcaaaaaatagtcctgccacgtggtttctactatctaattcatcataaataagctcanacaagttgcacgcggccgtgagtgtcgacttttttggtctaaatcccgtgtggttttggagtaataaattgaattcttctatnnaaattacttannattatataaatttaagtgattntttaattttttatagctctattctgctaggtgttaaagtacctaactttttttattatcccacacaangcgaatgaaatcaaaaagcaaaaatattaagaa

SEQ ID NO: 6682 - DNA, 919 bp, Diabrotica virgifera
  misc_feature (703)..(703): n is a, c, g, or t
  misc_feature (821)..(850): n is a, c, g, or t
ccacaacttggaaatggagcatgggaattgagcaaagttttcattgataagatgacgttcctgctgaagaaaatcaataggaaacgacaacaacttagcgccaaaattacttgccaattagcgattacagaatacggtaaaaataaattcgacgtggaatcatgccaggatgtacagaatggaaataaaatgaaccttaacttcaccttacaattagaggatagagacttaccattaaaccaaagcccagtacgaaagttcaacacaaaggaaattctccagcgaaaaccgagttttactgtaaataggactgaatccatggacaacgatacattcgatcatatcctacaagtcacatcacaacacgatactataatggcttattattatttggacgaaaataataaagttaaagtcactgaaatttttgatgtaaccgatagtgattctccaattgttcagacttctgaagaaagaagtgcaaatacaaatttggagttcgacgacgactggacaaatcaagagcaatggcaaccaaatgaggaaaatattgctcagtttgaactagaggacatacttgacagagaaccaatcttttctgaccccgaaagcgaatggacgggtacattcaaaatcgaagaaccagaggatgaagatgagcaataccctaccaacgatactcttccagaatctgatcgaaggngtagccgagaaatcattaatcagtggaacaaaaaagaatataaaatcccatcgatggtctacgaagatagtgacacataaatgtgttggcatctacgtttaggatgatagttttttannnnnnnnnnnnnnnnnnnnnnnnnnnnnngtaataaacagagggaccataaagttttttccacacttacctccataaatattgtattatatgcagctc

SEQ ID NO: 6683 - DNA, 903 bp, Diabrotica virgifera
  misc_feature (64)..(87): n is a, c, g, or t
  misc_feature (295)..(315): n is a, c, g, or t
atttgaagttaaatatgaaacggcacagttattttgattaatttatgatatgattcatatatgnnnnnnnnnnnnnnnnnnnnnnnntacctagtactttaaaactatttggcgtatccttgtcatacttggcggaaagtgtaggtactgtgcaccctgctgaattgagataaataaacgtttctggctactaccgggggcgtgcgatgggggatggtggctggttgacccttcccaaattctgcgccgctgacgaaattgctattttagtgtaattttttgatttttcagtacnnnnnnnnnnnnnnnnnnnnncttcattcggagcgataaaatgattagttttcgagatacttgaaattaaaaatgaagcgacacaatacattaatcaaaataaccgtgtcgtttcatttttaacttcaaagatctcgaaagctggtgactttatcgttacgaatgaagagtatattatttttagagaaagtattggagaatccaataattgaactaaagtggcgattccgccagtggcgtggaatttggagggggtcggccattcacttttccccattgtgcgcctctggtaatagtcagaaacgtttgtttgacataatttagcggtttgtacagtacctatacttcctgcccagtatgagggggatacgtcgaatggttttggagtgctgagcaagggtgatttttaaatttttggatagaacaccctgtgactcagtagggaaccacattttatttaagagttttacgttggatctttgtattttgagctaaggtttctccagttactatgtggacgattattaatcaaacaccctgtatgtattatacacttcaacaatttcgatctaactccatctaagtcgatttgtgtattttcatttgtca

SEQ ID NO: 6684 - DNA, 664 bp, Diabrotica virgifera
  misc_feature (10)..(42): n is a, c, g, or t
  misc_feature (44)..(465): n is a, c, g, or t
  misc_feature (472)..(509): n is a, c, g, or t
  misc_feature (529)..(542): n is a, c, g, or t
  misc_feature (545)..(567): n is a, c, g, or t
  misc_feature (575)..(597): n is a, c, g, or t
  misc_feature (627)..(658): n is a, c, g, or t
ttacgtccgnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6685 - DNA, 798 bp, Diabrotica virgifera
  misc_feature (51)..(74): n is a, c, g, or t
  misc_feature (119)..(139): n is a, c, g, or t
  misc_feature (165)..(251): n is a, c, g, or t
  misc_feature (263)..(356): n is a, c, g, or t
  misc_feature (366)..(388): n is a, c, g, or t
  misc_feature (418)..(473): n is a, c, g, or t
  misc_feature (476)..(504): n is a, c, g, or t
  misc_feature (551)..(551): n is a, c, g, or t
  misc_feature (555)..(598): n is a, c, g, or t
  misc_feature (639)..(679): n is a, c, g, or t
  misc_feature (687)..(720): n is a, c, g, or t
  misc_feature (726)..(779): n is a, c, g, or t
tctctccgcgggcggggggggggagcagtgggggggggaaaaacccccttnnnnnnnnnnnnnnnnnnnnnnnngggggggggctcttccgccgcgccgccaaccaacacaacccaccnnnnnnnnnnnnnnnnnnnnncaaaaccctcctttttctttcccacnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgttgtnnnnnnnnnnnnnnnnnnnnnnntgttttttcttttattttttttctctcctnnnnnnnnnnnnnnnnnnnnnnnnnnnnnnnnnnnnnnnnnnnnnnnnnnnnnnnnctnnnnnnnnnnnnnnnnnnnnnnnnnnnnngacccaacacaagagcaaggagaagagagagagaggggaggaaaganagannnnnnnnnnnnnnnnnnnnnnnnnnnnnnnnnnnnnnnnnnnngtttgtggtggggtagaggcgagagattgaacatggaacannnnnnnnnnnnnnnnnnnnnnnnnnnnnnnnnnnnnnnnngttttggnnnnnnnnnnnnnnnnnnnnnnnnnnnnnnnnnnagggannnnnnnnnnnnnnnnnnnnnnnnnnnnnnnnnnnnnnnnnnnnnnnnnnnnnntactaagtcaattttactc

SEQ ID NO: 6686 - DNA, 962 bp, Diabrotica virgifera
  misc_feature (690)..(690): n is a, c, g, or t
  misc_feature (711)..(728): n is a, c, g, or t
  misc_feature (815)..(815): n is a, c, g, or t
  misc_feature (867)..(867): n is a, c, g, or t
gaagacaccgaagcacgacaatacatcaatagaaataatcatgaaggcagtgttagttctaccagttttcttctgtttagtgaacagtgcgccaaaattaaggcttacaccccaattcatagcaccaccttctttactgacgttgcccagtaatgcaactagtataagaactgacatcagtgactcatttcactgtgaaggaagagactatggatactatgctgacgtagaaaacgactgccaactgttccatgtatgcttgccagtgacatactcagatggaagaaatcaaacgttcaggtggagttttatctgtccagaggaaacagttttcaatcaggaaatgttcacatgtaccagagcagatgaagctattgattgtgcagaatcaccacggttttacgagctgaacagaaacttcggcagcgaagaaattattggagaagtcatagattctgttgtaccttcgacaccagaacctcactatcttgaagaagctaccgccctaccagacgttcctcaaggtcttggcagaaacctttccagaagagggggaaataagccagatctaaaaaaacaatagaaatattggaaatctaaattatgctgtatgttcaagctgatatgtcatttataattgttgcgaaaatcaatacgagcaatagttttgacttctcttactattactanatcggtattttgcaacgtcgnnnnnnnnnnnnnnnnnngttacgtattttttatagctttatcaattttactacatctttcagtgtaataatctaatttgatctcttttattttatctatttcgntaattagtaattgtgtgaaaatatgttaaacagaatatgtgagaattatgtngtgagtcaactcaaccaaatcccagtagaaagtgcggtacaacatcacccctaatataaaagtaagaattccgcatcttctatgtccttttttac

SEQ ID NO: 6687 - DNA, 741 bp, Diabrotica virgifera
  misc_feature (178)..(212): n is a, c, g, or t
  misc_feature (247)..(271): n is a, c, g, or t
  misc_feature (454)..(541): n is a, c, g, or t
  misc_feature (622)..(673): n is a, c, g, or t
gtagaatgacattctagtaatgtttacatatccacaccagtgtgaattttactacacgtaatttgccgtgtaaagacagaaaaagtagggatacacgtaaaatatttgcgaattatgtacccatagccttaaggtcacagtacaatattgtgcttaaggtgaaacataatgaatggannnnnnnnnnnnnnnnnnnnnnnnnnnnnnnnnnnttgggaagtgttttaaggttatgttctttgttgcnnnnnnnnnnnnnnnnnnnnnnnnngtttgagcttcttttaatatggcataaaaaggttttcaaatattccatccttaatgacttcttggataatgataacaagatcataagataaacatgaaaatgccatagtatcgggtgatggaaaaaagatgatctttgactctgattaatcataaggagagaaatattagtgggtgtccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaatgccatcatattgcaggattggcactattaagcgttataaaattttaagtagtggataaagaggttgtagaatgcnnnnnnnnnnnnnnnnnnnnnnnnnnnnnnnnnnnnnnnnnnnnnnnnnnnnccaaagctaattggttctcacccaagccataaatgcccacatgttactacaatcttccctcgagggac

SEQ ID NO: 6688 - DNA, 79 bp, Diabrotica virgifera
tgtaatatcctttgataagaaaggaactacgacgcttccggccaaatggtaacaaaatgagcatgcgataaaaaaaata

SEQ ID NO: 6689 - DNA, 923 bp, Diabrotica virgifera
  misc_feature (651)..(671): n is a, c, g, or t
  misc_feature (691)..(708): n is a, c, g, or t
ttttctgaccgagcatcgtactaaatgatgttttattcaaaaaacatctcaaaaatttaattcaaatgatatgacgtcttaaaaaacgtaatttttgaaatcttcgtagttttatagaattaccaccactttaagacggtattactcaagtttgaacagatctatacttttttaaagcttaggatgtaattgttaaaatgcactaaattattttactgtagaaatgaaatagactatttctttttgagaaaattaagaaagataacaaaaatgtaatacaaaaaccgaaaattaccagctaaaaaaatgtttatataaagtgatcaaaacttttttctgtaaaacttacctaaaatacatttaataataaacttcaacaataataaatgttcagcaaaaaaaaatttttagctctcatacagtatgtctgcgtaacttgaaacctattgataacttttttattatcagttttacgaaaaggggttattctttatgaaatgctctgcatagtatataatcaaagatgcagtcatcaagtatcaaatttaatgaattttataagaggtatatcaaaaaatatgaatttcactcaatagtaaagtatcgttaaatttcacaatatcgaaaattgttattaagaaaagttgtttnnnnnnnnnnnnnnnnnnnnngtgttcaattacatccttcnnnnnnnnnnnnnnnnnntaataaaggcacttaactcttaagaaaaattcatattttttacatacctcgtgtaaaatttaaaaagtttgatatctgatggttgtatcttgggttaggccatggagagcgttttatgaagaataactttttttcgtaaaagcgattatttcattcataggagattctgaccaatagaaagctacagaaatctgaattaaatcgataatttttga

SEQ ID NO: 6690 - DNA, 865 bp, Diabrotica virgifera
  misc_feature (4)..(24): n is a, c, g, or t
  misc_feature (437)..(454): n is a, c, g, or t
catnnnnnnnnnnnnnnnnnnnnnagtgtgtagccccatagacccatagatgagatggctccaaagaacaacaaacgtcgtctgaaaaccaaatcggtaaatcggcaaaatacggtgtcccagtgtaacgtcatacgtacgcagattatagatgaagataagatgaaaatgaatacacaagaaggtccttttccaagggaaaaattggtaaaccagcaaagtgacgtttcacaatctggtatcacgaataatcaaattattgatagagaaaacaataaacttaagacctctaacgaactagattaccaacatgatcttatttctaaaagggtggaagaaccacaccaaggaaaggatgaagcggggatgaaagatcttgaacaagttgaaaaaactgaacctatgaagacggataaggactctgtattgatcatgcnnnnnnnnnnnnnnnnnngcaacgactccaaccagctaaaaagggaactattaagtacattttcacaatatcttgaggatattggagatgataaatgtgagctctcgtttgtatcaaaaatattatctgaacatctgttaccaaaggagcttcttaaactcatcaatagaaaatacaaaataacggaaaagcggcaatgtggtgcaggaggttttggagttatatatctaggaaaacttcgagaaagtggtggacctagaatggatgttatcgtaaaaggtgctttaccaaaaaaggagaaatacctaaaatccgaggcgataattttaagcccgatggatcacaaaaatatcgtcaaaatgatctcttttattacagaaccaatggaaatcgtgatggagtatatggaatatggaagcctagatcgat

SEQ ID NO: 6691 - DNA, 590 bp, Diabrotica virgifera
  misc_feature (389)..(405): n is a, c, g, or t
actctagatatagcagcaaaaagctatattcaatgacatgatcactgcattcccttgcgcagaacatcacaaatcacaatcagtggacacacccaacaattgagagagggagcggaatagaagtattggatctatcatggagggataagctatacgcttaggtagatgaatagcaggaatgaaaatacataatttctgccttgagaatgtttaatataaggctgaggggattacaccgaaagcgaaagcagtccacagctgtccgcattgaaaattatcattcctcgagtggacgtgcttagactattaacgaagtatcgtgaacaaacattgttattataattgcaccttatgtgaactggcagatcgatcattaagattctgaatannnnnnnnnnnnnnnnncatccctatggaacaccattgcacgtccgtgtatggctatgagcttgatgcaatagtttcacaacacagcttgctgtaacttgatatgtttattgcgaatgaaggatatgactaaacagccaaagctcgtgatacatctaaaaatagccagccaggtgaattctactatcaagttcttcctaaaa

SEQ ID NO: 6692 - DNA, 136 bp, Diabrotica virgifera
ggggaaagaaaaaaaaggctaaaagaccccctggggggcccgaagggggtcccctccaaactggggtcctaaaacgcggaaataacctttagaggttttcccccccaaaaaaccgatttccttgggggcccccttt

SEQ ID NO: 6693 - DNA, 554 bp, Diabrotica virgifera
  misc_feature (26)..(26): n is a, c, g, or t
tttaaaggcgcaaaaaaaaatatggnaaaagtcactctaacgccctatacgtttggaaagataaccgatggaaaaggaagaacgcaaaccgttagacgattcacatggaaaaataagaataatgtaagcgcccaagtgatcaactatggagggtatataacatcgatcaaggtaccaggttgtaacaaagaggtggaggatattacaattggttttaatgatatcgaaggttatcttaaaccagaaaacagatatttcggtgctaccataggcagagtagccaacagaattggtaaagctcagatgacagttgaaggagtaaaatataatttagctgccaataatggaccaaaccacttgcatggaggtgttgtcggcttcgataaggtattttgggaagcttctgtaaaggataccaaactcaccctcagctaccacgctgcagatctagaagagaattacccaggggatcttatagccaacgttactttcgaactgacaaacgacaacgaattccgtatcgactatagagcggtgactacaaagccgtgtcc

SEQ ID NO: 6694 - DNA, 954 bp, Diabrotica virgifera
  misc_feature (126)..(138): n is a, c, g, or t
  misc_feature (141)..(155): n is a, c, g, or t
  misc_feature (510)..(530): n is a, c, g, or t
  misc_feature (597)..(613): n is a, c, g, or t
  misc_feature (774)..(774): n is a, c, g, or t
  misc_feature (870)..(870): n is a, c, g, or t
  misc_feature (875)..(876): n is a, c, g, or t
  misc_feature (910)..(910): n is a, c, g, or t
tgtggtcgatcatgggtgatctttcgtttttccgactgtagatttttaaaagaatatggatatgcgtccccaataaaacagctttcgtcctatcagctttttaggactacatatatgactctagtnnnnnnnnnnnnnctnnnnnnnnnnnnnnnctatctgtgtaattaggttaattttggatttttggtttagtaaataacaatatagaattaagattagttagacaaacgaatagttacgaatttgttacgtcgccttgtatagttaagaactaaacaatttttcgactgtttcaatctagtctattgaattattttaaaagtagaatagtcgttaccggaattagtcgtccagggaagtaagatttttctcaggacttcgaatattccaggtatctgacaacttttttagttattaaaacattgaaattaaaaacattaatggggaaaaatattagttggccaaagctgtgccatacctatatttttaccttaaatatacttacgnnnnnnnnnnnnnnnnnnnnngtttgtttacatttaaatataattaatctattaatctaagcgccatctacacgataattgtcaatgnnnnnnnnnnnnnnnnnaaggaaactactattcgccagtcaatacgtcaaaataataagcaaaatcttaaaaaaataataatctaattacttctgtacattgtaaatattacacgataagaattaaataataaatttgaaacagttatttgctattatcgtaataattttctcattanatttccggcaaaagttgcacacataatccgctagttggcgataccagcgaagctcatagcgaaaatagtctacacacggttcttagacattactancggtnngctaatcgactaaccatgaacattaagggtgagnatacgtcacgagagcttactgtcatttgaaatcgtatatgattt

SEQ ID NO: 6695 - DNA, 606 bp, Diabrotica virgifera
ttataggcgattgaaacagctaaacatgagaagtaacaagtcactatgattcggatctcaaagaatcgttacagtgtaacgatacctactacggatggatccgattcagtaaaagtgtggattgagttcagtgggaatcggttgacaattctttttgattttggttccagtgacatgttatatacaaagattttcttagtttagagttctacgacaccaaatagttttttgctcattggtaatgaaaaattcgtcgacaaatttagctttagattgctagctcgctttgttatcacgatagagttgcaacttagcgaacaagtaggcaaatctaatgcaacaacgataaaatagtaaagttgttatagagttaactggatatgttaaaagctgaagtaatatttgctgattttagagacagttaacaatctaagttctagagatcaccaaaacgtactctcagtagagaaaccgaatgtatatagggtaaaaactaatataaaagtatcatttgatgttttagtgaaatcctgttcactttttttaacacatatttaaaaatttacgatagaaggatcattaaaacaagctttttacagttattct

SEQ ID NO: 6696 - DNA, 945 bp, Diabrotica virgifera
  misc_feature (354)..(390): n is a, c, g, or t
taagaatagcacaaaaaagttaccattgtgatattcaaatatatgtgaccgatcccgaatataaaaaaagtttcctgctacacgtgtgttaaccagtaaattgtaaatcatggatgacgattgggatgatgactctggatcggcccctgcacccacaatggcacctagtgtggcaacagaaggaggtaagaagttttcagcaggaagaggttttaaatctgtagagatcagcgatggagattggaacgacaatggcggtggtgacagttggaacaatggtggtgaaaatggatattcaggcggtagaggaggtggaagacggggcggtagaggaggaggtgatcgtgacggcgnnnnnnnnnnnnnnnnnnnnnnnnnnnnnnnnnnnnntggagatagaagaggaagaggaggttttagtagaaatggcgacagtaatggctacggagatgaaaatggcggagacagttatggcgattccaacaaagaaaattatggaggatatgaaaacagaggccgtggtagaggtggtggcagaggaggacgaggtggaggtagaggtgatagaggagatgataacgatgactatggtggtggtggtgggtggtgataaaacggatgaaccacaaaagccacgtgaaatttatatacccccagaacgagatgaagatctgtttacttctacaataacatccggtattaattttgtcaaattggatgatattgaagtcaatgttagtggtgaaaacgttcctaaaccgattacatcttttgaatcatcaggtatgagacctcattttattagagaacattaaaaaatctggttacacaaaacccaacacccattcagaaatatgctgtgccgataataatgaatggaggagatctgatgggttgtgcacaaactggatctgaaaaaacggctgcctttctttttaccctatg

SEQ ID NO: 6697 - DNA, 191 bp, Diabrotica virgifera
gaaacttaagaaaatcccacaaacaggagccaagagaatgggggctctcttttggcaggagaggaccaaattccaatgactgcccgagcaatcaccgccttagaggtctaccaaatgcggataaccacaattagcagggcggcacaagcatgacggaaaaaatggaacagaatctaaaaggagtgcaacca

SEQ ID NO: 6698 - DNA, 936 bp, Diabrotica virgifera
  misc_feature (38)..(77): n is a, c, g, or t
  misc_feature (178)..(201): n is a, c, g, or t
  misc_feature (417)..(440): n is a, c, g, or t
  misc_feature (453)..(470): n is a, c, g, or t
  misc_feature (504)..(526): n is a, c, g, or t
  misc_feature (752)..(770): n is a, c, g, or t
  misc_feature (849)..(868): n is a, c, g, or t
agcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnncagttggaggattacaggggtagttttagcaaactcctcaatgatattgtacttcatgatacctattatgttgttgcannnnnnnnnnnnnnnnnnnntataggagctgtatttgctattatagcggggatttatccaaatgatttcctttatttacagggtatac

SEQ ID NO: 6699 - DNA, 517 bp, Diabrotica virgifera
ctcacgcgcccgccgtgtagacacatatatgctacctctgcctttgcatacccctgacatgtcgcaaattatcccctatggggcctgtgcgtgcgaacgatgtcgcctcattattattatgatgattgttgttaagctgtcggctttacaaagcgagaacaaacacaaaagagagtagatggatgtactgactcgtcatacagatactctttacatacctatcggactgatcactaccaacgcaaaagacagcgtgtgtgtgcactttgtgctcagcgtcacatgttagaatgcgattatccaatgcgcaagaaacctgatggtcgtcagactttctacgagtgctacaatgcaaccacaatggctcgcacccccccacgccgccatcattcgcaacaaaaggcgcgcttgttcgaaagctgatctacatacctccccacatccctctccccttaataaccaccgaatatgacccccccattcgcaccccttttccttgaatgcactacacattact

SEQ ID NO: 6700 - DNA, 898 bp, Diabrotica virgifera
  misc_feature (435)..(454): n is a, c, g, or t
  misc_feature (636)..(653): n is a, c, g, or t
  misc_feature (718)..(759): n is a, c, g, or t
gtcattggtgattgttgctcctcgatatttaaattatttaaccacttcgaagtatgagcccgcacttggtatgagctcttccaatttctgaaacaaacggactatttttaaaaaaggctgttgtagtacttatcatactaatggactttgttttatattgccacgatcaggcgttaccaataataacgattttgacggcatcaaacagattgttggctaaagagacacttaatatgctttaaaactttacgtaatactaaaccatatcaagaaacttattcgacttataaaattatatctttcaaatcctccattctgattagccgtattgattagctttcaaaaaattgtttgacggatgtttttatttattgtaaataaaaaacattttcaagtcgtgatcattttcaatcttagataaatgtatagctaatnnnnnnnnnnnnnnnnnnnntgggcactaaataatcacttgtaaactgaccgcggtgaattttcaaaacagctgtactcccggtgttttaattttgccttgcctaactcttgagatttttacattccaaaaaattaagaagtaagtggctttctggactaaagtgtaactacaaatttggagtactttgcaaaatttcaccnnnnnnnnnnnnnnnnnnatgaagtttcaattttattaatttgaaaatttcccatgattttaattaagccttatatttgggannnnnnnnnnnnnnnnnnnnnnnnnnnnnnnnnnnnnnnnnngggagaacatagatttttgtacattttataatatttaccattagaacaaccacaaaattttttaatcaaggttaattaccatggccccaaattaataagtttcataaaatggggaaataaaattaatattgaacatttt

SEQ ID NO: 6701 - DNA, 583 bp, Diabrotica virgifera
  misc_feature (443)..(458): n is a, c, g, or t
  misc_feature (460)..(581): n is a, c, g, or t
agaaacaattactttaaggcaattatgctcgtcaaagttcttgtggttttattcatatgtattgaagtatgtcggaactgtgaggtgggacaaactaagcaaggatgtttgatcaggaacctcgtgtgttcttgtggtattggatgtatatctgattacagatatgatacatttcaagagtgtcaaaatgctttgaaaggaaaaaaacgagatatttgtaaggtccataatccatgtttgcacaacggtacatgcattcaaatttcccaacaaccaggctaccggtgtaggtgtgaaggtacaggatatttcggagctaggtgtagtagagtgtgtcccactccaggccaaggaagagccggtacaatttacccttatgagtgtatagtgatatgaagcaaaactactttttaacttgtcaattagaaaacaagccagattannnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 6702 - DNA, 462 bp, Diabrotica virgifera
  misc_feature (432)..(454): n is a, c, g, or t
acagaaaaagctgacgaaaggaaagcactatctattatgataataatgccgtgggtgagggtagatggtacacttaatagagtaatgttaaaaacatggacttgcaatgtattgtcttactgtctggattatcctaaagtgccattttcaaaaatctgcgataaattttgttatataaaacctgtggatttatattttattgtacagattttagaagagattggttgtattgaagtattaatatacgaaacagaagaggaatctatattttcagaatggagaaaaacttgcgaaaggccagctacatttctggataacatagaagatctgataattcagccaaacaatgtttccatgacacgtcttgggtcgttttacaatgaagaatgaacacagctgtaaatagtattcgtctttattgttttgtacagnnnnnnnnnnnnnnnnnnnnnnnctaacgtt

SEQ ID NO: 6703 - DNA, 53 bp, Diabrotica virgifera
  misc_feature (6)..(23): n is a, c, g, or t
gtttcnnnnnnnnnnnnnnnnnnctaatcgaaaccttgtaggaagaggaagac

SEQ ID NO: 6704 - DNA, 627 bp, Diabrotica virgifera
aaaggtactacatcactctccataatgtgcactcggcgatggtctaccaacgctccctgggcacaaacgccaagagcggaggaatatggacctgtctctcgcttcaactctagaggataacaactccaacccctcataagtgttaccgaacccagagaacgataggttgacctcagaacaaccaaacacaagaagccatatgtagccaagagaccgaaccaatggcaacagtacaatgtatgagaccgacggaccctcgctgatgttacactacacctgaagaagatgccaacgtgatacttcagatacaatatttaatcaactccactagaagaactcgtgcttatcacaccaaccatacacgtcaagacaggagtagaacgtgatgtgaactcggaggcgtccttgacagcagacacaatgataacaaaatctgctataccagaatgccgatggtaaaggaaccaacgacatagcccctgcacgaggatcacgtcaccacacgacagcatctatcatcactaggcaaagtaacgtctgtagcaactgagcagcaacacgcccctgtagctaaaggagctcacgaacaaagtccggtggctcacgaatcccacgtcacacctttgc

SEQ ID NO: 6705 - DNA, 184 bp, Diabrotica virgifera
  misc_feature (2)..(34): n is a, c, g, or t
  misc_feature (37)..(62): n is a, c, g, or t
  misc_feature (64)..(87): n is a, c, g, or t
  misc_feature (101)..(119): n is a, c, g, or t
cnnnnnnnnnnnnnnnnnnnnnnnnnnnnnnnnnacnnnnnnnnnnnnnnnnnnnnnnnnnncnnnnnnnnnnnnnnnnnnnnnnnntgaaaataaattcnnnnnnnnnnnnnnnnnnnatattaattaccaactttttgaacgcaattctatgattagattaaaatattaccttagggataac

SEQ ID NO: 6706 - DNA, 934 bp, Diabrotica virgifera
  misc_feature (11)..(43): n is a, c, g, or t
  misc_feature (707)..(707): n is a, c, g, or t
  misc_feature (825)..(825): n is a, c, g, or t
acctctatggnnnnnnnnnnnnnnnnnnnnnnnnnnnnnnnnncttcccatattaactttagaaagtaaatataaaggatgtcaattgaaattgaatcagccgatgttattcggcttatccagcagtatttaaaggaatcaaacttattcaggacactccatacattacaagaagaaacaggagtaacactaaatactgttgatagtgtagatggattttgtgcagacattaataatggacactgggacactgtgctcaaagctatacaatcgctaaaacttcccgataaaaagcttatagacttgtatgagcaaatcgtcttagaattgattgaactccgagaacttggagctgcaaggtctttgctaaggcagactgatccgatgattatgttaaaacaaaacgaacctgaaaggtatatacatttggaaaacttattagccagatcttactttgatacaagggaagcatacagtgatggtagcagtaaagaaaagagaagagcagctatagcacatgctctttctggtgaagtttctgtggtgccttcttccaggttacttgcattgcttggacaagcattgaaatggcaacagcaccaaggtttactaccacctggtactactattgatttgttcagaggtaaagctgcagtaagagaacaggaagatgaaacgtttcccacacagatggcaaaacaaatcanatttggacaaaagtcacatgtggaatgtgctaggttttctcctgatggacagtatttggttacaggcagtgtcgatggtattatagaagtgtggaactttactacaggaaaaaattangaaagatttaaaataccaagcacaggataactttatgatgatgaagcatgcagtgctgtgtatggcattttctagagacagtgaaatgttggtaactggatctcaaact

SEQ ID NO: 6707 - DNA, 913 bp, Diabrotica virgifera
gtagtgtttttataacgttaaaacatgataccaaaagatatatgtgatctagtagaagattatttaaacgaaaagatagaaaatttcgaaattcaggaacatgaaggtaaccaaaaaggtcagggacatttaggtgagattgtattcttatcattgaaaaacaaaaaaacaggaaaaaagcatcatttagtggttaaacaatgtctcacaggttctgaagaaactagcaaattgatgtcggcatgttttaacaacgaagtgcatttttatacaaaagttgtaccagctatagaagcgtttcaaaagtcttatcctagagctgaaatttttagccacctaccaagatgttttgcaacgagctcgaaaagaggaaaagaaaaattggtaatggaaaatttaaagatacaagactacaaaatccatcctaagaaagtgccactaaatagtaaaatgtacgagattatttttaagacgtatggaaagtttcatggaatttgctacgcttttaagcattaccatcctgatcaggttactgaattgggcaaagggtatcaatctacaatgaaaatgttttttgatggaggtttcatgcaaaaagcaattaccggtaattgtaacaaaacaaaagaaaatgttttttgatggaggtttcatgcaaaaagcaattaccggtaattgtaacaaaacaaaagaatttttggaagaggaaggtgaaataaaaattctcgatagttttaagaaatattgtgataacggtcctcaaatgtttcttgatgcacttgactacaaaagtccatattcaatttttatccacggtgattgttggagtaatatatgatgttcaaatataatacaccaaacatcgctgaactaatggacccagattccactgaagatattatgagtcaaatat

SEQ ID NO: 6708 - DNA, 838 bp, Diabrotica virgifera
acgggaccgggactgccctgccccttctcccccccccgtctggtagtggtataataaagtgaactttttgctatcaagagatataatgagatctacttgaccaggatatatcctagaagagagaaaatttcctagttatcgttatcttgatggattcctacaatgacatttctattaacgtgatatgtgtaatcttatgattgataaaaaaatgaaatgggacaaagcatcgtttcatggtcaaaccatggctcacagtgccttgaaacaactataaactgtgatggcacacatgttttaacaccaaagtgcgtttatatacgatacttgtacctactatagaaagcgtttcaaaagtctgatccaaaagctggaaatattggacgactaccaaaatgacttgtaataatctcaagaatcacgttacggtcaaattggtaatggaacatttagtgatacaagactattagatacgtcctaagaaagcgccactagttatgaaaatgcacaatattatttttaatacgtatggaaagtttcatggtatttgttacgcttttaatcattatgatcctgatgagggtactgagttgcgcaaagggtatcgatctacaatgaaaatgttgttttgatggaggtttcatgcaaaagctatgtaccggctatttgtgtcaaaacaaaagaatatgttttttgatggaggattcatgcttaaagccattaccggaacttgtaacaaaacaaaagaagttttgggggaggaatgagaaataaagaatctcgatagtttaaagaaatattgtgataacggtcctcaaatgtttctttgatgcttctt

SEQ ID NO: 6709 - DNA, 76 bp, Diabrotica virgifera
  misc_feature (5)..(68): n is a, c, g, or t
ggggnnnnnnnnnnnnnnnnnnnnnnnnnnnnnnnnnnnnnnnnnnnnnnnnnnnnnnnnnnnnnnnncaattttt

SEQ ID NO: 6710 - DNA, 328 bp, Diabrotica virgifera
caaaatacctacactcaaaaagtcaaaatgaaaattgtatttgtagcaatttttatggtcctcgttgtagctgctacagctgatatcattggtttacctcattgtggtgaacacgagattcaaggatgtgagccttgttgtcctgagtcagaagtaacttgccaaaacaaggtacctcagccatgtaatgaaccttgttttatgatttgtagacataaatgcgtttgtgatcaaggataccttagagacactagcaccggaaagtgtgtacaaaattgtcaataatttaatcttagtatttagtacttaaattgtaaaaatgtaacgt

SEQ ID NO: 6711 - DNA, 798 bp, Diabrotica virgifera
  misc_feature (56)..(713): n is a, c, g, or t
tgtcgaacaaaaacatgttattcctgctatgtttaaggaagtctacgcaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcgatttgccccaagatatcaaaccaggtcaactcatcaaagtaaccaccgacacggggaaaggctttcgacgtcatcttta

SEQ ID NO: 6712 - DNA, 595 bp, Diabrotica virgifera
cttacaaactattttattattactaaaatcataaaccaatcactaataaattgttaaaattcattatattggttctgcttgcagataaagagtttctcgtgactgtaatataaataaatctggatcaatttgtatgggcatcttggtacttggactaattgtcaatttaaatctccgtataatctcgataatacctattttgctttgcatgtatccaaatcttaatcctatacagtttcgaggtccttctccaaacggcaagttcgagtacggaacaatattattcttattttcaggactaaatctgtcggggtcaaacgtcagaggatctttaaagaattcaggatctctctgtatactaaatatcggtatcacacaagttacacccctttctacaaccatattcgagtttttaaatgtgtaatcttttacacacttcctctgaagatttgaaactactggataccaccttaaagtttcatccatgacttggtgaagggacttcatttccgtgatggactcctaaggtagttcttttttgtcgtttaaagctgtggtaatttcctctccaagtctgtcttgcaattctggatgg

SEQ ID NO: 6713 - DNA, 656 bp, Diabrotica virgifera
  misc_feature (172)..(172): n is a, c, g, or t
aacccatttctcggtaatttttgattaatcgtgaattgtgtggatataatcgattcttgtatacatactgttgactcttcaacgaacatatagtacttattccaacatcatgtgtaaccaccagccgttctaagaatctcgaaatatctcttcctacattacaacattattngagtcggaatctacctatctctaatacatttgaatatgacaattatgagtatgctcctggacaactcttttatctacccaaagactactgtatttgcagatcctagtttactcacggtaagaatggaaggcccaacaacaccctctgcaacactacactttgtacaacgaccaacagatacggattacatttctctataagtcataaatggtgtgaacccatggaagtcttactggtattaattccgactgatcgaggaaatcaacatatcccacagtataactaataaattgtcggcaatcacgacaagagttgttataagatgttcaatatatcaagcaaatgcaaaacctaaaggattttatcctcatgctcacagattgatgatgatcagaggacgtgaagaggtcgacgatcctcatgatgtggaggctgggcatgaagatggttttatagacgaatttccaggaatgagaattattca

SEQ ID NO: 6714 - DNA, 967 bp, Diabrotica virgifera
  misc_feature (873)..(873): n is a, c, g, or t
  misc_feature (938)..(938): n is a, c, g, or t
ggcagatctgttcataactacaaaagacaattttgagatatggctaggtagggaagagtcaaatccaaagaagcccaaattttcatacaaatctacaattcctcatcctatcaatcccaaaactagtgaaactgccaaagtgataggccaatctctttttgtcgatgttgaattaaaaggaaaagttgatttattaacacctgtttgttatgactggaaatgtcagaatggtgctttgttactttattcaaatacagaagaaaaatggattgatttacaggtcaattttaaagatgattaccaaagcgtatggacattcttcaaaaacgaaaactataaatacaatgacgtaatcaccctaagaagcggcgatttcaatatggacggctatccagacattttagctactctaactccagtgtcaaattataatgcaccacaatccttcctcttagagaacgtcccctgtcaaaactattgtggttctctaaaacgaacgtttgaagtacgatggtcttctttgaacccctttaaaaatggtacaataatggcagcgttctttgatttctaccaagacggtattcttgattgcattgttgtccaatcagttaatggggagtataagaccgcagctttcaagaatagtttggattatgatgccaattttatcaaggttatggtactcaccgggttgactaataagaataacccgatgatgatgggtcgagtggggaagaaacgtagaacatatggaacaaatttaccaggtccttccatatcttacaaaacaaccacacaagaaggcaacatccgccacggactctcatgtcagcttcctcaaatcgctcatttcagtctcagccttccatacancatctttggtctagggcgaacgcccaattcgtagataagtcacagtgggggtgtcaactactccnaagactggacccaatcatcccgactctca

SEQ ID NO: 6715 - DNA, 913 bp, Diabrotica virgifera
  misc_feature (643)..(643): n is a, c, g, or t
  misc_feature (744)..(744): n is a, c, g, or t
taaatatttagctgaacaaggattttattctttccataactggtttgatgatagagcatggtatcctttggggagaattattggaggtactatctatccaggtttgatgatcacttctacagttttataccatttatgttggttgctaaatatcactatagatataagaaacgtgtgcgtattccttgcacctctgttttcctcgtttacaacaattataacatatttgctcactaaagaagttaaaaactctggtgctggtttagtcgcagcagctttcgtatccattgtaccaggatatattagcagatctgtagctggcagttatgataacgaaggaattgccatattctgtatgttgcttacttattatacgtggattaaagctgtcaaaacaggaactatcttttgggggactctcagtgctttggcatactttttatggtctcctcatggggaggatatgttttcctcattaatttaattcctttgcatgttttgaccttgatggcaactggacgctttggacatcgaatttatattgcttacagtactttatattgtgtaggaacaatcttatccatgcaaatatcctttgttggatttcaacctgttcaaagttcagaacatatgctagcactgngtgtttttggactatgccaaatagttgcttttgtagattacacgcgcagtaaattgtctgcatcggagtttgaacactctacaccttcctcatctatacangtggtatcctaacagtagtagttggaggtgttttgacagtatcggggaaaaatttcgccatggactgggagattttattctttattagatccctctttatgcaaaaccatattccctatattgctagtgtttctgagcacaacctacgtcttggagtcgttttatttga

SEQ ID NO: 6716 - DNA, 217 bp, Diabrotica virgifera
  misc_feature (172)..(172): n is a, c, g, or t
  misc_feature (185)..(203): n is a, c, g, or t
gtatcccttcttcttcttcttagcatcgatttcaacatacttccaatttattcaggctattgtttttatgtcgtctactcatctcttctgtggtctccctcttggtcgtctagcttcgtaaggtggcaatagacgtaaggtggtaatactgtattgtggcattccacattgntcttttttgtctnnnnnnnnnnnnnnnnnnntccatttgagtttg

SEQ ID NO: 6717 - DNA, 1221 bp, Diabrotica virgifera
  misc_feature (10)..(32): n is a, c, g, or t
  misc_feature (868)..(890): n is a, c, g, or t
  misc_feature (921)..(961): n is a, c, g, or t
  misc_feature (964)..(982): n is a, c, g, or t
  misc_feature (1115)..(1153): n is a, c, g, or t
  misc_feature (1168)..(1192): n is a, c, g, or t
ttctttttcnnnnnnnnnnnnnnnnnnnnnnncataaaatttaacagtgaaattatgacacttaaccctctgtagtatgaattttttctatctttctaggatcgtattggtctaactcgttttcttctagtgagtggactccatttttctattttttagccatctattttcaggcattctctgaaggtgtcccttccagttgagtcttttggcaatagtctaagacagtaattcgacataaaataattgcggattcattaaaaacacatcaaactcgtacatgaactatttactccgcgaatgaaaccggcacatgtatttaattaaaacgcgaacagtgatcagcgacacaggtaagatttttataaacttacaatatcgtctgtttcgaggcaggcttgtcaattttttagagttcttattgcattttgactttctgtaggtaccattatttcattgtccacttcatatgatatgatgttattcgtgaacagaggtcttgtttcagtaggaatttgtgagtaatgttggatccaagatcttttttatatcaagtctattgtattttttgtacacacataaacagaattaaaagaattacggaaaagaaaggaaaacaggcatttcctagtaacacagagacacgacagaataatactattttacaaagtagaattattattgtatttcgtgttgctgggcaacaaaggataaacataaaggagtcattctatgtattttttgtactgttaatattaggtggggtgtattttctagattttcaagaaagatgtttgattaataaacacgtagatagcaaggtcaaataaaactaaatgtttttagtggactccaaatgataatatcnnnnnnnnnnnnnnnnnnnnnnnccttcacaaagggcatattctggtccccacnnnnnnnnnnnnnnnnnnnnnnnnnnnnnnnnnnnnnnnnnccnnnnnnnnnnnnnnnnnnnctaatcgaaaggaaaaataaaacgagatttaaaatttttttacccccccttattgtatcacccccggcccctttttaaaacagggggggggggggattccacctgggaaaacccccccccctttctttacccnnnnnnnnnnnnnnnnnnnnnnnnnnnnnnnnnnnnnnncgggggccccccggnnnnnnnnnnnnnnnnnnnnnnnnncacaggcgcgagggctcacaaaaaaaatt

SEQ ID NO: 6718 - DNA, 391 bp, Diabrotica virgifera
cctttagcggccgaccacataggcatcatgaagataatatcatttgtgtgccttaattctctatctcaaactggacatcatcacaggaaatatctagaacgatcttacgggagtatttttaggattcttatccatatttgtccgcatacctgacactgggaattcagttaatgtaaggccagaggtgaaccatttgtggagcctaggatgccatggggaagtcgccgaccacgaatcaaccccacaacatctatgggagaagactctgctcagatgaatgcaagcgctaaccgagaaggacacaaacacatagtactttatgccgctataaatccaatttatatggcagaagataatgatctcataaagcgaaaagatgtcaagattccaa

SEQ ID NO: 6719 - DNA, 970 bp, Diabrotica virgifera
  misc_feature (163)..(180): n is a, c, g, or t
  misc_feature (832)..(832): n is a, c, g, or t
cttattgtaattgtataacagattgaaaatacactgtcaagttaaaaaaatattcagacttgacccggtacattcgccaaactttaaaaaaaatcagtgcggagctctcgctaaaatttaaactgtcaaaattcttttaaatttgattgcaacatagtaaagnnnnnnnnnnnnnnnnnnggtacaaagatatggtaccgggccagaggaatgcagagcatgcataaaaataccaataaacaaaaaggattaaaaaccaaccaacataattatagaataataacgctgctacagtctacatcaatattgttaaaaaaatcgtgtagcagaagttaattaataccgtaggtattatcagaagaacaacaaagattcaggatgttcacattacagccactagtagagaaggccatagagttcaacaaacctcttttcatatgctttgtggatctcacaatagcttttgatacagtccaactgaaagacctaatccaaattatacagttttgaaactatgtatttatataagttttcgtacatgactatatcaaattgaatgatgtttttcttataattaatgttccattttaacaaacttaactatttaagatagctttttcatcgcaggtctgtgtaatctttaactttaaatataatatagatctcactttaaaaataatgtacaaaatgtttgttattaattaattaaatgtatttaacatcctaattactggttttttgtttaattttgagtaattagtgtatttatagtcatctaaaacaacaaaaactgtgttatctcccaacacagatgttattacatttctcatanaagtgtcaataacataatataaatcaagataatgcattaattacttaaaatcactatttgtaacagtccaaaaaacgtggaaaatattaattgaagtttatattcaaaattagaaatcaaccaggataagttattact

SEQ ID NO: 6720 - DNA, 828 bp, Diabrotica virgifera
  misc_feature (467)..(485): n is a, c, g, or t
tttgcgtccgactgcacctaggttcatcatcccatccatcgaattaacaacagataattgcctttatatatattcagttatcttaggagctctttttgtccttgctatgacaaggtctttcttcttttataaaatggctatgttgagctcgaaaaaacttcatggcacaattttcgataatgttattgatgctacaatgagattcttcgacacaaatcctggaggaagaattcttaacaggttttctaaggatatgggagctgtcgatgaattattgcctaaagcaatattggattcttcacagattcttctatctatgtgtggatctcttgtactgattattgtagttaacccttacttcttaattttgataggagttttaagtgcagtgtttggtgtaatgagacatatatatttaaaatcctctaagaatattaaaaggttagaaggaataagtacgtatacgnnnnnnnnnnnnnnnnnnngttattgttatgtctcatcaacattggcttcatacaccatattagtacttagcctgtttaattaatcttctacatttaattatatttcaaactctttttctacagtttttctgcgcttcagttctcctgtacttacatagtatttttggttgctccttgagtctctttccctccatgctttgttgagtttgattattgctgggtcagagggttccatggccaattcatgaccctacttatattaattttataaaggtaatattaccatattttctacatttaaggtctttcgttagcttgataccattataaactattcagtttacaaagaaatggtattttt

SEQ ID NO: 6721 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6722 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (168)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacattgatctgagtttaaacccgggtgagcccggttggtttctatnnnnnnnnnnnnnnnnnnnnnnnnnnngaaaagg

SEQ ID NO: 6723 - DNA, 816 bp, Diabrotica virgifera
  misc_feature (112)..(138): n is a, c, g, or t
  misc_feature (277)..(291): n is a, c, g, or t
  misc_feature (763)..(763): n is a, c, g, or t
cgtttgggtagccaggaatccacccggctttgcttttgtagagttcgaagacgccagagacgcagaagatgctattcgaggattagatggccggacgatatgtgggcgaagnnnnnnnnnnnnnnnnnnnnnnnnnnngagcggtaatggacgttaccgcggcccccctccccgatctcgtggaaaaccatttcacccggatgacaggtgctatgattgcggagatagaggacactatgctagagactgcaacagatacagatcgtcgaggaggcannnnnnnnnnnnnnnttctagaagccgttccagagaccgtcgttcgagaagcaggagcaacacccgttccaggagccgctccaggaaccgttccagatccgattctaggaagagaagccacagtcgctcgcgcagcaacgaaaaacgctcaagatctagatcagctcgctctagatctagatcgcatagcagatctgtcaaagaaaacggcaacgcgaaagattagtgtaacaaaaggggatttcaaacatccccgaaattctactgaatgtttctcaatgtcgtagacatcctccgcaagatttcgatgaggacggtgtttggatttgttccacttctgtttgattaacagatatggttgttaatatacgttttgcgcacctgttgttggatgttatatgtaacaaaaatcgtcctcagtgttcctatattcttgatagactggacatcaataacaagccaagtggcacatagtcaaacttttatnttggagaaaattttaatttattcatttaaattcactttaaagtcccatcttcc

SEQ ID NO: 6724 - DNA, 1030 bp, Diabrotica virgifera
  misc_feature (900)..(900): n is a, c, g, or t
aatgcatactgggagaaaaaacattcagttgtgaaatttgttcgaaaaattttagagagaagagagccttaaaaaaacatatgcaaaatcacgtcaaagataaatcttctccatcaggttctcctccctaaccgagattgtaaccactgcgttgactgttcatcgcgagaatgcgtcgtcgaacaacctaagatgtgctgatgaagtgaagtacagaagtctaaacacacatggttttcctgataaagacgtcatgtactagactcaacgagtcgcagtagaaattgggcatgaaatattccaataagtattaataaaagaaaaaatctgacagatgggtttattggaaaaatacgtataatttcacacggaacaaaaaactcacatatgtgaatactgctccatacacttttcgtcaagttcgtctttaagggtgcatatgcgcacgcataacggaaatagagtgttgaaatgtgaaatctgctctcgggagctcacaacaaattctcatctaaaggtgcacaagtgaaatcacatcaaagaaaaaccgtacaaatgttaggtttgttccaaggagcttacgcaaatgggacaattaagcaaacatctttattgcatactggagaaaaaccatttagttgtgaaatttgttagaagaattttatcacgctaaacatagactgctccatcaggttcctctctctaaccgagattgttaccactatgttgactgttcatcgcgagaatgcatcatcgaacagcctagatgtgctcatcaagtgcagtacagaactctaaacacacatggttttcctgatgaagacgtcatatactgcaaatcacgaatcgcagtagaaattgggcatgaaatatcccaataagtattaataatgggaaaangaaagtgtggtcattagacagaagcggatctcttttgaggtggattctgattttttcagaaaaattgtgtaataacttcaataataatatttgacttatcattcctcctaaataagccgaggatattaat

SEQ ID NO: 6725 - DNA, 326 bp, Diabrotica virgifera
acccctgcgggtcccggcccgaattcccgggccccccccacgcccccggagcaataagtaacaccacaattgtcgttatcattgattaattcagcaaacgaaaacgaacaaccatgttttaactggtaacgaaaactggatccaacaagaatcaaacattctggaataaaaatgctgactctatgcatggtctgcatttacaactgcaccatgcggatccaaactctaatagaaagcgagaaatacaataatcaacttcctcacggttcgggccgagcaccgcaagcagcatctgcagcacctgtagcaagcccccccaggaaacc

SEQ ID NO: 6726 - DNA, 543 bp, Diabrotica virgifera
  misc_feature (2)..(25): n is a, c, g, or t
  misc_feature (27)..(39): n is a, c, g, or t
  misc_feature (42)..(68): n is a, c, g, or t
  misc_feature (70)..(183): n is a, c, g, or t
  misc_feature (186)..(228): n is a, c, g, or t
  misc_feature (231)..(283): n is a, c, g, or t
  misc_feature (289)..(315): n is a, c, g, or t
  misc_feature (435)..(452): n is a, c, g, or t
  misc_feature (497)..(530): n is a, c, g, or t
gnnnnnnnnnnnnnnnnnnnnnnnngnnnnnnnnnnnnnagnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnngatccnnnnnnnnnnnnnnnnnnnnnnnnnnntttaggataacagcggaattttttttggagaagtccaatccaaaaataaagatggcaccccccatgttggattaaaggttaaaattggggggaaagcgttatatttttaagtgttgtccnnnnnnnnnnnnnnnnnnctggtatttgggtttaaaccgggggggggggccggggtggggttnnnnnnnnnnnnnnnnnnnnnnnnnnnnnnnnnncccgaaaagggcc

SEQ ID NO: 6727 - DNA, 789 bp, Diabrotica virgifera
  misc_feature (480)..(498): n is a, c, g, or t
gtcttcttcctcggatcttaaaacctgatagagcgtcgcactcgtgtggaagtagcttgtatggatgattcaaatgtgtaggtagaaattttgtgatcccacataaactattggataaaaatatacaaaatgtcaagaaaccctgaggctatagttgggtttgaatttcagtgatatataaatgctgcaatgttcttcagggaggtgcgaactttgagagggcgacacggtttgattggcgcacccggaattcagtgagggtttgcctgttgagcagcagtattattgccgaggtatttttagggaatcatactgtaacatgtttaagggatcaccttgggacggcccggcgggtttgggagatatgggacctccaggtggccaagtttttagtgagcccatttctatgcacgtcagtttatttcatcaattacgtttaaatttattaaactttcctacatcccaagaaatatactaagnnnnnnnnnnnnnnnnnnncacggaacccaccaaatcaagctccaaaaaaaagtattcaatcagtcaaaactgcctactttttgccattgtacctatttagagtaaagagacaaccatctttcagtcccagaataattgttttctaatttttttaaaggcctaaaaaagcccttccaaaaattttatgacccgttttcttgttcaatcttatttccaaattaagattttaggcaggtgccgatcccaacatccccagaatttaagtctaatcgaactggtcctaaaatgtgcccaattattggggggggt

SEQ ID NO: 6728 - DNA, 702 bp, Diabrotica virgifera
  misc_feature (8)..(25): n is a, c, g, or t
  misc_feature (634)..(655): n is a, c, g, or t
aaatgagnnnnnnnnnnnnnnnnnngacaataggtgatggtgcgtgtggaaaaacatctcttttgacgacttttagttttaatgcctttcccgaacgtcatgtgcccacggtttttgacgcatattcaaaagatatcgaggtggacgatcaaacagttacgctagctttgtgggacacagcgggagaagaagactatgataggcttagaccattatcctattcgaggacaagtgtagtgctcatttgtttcgcagtagactttccagattccttatccaacgttaaggacaagtggtatccagaagttaaacactttttaccgtacgtaccgtacatacttatagcaaataaattagacctcagaactgatccagaaacaattaaaactttagccgatagaaaccagcacccagttagccaagaagaaggagaaaggatggctaaaaagattaaggcagttaaatatatggaatgctcagccaaacacctttttggaattaggccaatttttgaagaagcggctcgcattgcacttgaaaccaaaactaagagtaaaataaagcattgtaaatttctataggtagttgttataaaaacagtgtggtctcaaattggtgacgcaatgtcatgacnnnnnnnnnnnnnnnnnnnnnngtacatgttacaatttaaactatgtaataaaattatagttagttaat

SEQ ID NO: 6729 - DNA, 494 bp, Diabrotica virgifera
  misc_feature (428)..(428): n is a, c, g, or t
cgttattatatcggaatacctatacaaaatagctacctactgagaaatacgattctagatatgattaccggtactcaaataaaaaagtaataatactaatcaaagtaacgaatactgtaaatgattactttatacaaaatatgtatacatgatgttatatatttacagtatttagctactgtaagagccacgccgcgacccacctgaaatccgctcgcgacccactagtggatcgcgacccaccggttgggaaacgctgacttacaatgaaatcagtgatcataggcgtaactagggggcggttttggggttacacctctgtcagtgataccaatcgtacttttcaaaaaacaaaccgtttcttcacccagaattgcacaaaccttgtacacggtgtatatttgagactgttctacacaacccaaatncatatttttagtattttgtacacttcttcacctgcctgcacacttcttcatctttatttatgtata

SEQ ID NO: 6730 - DNA, 753 bp, Diabrotica virgifera
  misc_feature (687)..(705): n is a, c, g, or t
  misc_feature (739)..(752): n is a, c, g, or t
tctatactatttcttaaatgatgagtaccgttcgtcaaacctatgatttctcggcctataaactattattcgcccattgttatattataatacgatcgaaacccttttttacagaaaatgcaacgttagactacaagttgttttcacggtttatgagttcattgcatctcctcttgtgatcatcagtcaaaaaagatttccttgcagctgcacaatatatcaattcacttgctttaatcattctaagtgtagtgcaaatgctgccctgaaacgctgtcccttcgctagctcaatacctcatcttattactctctggagattttctgcctcttgaaccacccaaccgtgctatagagtgaaaatgatctcatctttgtttgatgtttcacactaagctgtcgatatgcacatatagctcacgttcaaatctgcaacaacttgcctgagtgaccaaccttcttcgagtttggcaattgcatttattttttgcgcattattcaaatgcagtctaggtattttggcactgtgattttacagtattacgatataaaaatgaaggtggggattatttgtctgttcccctttgaagccaatcagttaaattgacttgttcagagtgaggctactgtatttgtacattgtttccttaatttgactaaactattatcgtttgtaaagttcattccnnnnnnnnnnnnnnnnnnngaccgacagatctgtacataacaagtgtctttgnnnnnnnnnnnnnng

SEQ ID NO: 6731 - DNA, 767 bp, Diabrotica virgifera
aatgaaaactgccaaaaaactaacaacaaaagaaaatagattaagtagcgggacagttaaattaatggaaagtagacgaaaactaataagcgaaaacaaaagaaacagtagaatacgtagaactgaacaaacttattaggagaaaaaccagagaggatctaagaaaacacactgaaaatgaaatcgagaaagtaattgagagaaataggggcctaaaataaaggcctaaaatgcttacgaccaaatttagggaaaccactactcatttcaataaaggatgaaacaggacgggaagagaggagaaaagataagatatcagaagaagtagaaaggttttataaatatacacctcaaagaaagacgcaaacttcaacactcaggaatatatcaagaaaacaatcacgaatgtaaactcagaaacattaccaaaaatagaaaattatgaaatagaagcagcactatcacaattaaagaacaacaaagcaccaggaccagatggaatccttgctgaaatgttgaaagaagggaaagaagaaatcttacaaacattaagaaatctgtttaatcagtgtctacataaaggagaaatacccgacgaatggaacgaaagtcttacaatcctgctatttaagaaaggcgacagaaaggacataaaaaattacagacccatctcactgctgtcgcaaacgtataaactattcatgaggattatcaacaacaggcttacacacaaattggactcgtatcaaccagtaaagcaggcagga

SEQ ID NO: 6732 - DNA, 838 bp, Diabrotica virgifera
atggactccacctaaaaatgatggtggtgcaccagttgagaaatacatcatcgaaaagaaagatcctgttaccggaaagtggcagaaagccgttgaagttcctggtaataaaacagaagctaaggttcctgatttacaagaaggacaaaaatatcaattcagagtcaaagctgttaacaagggaggcgacagcaaaccatctcctccatcagaaacaattactgctaaagacagattctttccacccaagattgatcgcacaaaccttaaagattttaccgttcgtgctggtcagcatatcaggttagatgtcaaagttagtggtgaaccaccaccgaccaagacttggttcctcaacaaagcttgtattgagaacagagatgatattactgtggatctcgaagattacagaaccaaattggtaataggtgtattaaagagagaacatactggtaccctaactctaaaagctgaaaatgattctggaagagatgaagccagtatcgaaattaaagttttggataaaccttctaaacctgagggtccacttaaaatcagtgatgtacacaaagaaggctgtactcttaaatggaatcctcctcaagatgacggtggtgttcctattgaatattatcaagttgaaaaacttgatacagctaccggacgatgggtaccggcaggtagaaccaaagatcctaaaaattgaacttaataacttagaacctggccaagaatataaatttagagtttcagctgttaacgcagaaagtgaatcggaaccctttagaagcagagcaaacgatagtagctaagaatccatttgacgaaccgggagcgc

SEQ ID NO: 6733 - DNA, 727 bp, Diabrotica virgifera
gaggatactacagcctttggcgaagatgagggagaatttggcgttaaaaaggatgctttagcgtttaactttgaaaacaatttcattgggacttaacccagtactagcacttggtgtatttctatatttaaataggaaatttaccacttgctgctccatagtgagctccgactgttgaatggaacatttttccaatgcagctttgactgtttgaacatgtcgctctccacacccatttgactgaggatgatatggtggactttttagaatggttattccattgttttgacaaaatcttgtaaattcagtagcattaaacggtggccattatcactcaccagcataactggcaaacccatcaaagagaaagttaccttcaacttgtctaaggcatccatacattacattttttcacctagctttccgaggagctgccatagtagcatacttattatgtgaacagtttaccgcaagttttataacaagttttgtaagtgtaattttattattatcaatggacttctggactgtaaaaaatataacaggaaggctaatggttggattgaggtggtggaattatgtggatgaggatggaaaatctcattgggtatttgaatctaggcagaacaaagtaaatgaacgagaggctcgcatcttctgggttgctttggttctaaccccattattgtggccctttctatttattgtaggattatttggattcgag

SEQ ID NO: 6734 - DNA, 968 bp, Diabrotica virgifera
  misc_feature (882)..(882): n is a, c, g, or t
cgtagctctatcaatgatagaaaagcacggtggtgattttggcaaagaaagactattctcttgctttggaatggcaatatttgcacccataacaggaggcttaatcgattggtatagtgaaaaagtcggccatactgattattcactcgcattttattcgtttgatttcctgttaataattgcatctttgtccttgtttttcatgccattggataccaaattaccctctgatagtatgttcagcgacttaaagaagattttgaaaatgccagcgttgatgatggttgtgttctttttgttccttttaggtaacttatggggtttcatagaaagtttcctattcttctacttaaaagatcttggagctccaaactatctattgggaataaccgtaaccgttggtacaatgagcagtgtaccattcctttatggctctgacaaaattactggcactattgggcacgtgactgtggttatcttggcgttctttgctcatgctactcggcttgtgggttattccttaatcgagagtccatggtggtgttttccattcgaggctttggaatccatagcagtgcatttaatgtgggtagcagctgcaacctactgcgctgtactagcacctagaggtttactagctactttattgggtgtatgtgcagtagcacagtatagcgttggaagaggaagtggcagctttataggtggtcatattattgcaaaattcggaattacaactgccttccgaataatgggattgtttgcagtttgttccggattgtcgtatgcatttctaaacctagtgtggttaaggaaggttgaaaaacgagaacaagatcgtagagaggccgaagtaacggaggatttgaaggcggtggctanaatacaagatcaaggcacatgatgagcttagaagactaaacgtcatgatcgatcagacccatattgggtctatcacttccttgggc

SEQ ID NO: 6735 - DNA, 1058 bp, Diabrotica virgifera
  misc_feature (697)..(720): n is a, c, g, or t
  misc_feature (734)..(757): n is a, c, g, or t
  misc_feature (865)..(892): n is a, c, g, or t
  misc_feature (933)..(971): n is a, c, g, or t
  misc_feature (974)..(986): n is a, c, g, or t
  misc_feature (1036)..(1057): n is a, c, g, or t
tgacagtttgaagaaacagttcgacgcgcaccttctcatatttcattattaatgcactcattgacggattcagtctcgtaaattctcgagatagtgtcgttaaacgttatgtgctcgttttgctaataattcggctttgctaagttgtagtttcttaaagaggattttattggagcttttgtttgtaaaataataagaaacatgccttccgttaggtggaaagctatttatgctacaatcatctgctgtcattatctggggctagtatcttcaaataatatgcaggatccaattacgatgacatctgatggatggaggccgatagtgggtagcagaagacaaccacctggtttcgagtcggatatgcgcctatctcaatataaaagtcctagtcagaatacagaaactgaaattatttaatccgaaagtccgatcacgattacaacgcccgaatatgaacaacacgaagaaattgaaagttcgacaaaagctttaaacaacttgtatgcaggaccggcgccggcacaaaaaactggtaataagattccacccccccccacatttaatcccccaaaattaaaagaatcccccctatggaggctttttatggacgaccttccaaatatggttttttgaaaaaaccccctggcccgcaaaaaaataaagaaagagaacaaaatgttttcccacctctccnnnnnnnnnnnnnnnnnnnnnnnncgaaagggggggcnnnnnnnnnnnnnnnnnnnnnnnncaatacaattccttcccggtctttctaaatttcccccttccccgaaacaagaggccgcacgcaaaattgggaaaaaggcagaaaaaaaaggggcttggggggtatttnnnnnnnnnnnnnnnnnnnnnnnnnnnngctccacactcccccctttgataaaacacacctttccgtcnnnnnnnnnnnnnnnnnnnnnnnnnnnnnnnnnnnnnnnttnnnnnnnnnnnnnctccaaggaagaaaaggggcccgcggggagtttatacaataatttttatnnnnnnnnnnnnnnnnnnnnnnt

SEQ ID NO: 6736 - DNA, 503 bp, Diabrotica virgifera
cccttaaagcccgggaaattgaaaataaaagttggcaatcctttctacgagtttttctcgggactgcttttttcaagggctgataaagttggacgtctgaagatgctgggacggcccacactggaattgtgaagataattagtgaagacgaaggtggaggaaaagagattgagatgtattacttcacagacataaagagtaatcagagtaactgtaggcggagacaaagcgcatggtgcccctaatagagaatatgaaatatcgctagtcttattggaggtagctgacatgaaagcgatgacggaggagactgaaaaggggggcataggatgcggaatgagttgtggggaaaccggaaactcaagtgggataacatgattaatgcaagttcatatggagagagtgatttataccccccggcggacactaacatgagattaatacctcagggatatggattgaggaatgttactaagcatgtaaagcaatgacctgaatatatc

SEQ ID NO: 6737 - DNA, 939 bp, Diabrotica virgifera
tgtgaattattggtcacctcagttgcattcgcagtgctttcttcattaggtttatctttttcttcagatggcttaggctcttctacacatcgtcttttgctattcaaaggacattccaattcatgcgttgccatcctctttactccgcttctgaatttacaactcttagattcaaagctgcaaggtatttcaacgccttctgcaatgtcttcgaggatgaaatttcgagtgtcttcaatactgccctcgcacgatggacatttttcaacctttgccttgcaaacattgcatagagtatgtcctgctttgcattggtggattggaggtatcatgtagtctttgcagatgggacattcaaataattgtttaatcaacttatctgttttatcttctttgtactcctttagtacgatctggtagttcaaagtattagtcctgtattttacggcatctctgttcaacttagtagttagccgacggaagatttcttttctctttactttatagatgtggtccgaaattttacaagttcctcttgaacatttgaagcaatgttctttatcattgaatttgataattttctggtcttcagccaatatgaaaaatttcttgttatctgagagtaacattaagtcaaatgtttcgtcagtgtcttcaattgaacatacactaactccaaattgttggtcatcgaaatcaaagaataaaagataggttttctcatttttaaccagtacttccacgttatagtatccatatacattctttaagtaaaatttattgaaatggaaatttcaatatgactctctttgaaatgagtgctgatagctgatagtttgactttttgatgacactttgatgttgggcacactacttctggcatcttggaaagaattgggagaacctttttttagttttaaaattgggaattgtttcttc

SEQ ID NO: 6738 - DNA, 270 bp, Diabrotica virgifera
tttcgcccggtagatactcctagtaacttaaaaagtggggcattataaatgcaccagtctatagaacctgcattagagacatgcgacacgcgaccgcaatcaattttcagccacgctaggctacgactatggcacggagtagaccagacaccggcataggcgctatgtccgacatgcctgtctaaagttatgatgaaatgcataatcccattcggcatagcgagcataattgtcatcaacgacatggacatatatgtactgagatctgct

SEQ ID NO: 6739 - DNA, 1045 bp, Diabrotica virgifera
  misc_feature (948)..(980): n is a, c, g, or t
  misc_feature (997)..(1040): n is a, c, g, or t
gacaaatacacatttgtagataacaaaaacatcgacacttctgatacaaatcaaaaatgaagttgcttatgtgtctccttcttctttggaaaacagtttctttggctcaaagtgataaagtgttattggtattcccggtaccttccaaaagccactttattctcgggaattctttagcgagagggctagcccaagctggacatgaagtaacgttgattagtccgttcgcggatgaaaatccgccaaagaattacagggatgttgttttggagggatttatggaaattaaaaaagaacaaaccatcttcaatgtatttgatatggaaaaaatgcaccccatgttaagcgtcttcatcatgaacatcatcggcaatcaattagccaacgccacacttggccaccccaacgtccaaaagctgctgtcatcaaaggaacactttgacgtaatcatcatagagcagttcaaaaataaagctataaacgcgttacagtggtactacaacgccccactaattctattcagtacaatcgggccaagtttctgggtgaacggcttcactgagaatccttcacctccgtcttacatcccagatatgttcttgagttatacgagcgaaatgaatttttggcagagaacttttaacttcattatgacactttaatgaataattaaacgattatttcttggtttcttcagcgcagacagaaatcttgaaatcttactttccaaattggcccggatgctgaaacaacaaataaaaaacgtttttttttggtggtttttaaactcccaccaaaagttcaaacccacccgtgacctaaaaactccccaaaatgataggaattggggggttttccataaaaaccttcccaaaaaacatccaaaagaactgaaacacttttttggaaaaggccaaaaaaggggggggttaatttccataagggggnnnnnnnnnnnnnnnnnnnnnnnnnnnnnnnnncaccaaaaaacgggtannnnnnnnnnnnnnnnnnnnnnnnnnnnnnnnnnnnnnnnnnnnggaaa

SEQ ID NO: 6740 - DNA, 768 bp, Diabrotica virgifera
  misc_feature (9)..(378): n is a, c, g, or t
  misc_feature (380)..(436): n is a, c, g, or t
  misc_feature (457)..(479): n is a, c, g, or t
  misc_feature (488)..(510): n is a, c, g, or t
  misc_feature (517)..(549): n is a, c, g, or t
  misc_feature (553)..(578): n is a, c, g, or t
  misc_feature (590)..(619): n is a, c, g, or t
  misc_feature (621)..(669): n is a, c, g, or t
  misc_feature (750)..(767): n is a, c, g, or t
ttgagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnngttgaatggccgaggcattgnnnnnnnnnnnnnnnnnnnnnnntcattagcnnnnnnnnnnnnnnnnnnnnnnncgggtcnnnnnnnnnnnnnnnnnnnnnnnnnnnnnnnnncatnnnnnnnnnnnnnnnnnnnnnnnnnnttaacctttctnnnnnnnnnnnnnnnnnnnnnnnnnnnnnncnnnnnnnnnnnnnnnnnnnnnnnnnnnnnnnnnnnnnnnnnnnnnnnnngattcatttaatcgggcgggaacaaaaaagcaagtttacctctttttaaaattattagtttaactaactatttttttggannnnnnnnnnnnnnnnnna

SEQ ID NO: 6741 - DNA, 553 bp, Diabrotica virgifera
  misc_feature (11)..(32): n is a, c, g, or t
  misc_feature (57)..(354): n is a, c, g, or t
  misc_feature (361)..(398): n is a, c, g, or t
  misc_feature (418)..(431): n is a, c, g, or t
  misc_feature (434)..(456): n is a, c, g, or t
  misc_feature (464)..(486): n is a, c, g, or t
  misc_feature (516)..(547): n is a, c, g, or t
tttgcgcccgnnnnnnnnnnnnnnnnnnnnnngtgaccgtgctatggtagcataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6742 - DNA, 84 bp, Diabrotica virgifera
  misc_feature (25)..(44): n is a, c, g, or t
  misc_feature (49)..(69): n is a, c, g, or t
tcccgggggcgaccctcccgcccgnnnnnnnnnnnnnnnnnnnntactnnnnnnnnnnnnnnnnnnnnngacctttatttagga

SEQ ID NO: 6743 - DNA, 350 bp, Diabrotica virgifera
cgggccaggggaccggggccggggatccccggggcgcccttgcgccggggagacgtctggatggacgaatcttttttaaggactgacggccatattggaacctcttagatctttacggagcagaaagaggcctggaacactttctcagcacatcagtattaaattctaaggagattaagtattatctacaacgagaggcattctcttccctaccgaataccttacagcatcacgaattaagggtattcgaaagtaaaagtcgcgggaagtagtgtgtggcgtgtatctcgcgagagaacgatggatatgatacccagagatgagcaacatgaatgctgtttcccggaccg

SEQ ID NO: 6744 - DNA, 483 bp, Diabrotica virgifera
  misc_feature (30)..(61): n is a, c, g, or t
  misc_feature (68)..(193): n is a, c, g, or t
  misc_feature (205)..(225): n is a, c, g, or t
  misc_feature (240)..(297): n is a, c, g, or t
  misc_feature (300)..(326): n is a, c, g, or t
  misc_feature (336)..(399): n is a, c, g, or t
  misc_feature (405)..(462): n is a, c, g, or t
agtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgggatctnnnnnnnnnnnnnnnnnnnnngggaaggaagggtgnnnnnnnnnnnnnnnnnnnnnnnnnnnnnnnnnnnnnnnnnnnnnnnnnnnnnnnnnnggnnnnnnnnnnnnnnnnnnnnnnnnnnnccctatgggnnnnnnnnnnnnnnnnnnnnnnnnnnnnnnnnnnnnnnnnnnnnnnnnnnnnnnnnnnnnnnnntggggnnnnnnnnnnnnnnnnnnnnnnnnnnnnnnnnnnnnnnnnnnnnnnnnnnnnnnnnnngcccaattttttggattataa

SEQ ID NO: 6745 - DNA, 881 bp, Diabrotica virgifera
  misc_feature (3)..(15): n is a, c, g, or t
  misc_feature (124)..(145): n is a, c, g, or t
  misc_feature (285)..(333): n is a, c, g, or t
  misc_feature (496)..(514): n is a, c, g, or t
  misc_feature (806)..(806): n is a, c, g, or t
  misc_feature (826)..(844): n is a, c, g, or t
ttnnnnnnnnnnnnnggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattanaatatatacttcaggatgannnnnnnnnnnnnnnnnnngttgatagagaattggatcccctccaccagctggatc

SEQ ID NO: 6746 - DNA, 873 bp, Diabrotica virgifera
  misc_feature (814)..(867): n is a, c, g, or t
ccttacagaacaagttatacataattatgcagctattagcgttagtatttctcattcaatgtgtttccgtcttttcaacagactacgaggtgccgaaaccacggtttaaggtgctcccgaaaggattccgtgtgagcattccccaagaagaaggcattcaactgttcgcgtttcacggtaatctcaatgtgcccatgaatggtctggaagctggacaaatcgcccaggacgttgctcaaagtaaacgtggtagatggatcttcgaagatagacagactaagttacaaagaggtgatgtgatttattattggttgttcgtgatcaaggaccacttaggatacaaaaagagggagtgtacctggtgaaagatactgatataacgaccacgtcgtcagaaggatcccaggagaacaactttcacgcgtcatcgggccaacaatttcatcttgataacgagagtgacactggctacaagatagccctcaaagtttccgatattgccggggatctgtacgaggaggtcaaaaagttaagggaaatcaacactgttctaacacaactggtccaaaaggacgatagcctttcaaggactttaaaatttgagggtgtgttacccgcatttgatgatgccgcgtatgttgcacagattttagttaatgagaaactaagactgacagtaccagtagtaaatgctacgagaaatcccgataaaagtgttagctttcaggtagctagtcttgaggacaaagtgtttcttattagatcagcaaaaaaatcattattagattcaaaaatagattagtgtattagggtnnnnnnnnnnnnnnnnnnnnnnnnnnnnnnnnnnnnnnnnnnnnnnnnnnnnnntttact

SEQ ID NO: 6747 - DNA, 611 bp, Diabrotica virgifera
  misc_feature (25)..(62): n is a, c, g, or t
  misc_feature (593)..(610): n is a, c, g, or t
cctattatattataatgtcaatatnnnnnnnnnnnnnnnnnnnnnnnnnnnnnnnnnnnnnnatcatccaaaaaatccccacatctggtggagactataaaatgatggataacttgaaccaattccaaaaagcttgtgtgaaatacggtgttcccgatgtagatcttttccaaacaactgacctgtgggacaggaaaaacatcgttttagtcacaactaccatttttgctctaggtcgcacctgttacaaacaccctgaatggcgcggtcctttcttgggacccagaccatctgaagaaaacaggagatacttcagcgacgaacaattaagagctggtgaagctattattggactccaagctggccaaaacagaggtgccactcaagctgggcagaactttggtgcttctagaaaaatcattttggtaaaataaacaaacattcgaagagacatattgaatctataaaaatagttgttatgtacctataaaaataacttgtttgaaatttaccataatttgattatacaaataaaatgtttacctgatttgactaccaaacttatctgaatggattaagaatttatattgacnnnnnnnnnnnnnnnnnnt

SEQ ID NO: 6748 - DNA, 496 bp, Diabrotica virgifera
gtggttgggttttgatttcagtgttttatattttttggaacattccacagggtgttccaaaatttgagaggggaacacggtttgattcgtacaccctgtatacagtgacaatgtgcctgtctggcaacaatgttgttacagcgatgttgatgaagagtggggctataacatattaaagaaattgcttgaatcggacatcaggtttgggaggtacaggacattaaaaatggcccatttttggggtgcccgttttttgtgccggtgagtgtattaggtctttcttacctgtttccttgttattttcattatatatgtcttcgctttatttatatttaggttgtattttttttgcttctgagtgccatttttctaaatattactttaattttcagtcgaatagaagctatctgatttgtcaataataatgaaatgactgcatttatcatttggattctttaacatactatacaggattatttacgaggttctcatgtat

SEQ ID NO: 6749 - DNA, 362 bp, Diabrotica virgifera
taaagtcctcacttccttcggatccgaaggctcataagaaggtcaattcaaattcccaagaggggtagcagttgacgaccaaggatatatctgcgttgctgattctggaaacaatcgaatccagatattcagccctgatggcggttttctgagagcttttggttgctggggcattggaaaagcggaatttaaaggattagaaggcgttgctatgacaccaaacgggcacattttggtgtgcgatcgggaaaatcataggatacaagttttctgaaagagtttttgtttttaatcgacataataataacttttttccaatataaagtgtgtttaactgacatcaataaatctatttgcatttt

SEQ ID NO: 6750 - DNA, 347 bp, Diabrotica virgifera
ttttcgtccgcccaattgaagaagttaatataaatacacaactttgttcgaaaaacgcttaaaaatctgaaggactgaaaagctgcaagtaaagacagaataccaaacgaattactgaaacattgtagagcagcaatggaatacatagacctggatcccgcggaccaaaattacttgattgatagcaagctgaaaatttgggaatatgtagcttagcggagtctacgcggataggctttgatgtatgggagcactggagcggggaaagacttatgtgcggaccaagataaagatttggaacgccagactacgaaaacgttccatgtatatttgtgcgaataggactt

SEQ ID NO: 6751 - DNA, 1014 bp, Diabrotica virgifera
  misc_feature (894)..(912): n is a, c, g, or t
cttgtttacatttttgacatttaaacatattatattaaatatgatatataatttgtagcgaaatgcccctagttgcaagaagagtatctcgtaacgttgtacgtgctactcctatctcacctccagtcatatcaagttttgcaaatgaaccttgtggacagaggtacgctccacttggagcatcggtcccaacccttcctgccttggaacctcctgcttctcctaaacattttcctttcccgaacacaccggtagacaatgaagttttcttcgagagcctgatgtgtttttttgctatggcttccactggtttgcagtttttacatttatacagatctgtttggtggttaccacactcatatacaaatcaaacaatgaatttctacttaattgacccatatttggttgcctttattgttataacactatgcagaagacttatttatattattatgcgtgtagtagtgaaaaaggtcatgattactacattacctgaacaggaatttttacatacttttagattctttttatttaccaaagtttttatgatgttggggttttgtttggtccttgtgatgcagaatcacaagctggagaagattttatatttatgttatccattcctgatttactttgtattctttggtcggaatggtccatccctttttcgaaatagtcaaatggagttccgccaatcctcctctgcatgcatgtagttcaagtgctctagaaatacgaaaaagaaagttgagaaccttggtacccattttaatggtagaatgaaagacattctattttcttgctttttggtaacgcattattacgctgggatcattccttggttgttttgttccagctttcgttacttttacaaaacatgttggggctgcacannnnnnnnnnnnnnnnnnntttaaaccggggttttttcttctttttaaattcccatttttttcacttctggaacagggaaaacccccaaaaaaaaacgttgggattgtgggggtattgggg

SEQ ID NO: 6752 - DNA, 367 bp, Diabrotica virgifera
gatttgactttttattttattcatgaacgaacataattattgcagataatttttgaactgttaccattaacgttgtctaacaattgaaaagttgggtaaaaacagtaattttaaaaagctttgtctgcaagtaatactgcgcaacggttaacaaaagattaaaacatggactgaatacctttaatcgacttcatcgaacgtaacactaccattcccaccaggcaaacccagaccttccctacttactctgacgaccaccccggagtacttattctacgaatatgaacgtgaacaagccctgaccctggagatcacccctcctgggaaaatccaactttccgtggtttcccctgcgccccgcggggtc

SEQ ID NO: 6753 - DNA, 93 bp, Diabrotica virgifera
gctgataaaaagaaaatgttttaaacccaaaaattttaaccgcaatatttataacaaaaatatttaagggtgtacaatttttcgggggaaatt

SEQ ID NO: 6754 - DNA, 873 bp, Diabrotica virgifera
  misc_feature (833)..(865): n is a, c, g, or t
gtttggttggtttcataattagaaagcctgccagtgttgcatttgatattctttcttttttgacatcataaccccggataagtttttacctgtctggctatgtcgttccattctgacctctcttgtgtccttctcctccattgtctttcgttcatagttttcaggtcatcttttactgcatccaaccatctctttctgtgtatctttctttcatctttctgtcggctaccattgtaaccttttctttgttgctttttatcttcttttttattacatattgtacaatatcctacaatgtcgtgagttgctcttcatctttttttgtcattacccatgtctcacatccataggttactacgggtctaattaatgttctgtaaatagtaatttgggttcgtttgtctaataattttgatgtcataaatcttttattagcatagtacctatgtaagattcccactgaaaaacatgcattaatttagcttcttatggaattcttttgattgattttttgtgcacaaatatgtaaaggaatccacatgttcgatggtatagttgtctattgcgatattattttcattgcaaggtgctcttttgactatcatgtacttggttttgtgcttcagtatcaaatttctctgaacacttccattagttggtgtttgctcaatttttgagtttaaagttaaaattgataagtaaagttaagatgaaaaaatcataattagatatgggacacttatatattataatgtatatgaatatattattatgtaacaattggttttttctgttggattttcacaggaaatgaatttttataaggggtttannnnnnnnnnnnnnnnnnnnnnnnnnnnnnnnnctttgggg

SEQ ID NO: 6755 - DNA, 822 bp, Diabrotica virgifera
  misc_feature (167)..(181): n is a, c, g, or t
aggattgaatgccgctctattctacgaaaaccctgatattcgcaactatgtctctctggttcctacgagtgcaatcacaggagaaggaatgggtaatttactggctttgatagtagaattttgtcaaacaaagttaacaaaacgtcttatgtattccgatgagcttnnnnnnnnnnnnnnngaagtaaaagccattcctggtttaggtactaccattgatgtaattttggtaaacggtactctaagggaaggagatacaatgctgtgcgctggtactgatggtcctattgagactcaaattaggtcgttgctgatgccgcaacctatgagggaactgcgtgaaaaacgcttatattgaatacaaagaaatcaaagcggctcaaggagtgaagatcgcagccaaagaactggaaaaggcaattgccggactgaacctctacgtggcccacaagtcggatgaaatcgatattgtgaaggaagaggtggctagggaacttaaatctgctttgtcgaacataaaattagccgagagaggagtgtatgtgcaggcatctacactgggatctcttgaggccttattagagttcttgaggactagcaaaataccgtactctggaatcaggataggaccggtagtgaagaaagacgtgatgaaagcatcgattatgttggaacacgaaagtcagtacgccacaatcctagcgtttgacgtaaaagtcgaacgagacgctcaagagctcgccgatagcgtgggtgtcaagatcttccaggcagacatcatttaccatctcttcgataagttcatggcgtaccgagaggagc

SEQ ID NO: 6756 - DNA, 524 bp, Diabrotica virgifera
aacacgacagtgatgatattattgaaggtagcggtcgaacctagttacagaaccccaaagttcaaagatgcatgcacttctagagaagtaactcaaataattttgtcaagttcggacgaagagagtgttggtgttattggaggtagcgacgacgaattacttcccaaaatgaaaccaaaagtaacgcaaataatattgtcaagttctgaacacgacagtgatgatattattgaaggtagcgacgatgaatcagttcccaaaacaaaaatgaaacaacccacgttattggagatgtttaaaaaagaaccaaaattagaacaaaaaatagaactaaaaacagaaccaaaaatagaagttttgagttcagaattttttgaggtttcccctcgacagtatcaagaacaaagaaacatggtaaggagactacgacaagaccttgaacaagctgagcaacttatggaggctcttaatatggaacatttaccggataagggtcagtctttaaaggatagatatcggacttt

SEQ ID NO: 6757 - DNA, 1023 bp, Diabrotica virgifera
  misc_feature (971)..(995): n is a, c, g, or t
  misc_feature (998)..(1016): n is a, c, g, or t
gatcaagaatcagcaaaagtaatgcacgatagaatgctattcttacttggaaatatgattggcaccatggttgatgctactgtcaaagatggctgtaaatttagaggagtgtttcatggcgcttctacagaaggagatttggctattgttttaagccttgctcaaaagatatatgatcctacagctcctatcgcagaggacaaaacgaatccaaaccctgttgtgagcaaactattgatttattcaaaggatttagtggaagtcacgatttcttcaatcaattttactgaaagcgcctctgaccgtaattacagatactgatatcactggaaagttggaggttaaagagcgagagttacataaatgggcaccaagcgaagaagataatgctttaggtcttttagatggtgatttagaatcgtcttccccgggagaaaccgcttgggatcaatttgctgttaacgaaaagttgtttggtttgaagactgacttcaatgaagagatttatacaactcgtctagatagatcagctcctggattcaaagatcgcgaaaagcgtgcaatcaaggtggccaatgaaatacaaaaagtctcaaccaccaatgtacatatgttggaagagcgcgggtttttagttgaagacagcggtatggatgaagaggatttatatggtgctgttgtacgtgacagcaacaagtatgtacctccagctcttcgtaagcaatcacaaaagcagacacaagaacagcagcccaatgcgcaacatcacaagtgaaaaaggaacataaaagcaacatctcctgccacaaaagtaggtactgctaatcttacaaaaaccaatggatcatcccccttcacctattgcaaaatctcccaacatcccctcaaaaaagttaatgaaaaaagggcaagaaaagggccaagaaaaaccaagcccccaaaaaggataaaaatccaagggtggccaatannnnnnnnnnnnnnnnnnnnnnnnnatnnnnnnnnnnnnnnnnnnncaacccc

SEQ ID NO: 6758 - DNA, 833 bp, Diabrotica virgifera
tggggaagttggcattaaccagggacttgagacttcgaacagatgggaacagccatacctgtgttcaagagtaccataaggcagtaaatattaaatttaaagtcatatacggagttagctcactgatcacatttcttcatatgtgtatatgttcggtcatcaccattatctttctagctcaagtcagtttttagcgttatcttgtgttacttcgaagaacgagttaatcagcgacaagttatatacacctagattttctctaatatttcgcccagaatagttctggacccagaaataacatatttgttagcctttgagcttggtcacgtctaagtactattatgtaggatctatctcacttaaagtacttatttgccctgtacataactttttttactgaagtggaaaaattctaactaaaccaacttgggaacccgtgtggaggaccacatgctaggacataatacccaaaggacgcattatataagccgtatgcacccctgaccagtcgtctaccaactaaaacgaccccttcttcggacaacgcaactccccaagagttcaaccggtgaacgaaacattgggatgctctgcgaagtctaaaaattcttactggaaaaactggaaaatatttttacctaaaagctataacaacggcttaaaataacatgcaataacatccattctctttggaaaatagtgcaagcaaaaacgcagtgttttccgtcgtttatgactcctgactccacaatctgtaggttgcctttgtaagcagttctcaacgcttcgtaccatataggcgcgcagtataaaagggtagcatgtacaaccta

SEQ ID NO: 6759 - DNA, 53 bp, Diabrotica virgifera
ggggccgaagggggtacattcgaactgggatttccaccagcgggaaaaaaccc

SEQ ID NO: 6760 - DNA, 656 bp, Diabrotica virgifera
ctaagtaactacatacttgaatgagctcaaaaaaaagggtacgagaatattcatctgattatatgcttaaaacagcgaaatttaaaatagtttatatgggacatggtatgattccactacacacattctaaaaagaatataatcccactaatgtaggtagtgaatgcttctaactcgagaggaagatcattgatatgtaaaataatgctgagaatccttatcctttaatgcgactagccattgataataaagttataaataaataggcatattatattgctgactgatttaattataagtattttcattattagaaattgataaatacatgatatgggcgcctgattttgagtatcctttaaaattcattactatatctcattctgcaacaaggccttccactactaacacaaatgtatgaacaaagaacggtattttaaaggacaaaaatactattagaaagattagctttatggggttttttttattaattgttttgacagtatgtctaaataaacaaatgctgatgacatgataatgaaagtggaatacatagcctttgtgctcaaaaactgttatacgattaaagggcacttcatagtccccctggtgaaaaccgtcgtggttagcctaaaacgtggaccagaaaaaaggca

SEQ ID NO: 6761 - DNA, 970 bp, Diabrotica virgifera
  misc_feature (63)..(82): n is a, c, g, or t
  misc_feature (92)..(121): n is a, c, g, or t
  misc_feature (879)..(903): n is a, c, g, or t
caataaaattgttggtaaataacctttctttgtactttactaattagaccagcgtattataannnnnnnnnnnnnnnnnnnnaaagattatnnnnnnnnnnnnnnnnnnnnnnnnnnnnnngtcgataaaatattaaataagcgtctcatctatataatatttataagtttgatcaatgtatcattattgttttggttattattgcgatcataaattgttggttaacagttgaattgttgctgaaatattcgtttaattttcaccggcttctggaattacaatctataccaagagggatttgatgtcattaagttattttattattgattagtgattacttacctaagactttatttgaaaattggagtttttgttgggaaggcccgcattttccgaggaaaattttcgtcgaggcagatcgtgaggggcaggtctctgtgcagaatttaattgcggtgaatttttgtttgagtgtttttgttgtggacttgtaatcttcggagttatagagcaataattgaaaaaaatacgatttgtcagcgccattttgtttgtagaaggggtagcgcactgtctgcggactttgcatgcctatattattgatatgtgggatcttgtaattcgattccagcaataaaattgctggtaaataacttttccatgaattttgctaattagcccagagtataacccagttgttaatctactgtgtttctagtccttaattcttgtcttctatatttagcaaatatttttcatctgatattcgtcctaaccaatatacgtttttcatgatagtgtcatactagattaactgattgttaatgttataaattgaaaactaacataaagcgaaaaaaatagtttgagattttgtnnnnnnnnnnnnnnnnnnnnnnnnnccgttgttcgagtttgttataatttaacaaactaatttgtctctcaaatcgctactacgcatgctgc

SEQ ID NO: 6762 - DNA, 890 bp, Diabrotica virgifera
  misc_feature (757)..(776): n is a, c, g, or t
ttgcgtccggaaataaatcaaaacaaaacaaaatacctaatatgctcaagataaaacccagttaatatgataagcttaaatattggtgaatatgaatttgaaaaggtatgaaagatagaagtatcgaaattaatgaaagaatccaggcaggaaacagggacctactagcaaatacagtaacttcttcaaagataagaagcttactcagaatacaaaactggaaatttacaaagcagcaattagaccagtaatcacatattatggtgcttaagtaatgtgtctgacccagaaagaggaagaaagatcgaggatcctagaaaggaaagtaattcggaggatagcaggaccactaaacttaggtaataatgaatttagaaaactcatgaaccacgaactaagagaacttctgaaaggagaagacatcgtcagatttatcaaggcacagagactcaaatggatgggacatagaaaagagaaaatcggaagccgttatcaagaaaatttccaaatggagacctgtatcaggcagaccacgaggaagacccaaaactagatgggagaaccagatagtggaggaccttaagaagatgggagtcagaaaatgggtaaccaaaagcaaaaacaggaacgaatagaggaaaattgtagaagatgtcaagtcacacaaccaattgtaaaacgaaaatgttaatgcggattgattcaccgcgacaaaagagcccaaagagggcgtcaatcactcggctaggagtgtaannnnnnnnnnnnnnnnnnnntgtctttgagccacgctgaatgtgcttctgataataatatgcttagcttggtcttcaaagactattttacgtatgcattgctactattttttgtttgtatggaaactttgtttg

SEQ ID NO: 6763 - DNA, 1349 bp, Diabrotica virgifera
  misc_feature (11)..(83): n is a, c, g, or t
  misc_feature (89)..(111): n is a, c, g, or t
  misc_feature (302)..(375): n is a, c, g, or t
  misc_feature (380)..(445): n is a, c, g, or t
  misc_feature (463)..(481): n is a, c, g, or t
  misc_feature (490)..(504): n is a, c, g, or t
  misc_feature (506)..(522): n is a, c, g, or t
  misc_feature (525)..(544): n is a, c, g, or t
  misc_feature (559)..(579): n is a, c, g, or t
  misc_feature (649)..(702): n is a, c, g, or t
  misc_feature (736)..(772): n is a, c, g, or t
  misc_feature (786)..(874): n is a, c, g, or t
  misc_feature (877)..(907): n is a, c, g, or t
  misc_feature (911)..(965): n is a, c, g, or t
  misc_feature (969)..(1025): n is a, c, g, or t
  misc_feature (1039)..(1207): n is a, c, g, or t
  misc_feature (1209)..(1221): n is a, c, g, or t
  misc_feature (1223)..(1279): n is a, c, g, or t
  misc_feature (1309)..(1339): n is a, c, g, or t
tttgcgtccgnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatggctacccttagcagggccaaaataccgcggccattcaaatttaattcagtgggggaggcgaagannnnnnnnnnnnnnnnnnnnnnnnnnnnnnnnnnnnnnnnnnnnnnnnnnnnnnggtggcgaattcctttattaaacctattaatttnnnnnnnnnnnnnnnnnnnnnnnnnnnnnnnnnnnnnatccttacattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnncccnnnnnnnnnnnnnnnnnnnnnnnnnnnnnnnnnnnnnnnnnnnnnnnnnnnnnnncctnnnnnnnnnnnnnnnnnnnnnnnnnnnnnnnnnnnnnnnnnnnnnnnnnnnnnnnnncaaaaatattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnncnnnnnnnnnnnnnnnnnnnnnnnnnnnnnnnnnnnnnnnnnnnnnnnnnnnnnnnnncgcggcaaacaaccaagaggggggaacacnnnnnnnnnnnnnnnnnnnnnnnnnnnnnnncttttttaat

SEQ ID NO: 6764 - DNA, 732 bp, Diabrotica virgifera
  misc_feature (281)..(302): n is a, c, g, or t
  misc_feature (326)..(344): n is a, c, g, or t
caaagtgaagggcattttaagataaattgtcttaaatggaatatatgagatgatattaaatggtactgtattcaaattttttgaaactattttaattctattaacacgttcgctgcatatattttggtgagtatttctcccggagggtgaattgagctagagtgaatacttctcacactaaccggtgggatggaagtagacgcttgtcgttcgaaggggacaaccgtggtatagaggaaaaacggtatggatgctgatgatcgagatagtgcagcaaaggnnnnnnnnnnnnnnnnnnnnnnctatatttatctgatgatttgtgnnnnnnnnnnnnnnnnnnncacaaaggattcatgctatcatgaaaaagcagtttataattgggtatctatgactacatattatattctacaaatcgatagtaggctccacatctagcacgtaataatgatttgattaaggatttattaaactggaatcctaataatgataattgcagtagaaatatgcattttgtgttttaatttttttgcaggtaagtataaatgaccgctgttgatcaatgaaaattgtaacacgtaataaaaatattgagggtcagaacctgacaaatatatgggaccttggttccatgactctcctcagtaagatagaggcaataaaaaagaacctcatttggacaacgggagttaggggattcagtgtaatcgtaataatctcttctttggt

SEQ ID NO: 6765 - DNA, 884 bp, Diabrotica virgifera
gatccaacttatttttaaaattcttctataagcccacatctcaaacgcttctattaatttatttatatcctttttaggatcgatttctcatacctgcgttaatctatggttcagttgaccgaggttcaccggtgaacttcggttttgtttggaatacatttctcattgttagtgcatgttctacagctttcgagaaatgccaatagatggcaaaaggtaaaatactatcgccattttgtacgaccttttttatgctgtttttgaataaagttaaatttaagtatttatagtcaaatctgttctgaaatctttgaacggccgaattccagcgttcaggttgaacgtagtttaaactgccatcggtggaacgtgagttgagaaagacgattttgactttaaactaacgttcactaaaagttcaggttaaactggtgttgaactcgatatgagaaattggcccttagcgtccaaacctccattccatataataacacagaaaatacataacaccgcagtattcatactttgagttgcagattcaaatcattgctgcaaagtacttttcttgcgttattatattttactacaatactaatattttgagatgttctctctgtcaactgaaccttgtttgttattacttctccggacaatttcctttttagacactcccaggcattttcgatggtgttcatgtctgataaattgctgggccatggtaacggaggaattccttgccctatcaaatgcataagcatttgatatggtaagaaattaagatcattaccatgattggaaccagtcttgtcttttttccatttactccttatatctccatgagtgactcttccgtgttttagagccaaattcgttgccctcttggg

SEQ ID NO: 6766 - DNA, 641 bp, Diabrotica virgifera
cagattatcgataacaacaatacctacttttttattctattagtcttttgagtattggcttagtgtactttagcttgtaattgaaaatgcaggatgaaaatctatactgtaacatggaaatttattcccgaaacggagaagaaagtgccataactcaacaacccacaaacaatgacgattatcctggtttccggagacccataccagtttccattattgacgaagactacagaagaactattgctcccacaagtggtctaggtttcctccttgatgtcaacgagttgatccatacaacaaactattgaacttgtacatttaatttccaatgtttcttcagaaaacaggtatacagtaaaagtaccccagaggtgatcccatatattacgcgacagaacgttcagcaaaattgttccagaacgtgttctggatcttgcagggcatttagcatgatattgtatgacaaaactcaacacgaagctctttatacttgaaccgaccattggcatgcggaaactgccccattttgttgctatcttcagaacacggaacgtgggattcccccctggaaaattactatcgtcacataccccaaaaacatgcactttaactattgaaagcttttttttattgtatataat

SEQ ID NO: 6767 - DNA, 204 bp, Diabrotica virgifera
  misc_feature (7)..(44): n is a, c, g, or t
  misc_feature (65)..(65): n is a, c, g, or t
  misc_feature (80)..(102): n is a, c, g, or t
  misc_feature (110)..(131): n is a, c, g, or t
  misc_feature (160)..(187): n is a, c, g, or t
taacagnnnnnnnnnnnnnnnnnnnnnnnnnnnnnnnnnnnnnntgcgacctcgatgttggattnaagtttataattggnnnnnnnnnnnnnnnnnnnnnnntggtcgannnnnnnnnnnnnnnnnnnnnngagttaaccgggggggagccagttggttnnnnnnnnnnnnnnnnnnnnnnnnnnnngtccgaaaggacccaaa

SEQ ID NO: 6768 - DNA, 289 bp, Diabrotica virgifera
  misc_feature (2)..(15): n is a, c, g, or t
  misc_feature (17)..(33): n is a, c, g, or t
  misc_feature (38)..(74): n is a, c, g, or t
  misc_feature (76)..(91): n is a, c, g, or t
  misc_feature (116)..(138): n is a, c, g, or t
  misc_feature (140)..(154): n is a, c, g, or t
  misc_feature (231)..(262): n is a, c, g, or t
cnnnnnnnnnnnnnncnnnnnnnnnnnnnnnnntaatnnnnnnnnnnnnnnnnnnnnnnnnnnnnnnnnnnnnncnnnnnnnnnnnnnnnnattaaattataaagactcgcctgcnnnnnnnnnnnnnnnnnnnnnnntnnnnnnnnnnnnnnncgctaacgtcagcataaccattatctttcttattcgaaactgccatgaaaggttgggatgacacaaaaaactgcccnnnnnnnnnnnnnnnnnnnnnnnnnnnnnnnnctacttaaaaagctttaattttttttt

SEQ ID NO: 6769 - DNA, 224 bp, Diabrotica virgifera
gtcccgggacgcgccacgcgttcggccgctcttattttttttatatgttataatctgttaccgctcacggtgtgtatataccggatagcaataataactactgtctcgtgtcgggagaccttgtgaggtgaggcttagtctcaaggatcgtaatgaccgaagaaggttcggtgtgaaaacttcttatcagctcctctagcgctggaataagcggttgcaagggg

SEQ ID NO: 6770 - DNA, 110 bp, Diabrotica virgifera
ctacattccattaagcagaacgatatgacagatacctccagtttttaaaactcaactacgatttaattacttttttgcgtggtagatattaagcgagaaaagtacctact

SEQ ID NO: 6771 - DNA, 1101 bp, Diabrotica virgifera
  misc_feature (88)..(105): n is a, c, g, or t
  misc_feature (785)..(802): n is a, c, g, or t
cgctgaaagttgattttcttttgtaaagaaatcttttgtgctgcgaggattttttgcccatttgacgaatcgataaaggagtattgannnnnnnnnnnnnnnnnnggcataagggttgctggtgccctaaggctattatgacctaaacatgtaatgttagtaggtcattgtccgtaattttctcttttatgtcacttgaaagtttcttatttttcacgataagaaacaaaagaaagcctaacggcaaggtggaaaaaggaaattttcaccttaaataaattgaggaaaattcgatttttagaaaattaaatcaggtgttgtgaaaacaacagttaaaattaattcgcatttttatgaatctctcttgtaaatctgttgggacaatctgtattgtgtttgaaagatttaattctctgaaaacttgagtgttagtgttgtgttaggacacaaaagataacggacatatggtcgctgctttggcgtcttcggtggtcgcaagggtataaacgtgtgtggatgccatggattacgctcttgttaagtgacattcagtcccttaaaacaaaatattgcagttttagaataaaaactgggtagtccctcgccagcctctctacggcgaaatgtgtgctcctcttttcgtcgtgaaaatacgttacgctctcaaaataattacccctctcgctaattggcaacacggaaatttgtataatagactctttctctctttttcgctactaagacaatcaatcgttaagccgcttattttgtcaaatcgtttgtgnnnnnnnnnnnnnnnnnncgccttttaccttttattttctcgtggggcccaaccccttatattcctgttaattaagacttataaaaaacccgacccaaataaatttctccaaacccttccccccaaaaattccctaatttggttaaaatcgaaagaacctatttcttttggaacaaattcgtgggggcccaaaaaatttccccattgtccacattggggcaaaaggaataatttaaaccccttcttccccctgttggggggggaattcttaaaaaccccccaccccccccgtcttaaaatcttttaaatttcccccc

SEQ ID NO: 6772 - DNA, 647 bp, Diabrotica virgifera
  misc_feature (244)..(261): n is a, c, g, or t
  misc_feature (283)..(306): n is a, c, g, or t
  misc_feature (308)..(324): n is a, c, g, or t
  misc_feature (332)..(350): n is a, c, g, or t
  misc_feature (489)..(507): n is a, c, g, or t
ctcatattaaaattttcagtttttaccgttaactcggcaagctggtagatttactgtgagtaacttaatggatttatggtttgagccatattctactcagaaatttttcaaacgtaataccataaagtcatcattttataataactaccaaaataaaatgtctcaagaaaataattttagatactcgtatcgttatgttaatattctaaagatctttaggtgctttaatgttagacaatcacgnnnnnnnnnnnnnnnnnnacctacttaaaataatctaacnnnnnnnnnnnnnnnnnnnnnnnncnnnnnnnnnnnnnnnnnccaggttnnnnnnnnnnnnnnnnnnnaagtaagcgatagatgagtacattatcggttttgtttaattttttaggattgattatatattctgactttttaaaggctgttggtattgtgataaatattctaccaatatattagtttaatatttgtttagttccgtcnnnnnnnnnnnnnnnnnnncgattatgttagtctaataagtattgtttagtttaaattatgaattttgtgatataatctttgtttaatcaaattaaaaagtttccttaaaaaactgtaaatttgttaaattcagtttactgcaataaattatttttcgg

SEQ ID NO: 6773 - DNA, 173 bp, Diabrotica virgifera
  misc_feature (2)..(80): n is a, c, g, or t
  misc_feature (90)..(161): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnncgagaaagannnnnnnnnnnnnnnnnnnnnnnnnnnnnnnnnnnnnnnnnnnnnnnnnnnnnnnnnnnnnnnnnnnnnnnngaattggggggg

SEQ ID NO: 6774 - DNA, 832 bp, Diabrotica virgifera
ttttcgtccgcgagaaacgaacacggagaagcacgccaaagggtttctttggaaattgccgaaataccctacttcattagaagaccagaaatcgattactcaatgctaagaggtaaatccaaattcgaagctagaatcatcggtgtaccatatcctgaaattaaatggtacaaagactggaaacctttggcaccatcaagcaggattaagattgcattcatcgaacctgatataacagtattaacaatccacgacatcattctgaaagatgaaggcttgtactcagtgagcgcccgcaatgtcgcagggtctacgtccgctagtgcgatgttgtatgttgaagagaacgaacaagattacaagatgagaaactactccaacatatcgccaatcaaaactaagaaacgtatttacaccgacttctacgatattggtgatgaattgggacgtggtactcaaggaattacatcacatgctgttgagagactaaatggtcgcaattatgctgctaaagtaatgtacggaagtggcgatttcagaccattcatgtacaatgaactagacatgctcaatgagctgcgtcataagaagttgatctcgttgcacgaagcatacgaaaccgaagattcattggcactcatcttagaattagcttccggaggagaattggttagagattatctcttgaagatggattattacacagaaagcgatattgctggattcatcagacagctgcttcagggcctggactacatgcacgatagaggctacgcacatatgggccttgacttgggagatctccttatttcccatccggcggggacgatct

SEQ ID NO: 6775 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6776 - DNA, 620 bp, Diabrotica virgifera
  misc_feature (2)..(421): n is a, c, g, or t
  misc_feature (428)..(465): n is a, c, g, or t
  misc_feature (485)..(498): n is a, c, g, or t
  misc_feature (501)..(523): n is a, c, g, or t
  misc_feature (531)..(553): n is a, c, g, or t
  misc_feature (583)..(614): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6777 - DNA, 469 bp, Diabrotica virgifera
  misc_feature (161)..(188): n is a, c, g, or t
  misc_feature (214)..(261): n is a, c, g, or t
  misc_feature (371)..(390): n is a, c, g, or t
agttccgcattagagatcctaatactgtaatacatgtaactcacctctcacgaaatatcattatttgtaattttctataaattttttattcaaatataaattcaaattatctagatttagcaaagatgctaatattagtattaaacaatgtgtatacttannnnnnnnnnnnnnnnnnnnnnnnnnnnctcagcaacattcttttcacctgtcnnnnnnnnnnnnnnnnnnnnnnnnnnnnnnnnnnnnnnnnnnnnnnnngctgaataaatttgaatggggccgcggccattttgaccgcggcaaagggtgcaaaatcaattacgtttttttatctgaaagctggtaaaggaaaggcttgcattgaaaannnnnnnnnnnnnnnnnnnntcaatctattaaggaatttttattcttcaaggtaaaaaacgcttcacattttttttaaaatgaccgagaaaaaccacat

SEQ ID NO: 6778 - DNA, 1188 bp, Diabrotica virgifera
  misc_feature (960)..(985): n is a, c, g, or t
  misc_feature (987)..(1025): n is a, c, g, or t
  misc_feature (1059)..(1087): n is a, c, g, or t
  misc_feature (1112)..(1143): n is a, c, g, or t
  misc_feature (1148)..(1183): n is a, c, g, or t
ttttcgtccgaggttagcgataatagtgtcgaatatattgttattgtttactcctgtttatttctctttaataacaaaaaatatttcaactgaagatcgtggaacattggtagcagttgttgttatgtacaggcatggggacagagcgccccttatttcatttccacgtgacgaatattacaatttgacatactggcccatgggttttggacaactgacaaagtatggtgttacaagactttacaatcttggcaaatggtttcgtgaacggtacaagaatttcctcagtgaaacgtactctccaaacgagatttacattcattcttccaacatagaccggtgtttgatgtcggcaagtgcagctctggcaggtctttatccaccaacaggttttcaattttggaatcctcagttatcttggcaaccgattcctgttcacactgacaacaaaaatcacgatgagatcattactgaaaggcgaaaatgcaaaaagtacgaagatattgttctaactctccaggaagcaacatatccgtcttacgaacgtaattatacagaactcttccaatttgtttctaataaaacagggtggacagtctcactttatgaaataaagacactttatagcgttttaaattcttacaattcctacaatagctcgtttgttcccaaatggattgaaaacataaatttagatattgtcgaaacattagcagctgttgtttacggattacctagttccactatcgaactagccagacttcgcattggtcctttctacaaatacatgtttgacctatttgatactttcgtcaactcatcttcatccaacatgccaaaatttatttatgatatcggcacacgacacaacagtgtgttctgcgttaagagcaatgagagcattcaggaaacccagtgaaattccgagacactttaaattttggaaattcagaaaatacnnnnnnnnnnnnnnnnnnnnnnnnnngnnnnnnnnnnnnnnnnnnnnnnnnnnnnnnnnnnnnnnnatgggaaattaacttgggggttttggcctggggnnnnnnnnnnnnnnnnnnnnnnnnnnnnnttatcccgagctatcaccagcaaannnnnnnnnnnnnnnnnnnnnnnnnnnnnnnnggtannnnnnnnnnnnnnnnnnnnnnnnnnnnnnnnnnnnaacac

SEQ ID NO: 6779 - DNA, 237 bp, Diabrotica virgifera
ggcttcttacgatcggagatcggtccattggagctatggacggtgaagctaatatgatcagagaagtctatgagaaaggtatgcatcctgccgaattcgataaccacttaacgagccttgcccagctcatcgtggatattggtcgcagagccaaaactatcctcaacgccgaacagagaataaaaatagaaaaacagatgctaatggataacttccccgccactcccttacttcagt

SEQ ID NO: 6780 - DNA, 1011 bp, Diabrotica virgifera
  misc_feature (98)..(120): n is a, c, g, or t
  misc_feature (236)..(258): n is a, c, g, or t
  misc_feature (982)..(1001): n is a, c, g, or t
aacttaattaaaattttttctacgagcaaaattaagaaagcccggatctttaaatgaaaatgaccaaatttataatgatattgttacaagctcatgcnnnnnnnnnnnnnnnnnnnnnnnttatacctattataattggtggttttgaaaattgacttgtacccttaataattggtgctcccgatatagcattccctcgaataaataatatacgattctgattgcttcccccgacnnnnnnnnnnnnnnnnnnnnnnntgatagtataaaggggggatggaaccggatgaacagcttacccgcctctgtcatcaaatattgcccatggaggtccatcattagatttaactatttttagattacatttagctggtatttcttccattttaggtgcaattaattttattacaacagtaattaatatacgaccaataggaataacctttgatcgaatacccctatttgtttgagctggcgtaattacagcaatccttcttctattatctttaccagatttagctggagctattacaatattattaacagatcgaaatttagatacatctttttttgatcccccctggtggaggcgatcccaattctcctatcaacattaattttgatctttagctcatcctgaagtatatattttaattctaccaggcttcggattaatttctcatttttgttagggcaagagagaaaaataaaacaaaacctttttgggtactttaggaattattttactgcttataataaccatttggctttattactgttttattggtttccgcctcctccttatattttaccctttggaattgcatgtttcaaacccgatgcttcttttacccccagcacctataatttattgctggtcccacttggaaatcaaactcattttcattgctttgctactttatttaggggaactcctatttaccttatatgcccagaaaaacctctgtgaaatttttagggnnnnnnnnnnnnnnnnnnnnctccttgtaa

SEQ ID NO: 6781 - DNA, 1205 bp, Diabrotica virgifera
  misc_feature (79)..(92): n is a, c, g, or t
  misc_feature (95)..(143): n is a, c, g, or t
  misc_feature (152)..(174): n is a, c, g, or t
  misc_feature (363)..(375): n is a, c, g, or t
  misc_feature (377)..(389): n is a, c, g, or t
  misc_feature (432)..(449): n is a, c, g, or t
  misc_feature (633)..(667): n is a, c, g, or t
  misc_feature (670)..(685): n is a, c, g, or t
  misc_feature (739)..(780): n is a, c, g, or t
  misc_feature (812)..(837): n is a, c, g, or t
  misc_feature (895)..(920): n is a, c, g, or t
  misc_feature (936)..(956): n is a, c, g, or t
  misc_feature (975)..(1004): n is a, c, g, or t
  misc_feature (1099)..(1141): n is a, c, g, or t
  misc_feature (1167)..(1184): n is a, c, g, or t
ggactattaatggatgaaaattattgggtatgtaatttagcatgttaacaattacaaaaaacaagagttacccgatttnnnnnnnnnnnnnntannnnnnnnnnnnnnnnnnnnnnnnnnnnnnnnnnnnnnnnnnnnnnnnncgatccgannnnnnnnnnnnnnnnnnnnnnngtaattttctcttaggttaatagtttccgagttataaacaattattaaatctaaaaaagaacacaagataacgattcttagggctcaaaaacataagtaaaacatgtcatttttgaaattacgtagtacctaaattttcaaacattattctatcagtccttgataagtattttggacgtatgtatttcnnnnnnnnnnnnngnnnnnnnnnnnnnaattcagagcgatcgccgatcttcccacaaggagctttgctcnnnnnnnnnnnnnnnnnngtagtttacaataaaatctagcataaattcttatcaaggcctgatagaataaggtgagcttgaatttaggtacttgatgattacaaaaataaagattcttcacttgtggccttgacccttgaaaatccgcatctttcgttattttttcagttttaaatttgttataactcgaaaacgaccaacnnnnnnnnnnnnnnnnnnnnnnnnnnnnnnnnnnncannnnnnnnnnnnnnnntaatatctgcccggggagaaattttggttttatgtataaaaaatacaatatacnnnnnnnnnnnnnnnnnnnnnnnnnnnnnnnnnnnnnnnnnngtcagaaaaaaattagatcgggccccaattgnnnnnnnnnnnnnnnnnnnnnnnnnncatttaacaaatcggggaaaaccgaccttttatcgaattcttcccctaagaaaacccnnnnnnnnnnnnnnnnnnnnnnnnnnctattttctttcggcnnnnnnnnnnnnnnnnnnnnnggttgggcctttttatccnnnnnnnnnnnnnnnnnnnnnnnnnnnnnnccaataaaaaaaccccaacaggttttctgttttcacagacaaaaaaaggaaaaggaaaggagaaaaaagattttgatattggggtgaaccccccnnnnnnnnnnnnnnnnnnnnnnnnnnnnnnnnnnnnnnnnnnnatccttttttttatattctttctctnnnnnnnnnnnnnnnnnnaaaaaaacaccctccaaacac

SEQ ID NO: 6782 - DNA, 881 bp, Diabrotica virgifera
  misc_feature (72)..(91): n is a, c, g, or t
  misc_feature (271)..(292): n is a, c, g, or t
  misc_feature (797)..(823): n is a, c, g, or t
  misc_feature (836)..(871): n is a, c, g, or t
cagggacaaaggggttttcgattttgtaggggaaaggcgggcaaaacggggtagctgcctaaaacggggtannnnnnnnnnnnnnnnnnnncactcgctcgatctatacgatgttaatgaaattatattatagacgcctgtttacgccttctgtcataaagcagatataattaactgttagtcgattgttgtaaacaatacatgtgcgtttttagttaaccaagttataatatcggccgaaaaataatccatcgttattataactaaaacnnnnnnnnnnnnnnnnnnnnnncttccaactaacagtgaatgtgttctagagtatttgtttgtcattatgttaaaaaataaaaacttgtaataatttaaacaggtcataatcccaaaatctgctctttgggcaaaacggggtaccaataggtggggtaaaatggggtaccctttttaccgtgcctattggtagtcttaaccctttttaccataccaagtaagatagccgatgatcaaaccaaatcacagacgagtaagaaatcgcaattgaataaaactaaaaaagtagagtcagattcagaaggcgaagatagtgacactgactggctctgcggaaacttttatttaagttccacagaaggatggataagctgatccagttgctttaaatgaactaaaaattaatgtgcaggtgtagaagatgaggatgacgaatcagtacttgtatgcgaattttgtcaataactttttcttggttttaatttggtaccccattttaccctatatgacgggcataatggggtacnnnnnnnnnnnnnnnnnnnnnnnnnnngataagaaaatcnnnnnnnnnnnnnnnnnnnnnnnnnnnnnnnnnnnngttactactg

SEQ ID NO: 6783 - DNA, 1019 bp, Diabrotica virgifera
  misc_feature (588)..(605): n is a, c, g, or t
  misc_feature (955)..(977): n is a, c, g, or t
  misc_feature (983)..(1005): n is a, c, g, or t
ccctgcgtccggagattttttaaatggagcgcgccgcgcctgcattgaaatcggataaacgcgcatgtttggcaattgaaaagcagcggtgtggattcaagttggacgcgatcactcttcagagtctggaagctgaatgtttggtcttcaatttgagtatctggcagcctcaaaaatgctggtttgaatatgagtttttaggtctcgaaaatgcgtgttttcgcatttttcagattttgagtcgcctgtagctcgaaagctgtcaatttttgagaaagtttgcaagatgcctttcttgttcggagtcaccgacaggactcggaaatgtatgttccggaggaaagaaacgtgatcttttgtatttgttggaaggattgtttaaacaatttctgcccaaaaattctgcccggcatccttcagatttcttccagcacgtcgcactctttttcaacgacatggggaacctttttttacgaatgaccctcgtaatttgtacaatttctagttaaaccgtgcatggaaattttcatatatttgaaaatatacattccagccatatttttcacaaaaatatttaggaataagagnnnnnnnnnnnnnnnnnngaactctggaggtgtcaacatacagtttgatagttactatagctagtgcatattcgctgatagatttgcttaaagttgatgttaagaatgatacagtacttaaatatttctgtgtggtatatgtatttgtttcgcaagaactaatatataaaacagaataaatttttcagcactgatagaaaacaaagccctttattggctgaaggaaacctgtgacctcagtgttatctaagaaggtttgtaaccatagtatgcctattgcaattttgagaaaccattatgtggcataaaaataaaaaaacgcattttagccaggggaaactaatttttaataaattacaaaacagaannnnnnnnnnnnnnnnnnnnnnncaaaannnnnnnnnnnnnnnnnnnnnnntttacacttttttt

SEQ ID NO: 6784 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnncaaagg

SEQ ID NO: 6785 - DNA, 842 bp, Diabrotica virgifera
  misc_feature (350)..(383): n is a, c, g, or t
  misc_feature (550)..(569): n is a, c, g, or t
  misc_feature (701)..(718): n is a, c, g, or t
agttgccgccccccattttttgattcacagcagctttctttgtaacaattacgaagtcgaatcggtcacattggggagagcatacctcagagttttgatgtgccaggtgtgaaaagtatgtactttcaaacaaatcgtccatagagcttcagagtgtgacccttaaggtcggccggcctcggaacttgggaggtcgatgagaggggggaattaaatgttagctgtatctcttgttctcgcctatgagtttcgacgtttctttttttaatttgtatgtgctttttgcgtacagtgcgagtatgcgttgtttaaataaattagttgttgtatgcaccatcaaatttgtttgnnnnnnnnnnnnnnnnnnnnnnnnnnnnnnnnnngaagtaatcttaatcacaaaacatacatatttatgaataatataataatacatagttttttattaaacttagtaataatttaaagtatgaaaaaacaaattatcccattcgatggtttctaaaaatagtattggtctatggaaatcagaaaatctcaaataaactannnnnnnnnnnnnnnnnnnncatgctattaaatgaatgaaaaactgaagttacagaaccaccaaaaaagagataaacgtaattgattggggttggaaattaagctaagaaccgttagtgccgatctgatcaacagatcttctttatatcagnnnnnnnnnnnnnnnnnnctatctgctcttgcaaaactggttgcaccgagtacttgttagtacagagatataaatagtttatggacttcgattatgaaaaccttagtctttctctattatctatgttggagtttcttttttt

SEQ ID NO: 6786 - DNA, 459 bp, Diabrotica virgifera
cagtgggacttaatatggtgacgaaagcattgttgcaactcacatttggtcaagcattaggattattaaaagacctctggagttacgctatttgtattcacactttgaatgttataacgattgtcgtaatcgtatcatggtccttcgaaatattcatcactgggttacgaacgaagaacacggaagaagaggacaccaaaccaacggaagtcaacagctaatgtgactaatggacttcttaattattattagtgacttctgtgattacatatacagggaggtttaaaagacactctacgataagaagaaaaacttatattttttacctctatgttggttagtagttttttggtggacgatctaattcgacagtctttagtcagttcttgttaattgtaaaatgtttgttatagtggagctcgaactgtataagaatgatattaaacgtatttttctttt

SEQ ID NO: 6787 - DNA, 226 bp, Diabrotica virgifera
  misc_feature (123)..(143): n is a, c, g, or t
  misc_feature (183)..(215): n is a, c, g, or t
ccttaggggataacagcggcattttatttggagaggtcaaatccataataaaaattgcgacctccatgttggattaaagtttaaatttggggtagcaactatattttttaatcctgttccacnnnnnnnnnnnnnnnnnnnnnctggaggttaaaacccggggtggggccacgtgtgggttcnnnnnnnnnnnnnnnnnnnnnnnnnnnnnnnnnccaaaagggac

SEQ ID NO: 6788 - DNA, 320 bp, Diabrotica virgifera
cacatctgcgttaaagcatacctgacacccttgatgagacttttgttaaacgtaagcactttccacccgaccgaacataaagcttcacagcgagaccctaaacgtcggccgcactcgtaacttggaacgacaacagagaggcctcatccgggcgatagcgtacatcacagccggccccctatgatcaactaccaacctaatccgacatagaacgacgttgttggaggcccagacgactatgccgtgtgccgatgacaccactcggagcagtcactactaacggttgtgagaacccgctccttcccagcttttcttcgccc

SEQ ID NO: 6789 - DNA, 765 bp, Diabrotica virgifera
  misc_feature (78)..(106): n is a, c, g, or t
  misc_feature (727)..(746): n is a, c, g, or t
agcttcaacagttccttgcctgtgatcttctactacctgaatccgtcagcagcctcccaagtacggacagtgctggannnnnnnnnnnnnnnnnnnnnnnnnnnnnatccgttgtccctagaagacgaggttcatcgtcgattgaccttattaccggacgatctttcggaagagaataagaacgcgtttcaaacgatctacagccagcctgctagtatttttgaggagttaaacatcaaggaggccaatgacattttgattaagacttgtcccaaggatgtggcccgaccaactcccggttttggcgctttcgccgagataaaacagttgttgacatatccaccagagggccgttaccgcctaaccatcaacacggaagactacatgtgcttggctcaagaccagtttctcaacgatgtgataatagatttctacctaacctatctcgtggacaacctaccgccagaacaaaagtcgaagatccacgtcttctccaccttcttctataaacgactgaccaccaaacccacaaaagcctctaggaaatctcagccaagtgaactagatccgaccttatcaccggcacaaaaacgccacgctagagtcaagaaatggagcaaaaacgtccatatattcgagaaagatttcgtaataattccccttaacgagaacggccatttgggttttgggtattatatgctttccgggaatggcggggttgcctacnnnnnnnnnnnnnnnnnnnnaaatccaagtttttttagg

SEQ ID NO: 6790 - DNA, 956 bp, Diabrotica virgifera
  misc_feature (228)..(263): n is a, c, g, or t
  misc_feature (629)..(652): n is a, c, g, or t
  misc_feature (848)..(868): n is a, c, g, or t
gattatcgccatttattcacgtgttgaatttataaatttgtaataataataataaaatgactaaatacataaagggtaactggaaaccagtggctatagattcaaatgtattttcaggggatatgactgatttgataggaatagaggaatgtacagactatgatttaaatgaattttcttcaaagaagccccaaaaaagaaatttacccaatgaagaaaatatacctnnnnnnnnnnnnnnnnnnnnnnnnnnnnnnnnnnnnaaacagcacatagaaatagaccattttaccccatctaagtcaggaaatacctcaggcatagaagatgaagctgaaagtaccaaaaatgatttagatgtcacagcttggaattcttttggtttacctgaatcaatattaaaagccctagcagagttggggtactctaatcctactcaaatccaagagttaactttgccctcagcaatattaggaaaaagggatattctgggagcagctgagacaggtagtggaaaaactttggcgtttggattaccaatattaacaggaattttgaaagtgaaaaaaaacattctgtgatggaagatgaaaaagagatgagtccaaattctgatgaatctgactttnnnnnnnnnnnnnnnnnnnnnnnntggatgggtaaaattgatcaaatgaagcccatatgaaaaaaaacttcccaagtttaaacccctaatttgcttcttgtattaaaaccaaacccagaaaactaaccaactcaacgtaaaaaaacccttttaaaacctgtggaaaaaataaaccagaagtaaaccgttgccaaaaaaattgggggggaaagggcccccnnnnnnnnnnnnnnnnnnnnnctttcaaaaaaggacctaaaaaaaattgtttgaaactcccgggccaattgtggggaataaatctcacaacgaaaaaccccctactttt

SEQ ID NO: 6791 - DNA, 799 bp, Diabrotica virgifera
acttccaaagaaatggtgctcactttcgtcaattcattggtgccaaccgttcggaaagccctctgtgatccgttgcccgaagttagacaagccgcggctaagacgtttgacagtttgcacttcactgtcggcgcccgagcgttggatgatattctacctacgttattgaatcaattgaatgatgaaaatccagaggttgtagaatggaccctcgacggtttaaggcaagtgatggcaattaaatcgcgcgtagtactgccttatttagtacctcagttaacagctccccctgccaataccaaagccttgtcaattctagcttcagtagcaggcgaggccttgaacaaatacctcccaaggatcttaccggcccttcaaacgactctgggttcttcacgaggtactccagaagaagcacagcaaatggaatactgccaagctgtcgttctctctgtagtcgatgaagtaggaattcgaactgtaatagataccctcttagaaaacactaggaacgaaaacgctgatcagagaagagcggcagccaccttgctctgcggattttgtgccaactccaaagcgcaatacaccagccacgttccgcagttgctcagaggactcataacatctctgtatcgactcagatcgggaagttttgcagatgtcttgggaagttctgaatgctggtactaagactctagaaacaaaacaacaagccacataactctccaaacgccgacaatcccggccctaccccctgtcccgacatgaagggcacctccaaacctggtgccaggttttc

SEQ ID NO: 6792 - DNA, 875 bp, Diabrotica virgifera
cttattggatctgctgttataaccatgcattttgtcttttgtggggaaattaacatgttaaattttctggcgattatgttgaattggtgcagcatatgttgtaaatcatcttcactttgagagattagtattgcatcatccgcatagcaggttattttaagttgtttttctcccttttggtatccatttttagttcttacttttttttaacaaaaatgttactaatataaatatcaaaatatagataatccatagatgaagacgtatatttttgtacaaattcaaatcctaaaaatgatctgtggaaatcaatggcacttgattgtaacatttccagattggttttttatggcaaatcaacttattgccattgttgttaaaagattcttttaatatttgttaaacagctaaatcttctacattaatatgacacaatttctaaatttagataattaatattacataatgaacttaacccattcgctgccaatcaatcgccagcgcgtgatgtggttacttcagtcaggtgccgttcacgcgccgtagagtgatatggttactgcagtcaggtgctgttcaacagaatggctcctagctgacttctagtgtcttgataggcagcgaatgggttaagaagaaccaaatacatttgattttctgaatgtcatagatctttttatagattatgcatagtgccctttctggatccccctttttgtcttttttctatgagttttactcctataggatcgtattaatttggttttattatgtgcctaagaatttgtcatcaagtttgcaacttctatagtgactctcaaaaatcataaaataatgccatttaatgtttggcatgggaaaaaaacccaaatttt

SEQ ID NO: 6793 - DNA, 1188 bp, Diabrotica virgifera
  misc_feature (16)..(16): n is a, c, g, or t
  misc_feature (19)..(19): n is a, c, g, or t
  misc_feature (24)..(24): n is a, c, g, or t
  misc_feature (29)..(32): n is a, c, g, or t
  misc_feature (37)..(37): n is a, c, g, or t
  misc_feature (59)..(59): n is a, c, g, or t
  misc_feature (68)..(68): n is a, c, g, or t
  misc_feature (109)..(109): n is a, c, g, or t
  misc_feature (111)..(111): n is a, c, g, or t
  misc_feature (143)..(143): n is a, c, g, or t
  misc_feature (213)..(213): n is a, c, g, or t
  misc_feature (222)..(222): n is a, c, g, or t
  misc_feature (246)..(246): n is a, c, g, or t
  misc_feature (249)..(249): n is a, c, g, or t
  misc_feature (256)..(256): n is a, c, g, or t
  misc_feature (258)..(258): n is a, c, g, or t
  misc_feature (261)..(262): n is a, c, g, or t
  misc_feature (275)..(275): n is a, c, g, or t
  misc_feature (279)..(279): n is a, c, g, or t
  misc_feature (281)..(281): n is a, c, g, or t
  misc_feature (296)..(296): n is a, c, g, or t
  misc_feature (300)..(300): n is a, c, g, or t
  misc_feature (329)..(329): n is a, c, g, or t
  misc_feature (333)..(334): n is a, c, g, or t
  misc_feature (352)..(352): n is a, c, g, or t
  misc_feature (359)..(359): n is a, c, g, or t
  misc_feature (382)..(382): n is a, c, g, or t
  misc_feature (390)..(390): n is a, c, g, or t
  misc_feature (464)..(491): n is a, c, g, or t
  misc_feature (528)..(528): n is a, c, g, or t
  misc_feature (548)..(568): n is a, c, g, or t
  misc_feature (613)..(634): n is a, c, g, or t
  misc_feature (719)..(738): n is a, c, g, or t
  misc_feature (822)..(840): n is a, c, g, or t
  misc_feature (891)..(931): n is a, c, g, or t
  misc_feature (965)..(1019): n is a, c, g, or t
  misc_feature (1097)..(1124): n is a, c, g, or t
  misc_feature (1163)..(1187): n is a, c, g, or t
ccccctcacggggganagnttatnaagannnnagaanaaggggactctaccgggcccgncacagccgnaacagcccaaagagacccaaaaaccgggcaagcagaaccancnaaagctcttattttaacgaccaagggcaaacncgagcccaaaaacggcgcgagcgccacaaaacaaggaccagccaacggcaacggcaagaagaccgccagncgcgaaccnaaaaccggcaaagcagaagaacanccnacacagncnganncaaacgacaaaancacngnaccgagcggcgccancganccaagaacaggcgccagagacaacaaccngagnncaaacccgcaaaaagacncagaaancgaaccagacaccgccgccaccncccaagcnggaaaaaccgacaaaaaagggcccgacccccaaaacggaaccgccccaaaaaaacgaacgggaaggacgaaccnnnnnnnnnnnnnnnnnnnnnnnnnnnngggaggaaaaaaaccaaaacccgaaaaccccaacccngaaagaacccaaaaccgggnnnnnnnnnnnnnnnnnnnnnggaccacaaaaaccccccgggaaaaaccggggaaaaggaccgggnnnnnnnnnnnnnnnnnnnnnncgaccaaggacaaggggaaaaggaataaaactggaaactaaagggaaccaaaaggaaaaccctcctggaacaagaaaccccccgnnnnnnnnnnnnnnnnnnnncgacccgagacttctcggaaaaaaaaccaaaacccgggggccccaccgggaagggggaaggtattaaaaaaataacggggaccnnnnnnnnnnnnnnnnnnncccccccccacaaaaatctgaaaaagggcagggtgggaccggcccacacgnnnnnnnnnnnnnnnnnnnnnnnnnnnnnnnnnnnnnnnnntggaaaaacactcccccaaaaaaccaccgaaatnnnnnnnnnnnnnnnnnnnnnnnnnnnnnnnnnnnnnnnnnnnnnnnnnnnnnnncaaaagttcccacccacccgggcaaaactaaacaattttgtggggaggggaccccggacttgtgcccccccacaaacnnnnnnnnnnnnnnnnnnnnnnnnnnnngagcgccagaaaaattgggtttttggtttccttaaaatnnnnnnnnnnnnnnnnnnnnnnnnnc

SEQ ID NO: 6794 - DNA, 672 bp, Diabrotica virgifera
  misc_feature (121)..(142): n is a, c, g, or t
  misc_feature (282)..(330): n is a, c, g, or t
  misc_feature (493)..(511): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaaatcatctaaatactttaattccagttggtacagcaataattatagttgctgaaggaaaataagctcgggtatcaacatccattccaactgtaaatatatgatg

SEQ ID NO: 6795 - DNA, 204 bp, Diabrotica virgifera
cccttttaaggccgattttcaactaatcataacgatatcggacccccttaaaatattctggcagctggcccagctgaggcagaccccgcattacgaccatatcatcaaagtaccattgtcacagaccggatcttcactgggctaactgcatataatgaaagaaagtgatacacctcgagcccttattataaactttgttgtaat

SEQ ID NO: 6796 - DNA, 785 bp, Diabrotica virgifera
  misc_feature (184)..(207): n is a, c, g, or t
cccctttaaagtccgacttcatgaaaaattccatagctaaggatccccccccccgttctacaagctttaaagagcttatcagaaatcaagttaaggaaatcgccacagaaacaagaaactaccctggtctaccgaaaagtttggtgtttcaaccggagcttttacagagcttgttcggacacgnnnnnnnnnnnnnnnnnnnnnnnnagaacgttcttgaggcttttagatgaagcaattggaggctggccaatcatcaaaatgcatacatggaatgaacgagagtttacttggcaaggagctactcttaaagctaggaaacttggactctacaatgtatttttcttctcaattcagatctacgataattacacaagagacggaagaatgttgtggttaaaaccattttatgccacccaaatcagttcatttaacttaaaacgatagagtcattgaccatatacacgacattcttaaagaacttgggagctaccaggggacatataaaaagcaaatttaagggttgcggtacattttgaggaaagatggaaagaaattggtacagaagcataacaaccacctcgtgccttacaacagcgatgacagaaaaaatgtaacatttgcgcgttctccatcaaatttaattcaaattggattggttggctttttttacaaaatacctcggtttttaactttaaaacctactggaccaagaattgtttcgcataaatggataccctgaactacccttactacctgttcctccctaccccaaaagggttcaa

SEQ ID NO: 6797 - DNA, 163 bp, Diabrotica virgifera
  misc_feature (35)..(47): n is a, c, g, or t
  misc_feature (50)..(69): n is a, c, g, or t
tttggggatattttccttttcctggtttttttctnnnnnnnnnnnnnccnnnnnnnnnnnnnnnnnnnngttaaaaaaacattgggggggacacaaggggggataattccaaaacggatactcacaccgggagaaaaaacctttgtaatattttccccccccc

SEQ ID NO: 6798 - DNA, 593 bp, Diabrotica virgifera
cctttgcgtccgcgtgaccctgggcttcaacgtttcgatgttaaccacggcaggaaccatcgccaatacgggaccaccaccaacgtgtctgatgaagatagtcacaccaaccggtgaagagatcaactcagcagaaattggcgataacttaatgcttcaagtcgacgtacaacctggttccatctacggtggatttgccagaagttgtgtagctaagactatggaagacgccgtggagaatgaatatattgtaacggacgagaatgggtgtgctactgatccgagcatcttcggtgaatgggactataatcccgacacgcagagcttgttggccagtttcaatgctttcaagttccctagtagcgataacatcagattccaatgtaatatcagagtgtgcttcggaagatgtcaaccggttaactgtcgtggatataacgcctttggcagacggaaagagatccgtcgaaaactcagaaaatgacaccgatggtacttgttggaggagacctcttatctgggcaactcagagaaaaaatcaccatcccggtctattggaatattgactttcgaaaacggagaggaacgatacc

SEQ ID NO: 6799 - DNA, 57 bp, Diabrotica virgifera
tcccccttatcttcatcgatggacattaacacctaatcaaatcttttcttcattcaa

SEQ ID NO: 6800 - DNA, 604 bp, Diabrotica virgifera
  misc_feature (15)..(46): n is a, c, g, or t
ccccccttgcgcccnnnnnnnnnnnnnnnnnnnnnnnnnnnnnnnncacccgcaaagacaaatgttatttaatgatagctagattagcatggtgagagaatatcttatccttataaaagaacacttcattctctcgaaccttgtgtatcggggatcattaatgcacaattatatatttattactttcgacttccacagagctacaaaagccccctttttatcgtaccatacatatttctcctactttctttgtcctgaagtgtcactcgcttctaagcatacctaactcctcgcgacatctgtgcccgtgatttagcagccatatatctataattacacatcttcatattaccaatatcaaacatttttaggggtgcgctcaacaacacaattttattacaattgcctttccacccccccgcgacgattaagaaattttcatatcctaaaaacggcattatgtattattacacattcctatttttattgtttctaagcttttgcttccctaccccgctgaacttccccccctccaccactgccgacactattaccccccagcacccctgcgtcacgtacctccaacactctccctttgaataaa

SEQ ID NO: 6801 - DNA, 191 bp, Diabrotica virgifera
  misc_feature (83)..(110): n is a, c, g, or t
cggtccccctttatccgatttgaatggccgcggaattttgcccgtgctcccttaccataatcattatattttttattgcaacnnnnnnnnnnnnnnnnnnnnnnnnnnnntcactgctcttctattctacttttatcaaaccaatctatatttcccaagttagaaaagccgtaaaatttcttttaaaacca

SEQ ID NO: 6802 - DNA, 678 bp, Diabrotica virgifera
  misc_feature (66)..(88): n is a, c, g, or t
gacggagtagtcgtgtgttgttattgttaattaatagttaggtgttagctagttttcacagactgnnnnnnnnnnnnnnnnnnnnnnngtaaaatgagccatcatttcccccctttttacttctggatagtggtagcaataatagctttcggtggttttattatttttctgcgcgttgtttttgcctgttgtaaaaatgggagtaatgggactagacgaagattgtatggtccttcagtcacagtcacaacgacaacgcagcatgctcaatcgccacaggtagtcccaccttatcccatagatacacgtcatccggtaccagctagtaatattacgggatatggaaatcaagccccatatcaacaatacccattccacccaacaggtaatgtggcatcacccatggcaggagcaactccatacccgccacagccttaccaacaagccgcacacgactacagcgccaacccacctccatacgacgtggcagtatctcaaccacctcttcaaccaccccccaattcaaaggagggctacgtcaagaagtccccttacaacccagggtataattaagttcttctcatccaaccgttgaatgttttagttgggtcttcttacattttcgttacttaaagaagttggcagaaattttctttgttttatatttaaagtgggttt

SEQ ID NO: 6803 - DNA, 109 bp, Diabrotica virgifera
gtataaatataagtctcgcctgcccctgattatttgaaatgccgcggtattttgccgtgctaaggagcatatcattagttttttattgaagctggaatgagggttgatg

SEQ ID NO: 6804 - DNA, 529 bp, Diabrotica virgifera
tttccttgagttataaaatcattttcctggacctctttcttataataacttaataaagtctaatcaaaaaaaaagggaatgtgactatctgtgttataaataatctcctatatctttcacataagaacgttaactggaaacgaggatataaaagtgcgtggtcataccataactggtaacgactctagccccttcctccaagccaccgaccgacactccattctgcgattagctaaagaatcaaagaaactaccccaattcgctgcacctagttaatgatgcgcaacacctaagaccgatagatggtttcgctccagcttgtaccaggcccctcgatgaaagcgagaccttcaattaacagcacacaatatcaagaagtaccctgcagaccgttctatataatacaaaagccttctaaccactaccgtagaacttagtggcccacttgataacacaaccggtagccggcaccctatatggagcattgctgcccaacaatcgctggccatggcccataactatgccatct

SEQ ID NO: 6805 - DNA, 824 bp, Diabrotica virgifera
  misc_feature (142)..(164): n is a, c, g, or t
  misc_feature (182)..(273): n is a, c, g, or t
  misc_feature (285)..(411): n is a, c, g, or t
  misc_feature (413)..(444): n is a, c, g, or t
  misc_feature (480)..(498): n is a, c, g, or t
  misc_feature (537)..(554): n is a, c, g, or t
  misc_feature (562)..(583): n is a, c, g, or t
  misc_feature (595)..(745): n is a, c, g, or t
  misc_feature (774)..(800): n is a, c, g, or t
ggttaattaaggaaatccggaacattttttttacctggttaattaaaacatggctttttggattaaaataaaagcctcgcccgccccccgaataatttgaaagggccgcgggatttttgaccgggctaaaggaacataatcnnnnnnnnnnnnnnnnnnnnnnnttggaaaagaaggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnntcggggaaaccccggatttttttttgggggtccaannnnnnnnnnnnnnnnnnnccccccgcgggggattaaaattattatttgggggggggnnnnnnnnnnnnnnnnnngttcctcnnnnnnnnnnnnnnnnnnnnnnggggtgtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggggagggatagctattttttgtnnnnnnnnnnnnnnnnnnnnnnnnnnnctttattctttttctttttttttt

SEQ ID NO: 6806 - DNA, 658 bp, Diabrotica virgifera
  misc_feature (36)..(55): n is a, c, g, or t
  misc_feature (299)..(332): n is a, c, g, or t
gatgattttccactaatcatgaagatagttggttcnnnnnnnnnnnnnnnnnnnntctgtggaggaatggtatgaacttcattgccaattttagtacgagcactaattcggaaggcccggatccttggttggaaatgaccaaatttataatgttattggtacagctcatgcatttattataatcctttttataggtatacctatcataattggcggctttggaacttgacttggacccttcctaattggggctcccgatatagcattccctcgaataaataatatcagatgttgattgnnnnnnnnnnnnnnnnnnnnnnnnnnnnnnnnnncgatagaacatcgggtcgttgggaccggatgaacaggttacccgcctctgccatccaatattgcccatggatgtccatcaggagatctccctatttttagattacattgaactggtatatcttcaattttaggagctgttagttgtattacatcagcaattaatatacgcccattacgaataacctgtgatcgaatacccctatttgttcgagctgtcgtaaatacagcaatccttcttctagtatctttacccagtttggctgcagctattacatatattattatgagatcgcaacttgattaccatcattttttgatgcagctg

SEQ ID NO: 6807 - DNA, 1097 bp, Diabrotica virgifera
  misc_feature (39)..(60): n is a, c, g, or t
  misc_feature (148)..(170): n is a, c, g, or t
  misc_feature (475)..(499): n is a, c, g, or t
  misc_feature (803)..(821): n is a, c, g, or t
  misc_feature (945)..(962): n is a, c, g, or t
  misc_feature (1008)..(1029): n is a, c, g, or t
gatttattttactataataaaggatgaggtattagaccnnnnnnnnnnnnnnnnnnnnnnctagtgaatacatttccgggagagaatatgttattcttatagaagaaaaatttgttgtttgaaccttgtgtgtcacggattattaagnnnnnnnnnnnnnnnnnnnnnnnctcggaatttaaaatatctacgaaattaatagtttttgttggaaaacaaatatgtcacgaggtttttttgccgtgctatgtccttcgctttttcatatatctaattttctcgaacataaatctagtttattcactatcaatatattcatacttaaatatttttatatccttatcattagatatttttggggatgagcttagaaatacgattttatttcaattgaatttttcaataataattaggattaaaactgttcgtattttaaactatgctattatttattcttatatattatctatcttcnnnnnnnnnnnnnnnnnnnnnnnnnctatgaattaatcttatttacatttagaaatgatgataaatattagtattacaaattggatgatttactaaagatatataagaattaagtaaaggaattcggcacccttcttttcacctgtttaattcctaacatgtcttttttgtcattcaatatatagtctcggctgcccactgatttgtttgaatgcccgcgggatttttaaccgcgcctattgaactttaatgatttgctttttttattcgaaagatgaaatgaaaggcgtggatgctcacaaaactcggtctttaatttcatttatccnnnnnnnnnnnnnnnnnnnctaaaaacgttaaattttttcacagaacggagaaagaccctctaaacctttctataaaattttttatacggttggttttaggcatacatttttcctttcttcccaaattattttaactcggggnnnnnnnnnnnnnnnnnnaaccttttcttttttttcctcacctaattaaacggttttgggcccnnnnnnnnnnnnnnnnnnnnnngatacccctcggggacaaaagaaaatttctttttggcgccctcaactcccaaaaagattgcccccccc

SEQ ID NO: 6808 - DNA, 318 bp, Diabrotica virgifera
  misc_feature (6)..(86): n is a, c, g, or t
  misc_feature (168)..(191): n is a, c, g, or t
  misc_feature (241)..(268): n is a, c, g, or t
  misc_feature (270)..(284): n is a, c, g, or t
tgtatnnnnnnnnnnnnnnnnnnnnnnnnnnnnnnnnnnnnnnnnnnnnnnnnnnnnnnnnnnnnnnnnnnnnnnnnnnnnnnnnnctattttcaagtcaaacgcttacatttttctaaaagacgacaacaccctatacagctttataaaattattaacaacctttcnnnnnnnnnnnnnnnnnnnnnnnncaaatttatttaactggcgcgattaaaaacctccatccaccttcttccannnnnnnnnnnnnnnnnnnnnnnnnnnncnnnnnnnnnnnnnnntttatcaccacccccctctaccttagggataact

SEQ ID NO: 6809 - DNA, 126 bp, Diabrotica virgifera
cgcaactcaacagttgagctacaatggcggcctgtggttgcactgatccaggatattacggaacttatttggcgaactgttgtggaggaggtagcttcatagcatttatgaggttacctgaagcta

SEQ ID NO: 6810 - DNA, 904 bp, Diabrotica virgifera
  misc_feature (330)..(350): n is a, c, g, or t
  misc_feature (534)..(546): n is a, c, g, or t
  misc_feature (548)..(565): n is a, c, g, or t
  misc_feature (587)..(606): n is a, c, g, or t
tcaacaaccgaaacgaagtaagcggttatttttatatattgcctcaaaataaaattgccatggatattcagctttttttcccatttatgcgaaacattacattacaagaaaaaagtaaataatgaacttatacattttgacaatataacgatttgaattagaatctgcagcaaaatttattttgactatatgtttttactataaagaacaagtcccagtcttttaacatgtgacaaaaatgtgacttggtaagttttgcttctagacccctcatccacaaaactcggcgaaatcatttggaattgctcatgtacatattacaagttctcnnnnnnnnnnnnnnnnnnnnncaccatagttggcaaccctcggtgctattttgatgtggctgctatgataagttactctttcataattttcaatattcattcttgttccgctgccatgaaatcctctttcgtatactagtctcgcatatgtctcgcgatattgcagttttcttattttgatggtttcttttttttttcattctcnnnnnnnnnnnnncnnnnnnnnnnnnnnnnnnacgtttcgacgtccaaatcagnnnnnnnnnnnnnnnnnnnngacttattttccatttagaatagttaattgcaaaaaatgccacaaggaaatagcttcagagcaacattatttcttatagttgcagcatttaaggtctacacttctattctgtaatgaagagatcagccaacgtaattcttgttacgttcagtggaaaaagatcttcagtttattttgctatttctattcatactgtaaatccgtttattaaattaatttgatttataatccccggttttaaatagggtcacaaaaattcgtttttggagggttttttattctgaacatttttttaatt

SEQ ID NO: 6811 - DNA, 999 bp, Diabrotica virgifera
  misc_feature (741)..(754): n is a, c, g, or t
  misc_feature (756)..(768): n is a, c, g, or t
  misc_feature (791)..(811): n is a, c, g, or t
  misc_feature (813)..(829): n is a, c, g, or t
  misc_feature (895)..(909): n is a, c, g, or t
  misc_feature (920)..(939): n is a, c, g, or t
  misc_feature (947)..(967): n is a, c, g, or t
  misc_feature (971)..(991): n is a, c, g, or t
tcttgattggcaaggttagcaacctaccaatctggaaaaaaaatactgctcaaagaaacaatgtgaagcctcaaaagtagtctaaatatgtcatttatctaattttgtcgcaccgtatgccacagtacttagcaccaatgttttatatattaggtttgttccaacacaacgaaaaccttcatgaaacaatcacgaaactgcgcgtagatagcgaaataatacgttctatgggttatcttgtttactgcgcagtttcgtgatcgtttcatgactgtttttcggtcttataatagtcgatatgacgttcaagctgtgtaatgttgactccatcaattttctcaataatgaaattgatcaaccacttcaataaaataactttataaaatacgcccactataataataaccatttcctaataattacattgacagtacacattccaacgtacgttttacttaacctttaaccacaggcgctggcgtatttcgtacgccagatataagaattctactgcaaatatgtttaaaaatttagtttttgactttgtttatctatctaacctatcactagaatgtgctttacaactggttatagtttcgttataatcggagttctgggaagatcgtaatttacagtttattatttgttgtttccggtggtggacaatataccgccacaattacattaatataagtagtaatataaatacatatttcaattgttttatagtcataatgacannnnnnnnnnnnnncnnnnnnnnnnnnnctttttagcatgtaaaaaaatcnnnnnnnnnnnnnnnnnnnnngnnnnnnnnnnnnnnnnngggaatcaaaattcaagttataaatttccaattgaactttatggaaaaaggaatctccaagttatnnnnnnnnnnnnnnntaaaagttttnnnnnnnnnnnnnnnnnnnnatttttcnnnnnnnnnnnnnnnnnnnnncttnnnnnnnnnnnnnnnnnnnnncatttttt

SEQ ID NO: 6812 - DNA, 463 bp, Diabrotica virgifera
  misc_feature (16)..(34): n is a, c, g, or t
ggacttttcactttannnnnnnnnnnnnnnnnnnagctctaaaataatttaattcccaaatattttaggaaagtatttgttttgataaatgcccatatactgattcaatcgggacaatttatataggcaaatcaaattactcggcctgtcaaattttcctgtccattttctgtctctctctagctctctcctgtatgttggcggcattctcgctcaatatttgaatgggacggggacattccaacagacatgacagtcccgtggcttctattcattttctgatgtttagatgtccttagacataaaagtaaatagtgctacaagggaggggctctggaatacattagctcaatatacccgggcgtaagtcaaggtgggcgcacttatatttacgtcataactatccttcattacatcagaaagacacctccaaacaaagtacaaggtaggggaattaaatttg

SEQ ID NO: 6813 - DNA, 269 bp, Diabrotica virgifera
  misc_feature (65)..(85): n is a, c, g, or t
  misc_feature (148)..(183): n is a, c, g, or t
ataattaaccgctttacaaatttaaggggggcctttttccggggaaaaggggggccgggaacccnnnnnnnnnnnnnnnnnnnnntaaaaaaacattccaaaaaatagactcccgcccccggagaaaaataacccctggtaaaatggnnnnnnnnnnnnnnnnnnnnnnnnnnnnnnnnnnnngattttcaaacttttccccgggtccccccctatttccccttttttttggggctatttttcctcttcccttgttttttgtccccccc

SEQ ID NO: 6814 - DNA, 302 bp, Diabrotica virgifera
  misc_feature (16)..(33): n is a, c, g, or t
  misc_feature (94)..(126): n is a, c, g, or t
  misc_feature (139)..(165): n is a, c, g, or t
ctcccccaaaaacccnnnnnnnnnnnnnnnnnngtaaaaaacgtggggggcccaagggggttaacataaagtggatttcacgaggggaaaaacnnnnnnnnnnnnnnnnnnnnnnnnnnnnnnnnnaaagtgagaaacnnnnnnnnnnnnnnnnnnnnnnnnnnnatttttttccccctttaaccccccggaaaaaaaaaaactccctcccccccataaattttttttctaaaaaatttgtttgggttatcttcccccccccacacaaaaaaaaacttcttttagtatggggggggtgagcg

SEQ ID NO: 6815 - DNA, 458 bp, Diabrotica virgifera
  misc_feature (14)..(41): n is a, c, g, or t
  misc_feature (63)..(276): n is a, c, g, or t
  misc_feature (281)..(306): n is a, c, g, or t
ccccctcacggccnnnnnnnnnnnnnnnnnnnnnnnnnnnncccccctttccagttttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcannnnnnnnnnnnnnnnnnnnnnnnnnccaccttagggataacagcgtagttttattggagagcctcaatcgataataaagattgcgacccccatgccggatcaaagtttataattgcggtcccagctactcccccccgcctgttcgacttttaaaattttacatgacctggacttaac

SEQ ID NO: 6816 - DNA, 771 bp, Diabrotica virgifera
  misc_feature (506)..(523): n is a, c, g, or t
tcttttgcgtccgcttcaaaagtggatattcgtaataagagacgcaatattctggtatgcaaatttgaagtatccaatgtaggtaccacatcacaaaaggggttttggaattcaagcggaattcataatgaaatagtcatatccaggccggcatgtatccaacaaaatggaacgttgattacaagaatatgtaagaatggtaaatggataccagacatcgccaaaacggtatgtccacaagtaacaggaatgagacgaacatgccctccgaaattccaagaaactccaactagttgcctatttatagcacccgctcaaacatgggggtatatttgtaattcgaaaaactttagacccggaaccctaatcaaacttctataaaagacgatcttgtatggataccttaacaaatatttaagaccctacggcccctctgaatcagccgctttttggtgaaaatatggcacctcatttgataaacacataagtgctacgtctatgcatcnnnnnnnnnnnnnnnnnnaactgtttggttgctaatagtgcaccaaaaaaatattttcctgggtttttgaaataaccgccagggtaggtttgggattttttaaggagttgagaaacttctaatggccaaaaaattgtttgggttgctattactggatcaaaaaaattttatcctggtttttttaataaacacgtatgggtttttgttgggtttttttttaaggagtttataacctcttcaatggcccaaaaaactggatctgctgt

SEQ ID NO: 6817 - DNA, 316 bp, Diabrotica virgifera
accccccccacgccgtccgggtaccagcgattgcacaaatttttaactcttcctcggctgcacagtgctgaactcttgatttatgctcctagagtgcttcaggcgtatctcagcctcctattcacacatgtgtgcctaccaatggctagggaccaaaaaccggccagcatttgccatggcaacttcatggctctgcttccacactggatcccgcactctgctaaaacacgatggagcgacccccaaccacatagttcttatcaaaattcccctggacagacaacagaatacacgcacctttctacccttcacaagg

SEQ ID NO: 6818 - DNA, 556 bp, Diabrotica virgifera
  misc_feature (335)..(359): n is a, c, g, or t
gtgtatatcctttttattattttgtaatatacagtggcaattctgtataagattaattgtaaaaattgcataaatattagtcaatatatgagcttgatctaatattactaattattttcgaggaaagcataagaattttatcgtaggtaagtttaatattacaatggtaaataatagtatatacttttaaagcacttaagtgttatcacattcctacttcatgcaaattgatctaaattaggtttagtgttaagatatttcacgaatactcacatcagctacaaaaattgtatatgaatatttgtagaacgacatatgaaaactaaatacagacnnnnnnnnnnnnnnnnnnnnnnnnncgtacatacgatttcaaaatcccttatgatatttttaataatgttgtttaaaaaatttataatataccattagaaaatctgtggcacgcttgcaatctatggaaatcttataatatatttaaatgagttgaaaaaatgacttaccacagattgtgcgttttttcactactctcaaacgtataaattgacatcagcga

SEQ ID NO: 6819 - DNA, 820 bp, Diabrotica virgifera
  misc_feature (5)..(24): n is a, c, g, or t
  misc_feature (601)..(620): n is a, c, g, or t
caagnnnnnnnnnnnnnnnnnnnncacttcaacaataaactttgtactaataataattgttacctatagttttctcttgcctacataatttcttttttcttttttaatggcaatattagatccatgtcggatgatgaatgtgatggttttccttttctgcttttcatcagttggccaagtgcaacaaacggtgattcgaaagccaagcaccagaagattgatatgacaaatgtacagatcgcatctcccataaagtcatgtatagtaccgatgttagtgtaaaatacggcactcctctttgttccaacgaagtaccagataactatcaaatgagtcaagtaaaaactgtaggatagcctcaccaatctttggaagattggcaacgataagactcgattcattaaaccattcttgtctgttatacaaagaataatgaagcatccttgtgcaattgcccacaattgccgagcaccaccattgaacaaagcagatcgaagtggactatagcttgttgctcttgtatataccagatgcaccaaaatgagtccaaacatggtacctataacggtcacccacgctagatatctgacaggtctacgannnnnnnnnnnnnnnnnnnngtaaacgatgtatccgaaaataataccaataaaatatggtggtaatcgagtttttgtcggtaagtacatcccttggaagtatcccacgttaacttcaaagtagttagctccatgattgttttgcattgttgaaataaatgaatatattcctgatgttaacaaatgactacacataccatacatgcccttactggattcct

SEQ ID NO: 6820 - DNA, 355 bp, Diabrotica virgifera
  misc_feature (2)..(65): n is a, c, g, or t
  misc_feature (106)..(123): n is a, c, g, or t
  misc_feature (133)..(196): n is a, c, g, or t
  misc_feature (200)..(226): n is a, c, g, or t
  misc_feature (244)..(268): n is a, c, g, or t
  misc_feature (281)..(323): n is a, c, g, or t
  misc_feature (327)..(348): n is a, c, g, or t
tnnnnnnnnnnnnnnnnnnnnnnnnnnnnnnnnnnnnnnnnnnnnnnnnnnnnnnnnnnnnnnnncggtatttttgaccgtgcctaaggtagcatgaatcattacnnnnnnnnnnnnnnnnnnctggaatgannnnnnnnnnnnnnnnnnnnnnnnnnnnnnnnnnnnnnnnnnnnnnnnnnnnnnnnnnnnnnnngtannnnnnnnnnnnnnnnnnnnnnnnnnncaaaaagacccctatcannnnnnnnnnnnnnnnnnnnnnnnnggtttttttaccnnnnnnnnnnnnnnnnnnnnnnnnnnnnnnnnnnnnnnnnnnngggnnnnnnnnnnnnnnnnnnnnnnctttttt

SEQ ID NO: 6821 - DNA, 730 bp, Diabrotica virgifera
  misc_feature (91)..(111): n is a, c, g, or t
  misc_feature (323)..(340): n is a, c, g, or t
aaatttttccccctgcagtcccgacccctctgcagtccgataagttgtttttttttataagataacactaacccgtataaacgaatgcagnnnnnnnnnnnnnnnnnnnnngaaaacaatgaggtatattgactttcaggttaatgttgtgtgcaacacgtatttatattatgtacaataatatgatgtaactagttttagatgcctacatccctaaaatgtttatatgtactatgtttagatatgaggtgtattggctattatatttaactattgattttattactgctttaagacacattctgacattattgtgcatcacnnnnnnnnnnnnnnnnnncaagtgttactttgttagttgagtacagttatatgaattcttattgttttgcattttggtttctaaatgcttgacattatatttccaggctacacatttttttttaaatcaatgggtatatattgttttcctaggaggaaataaccttcctccatttcagctcagcgtttgaggtagaggcttctattatgtcgttgttccgaagtctttcttttggcgagaccaatgttacaaaccttcaaattgttttccttaaattgcaaattgtatttcagctcgacatgaagaatttaaatttgtaggcacagggcaaatttccagaagctaactaagaaagtctaatattcgattatctttcgcttgcccctatccccaatgttccacttttaa

SEQ ID NO: 6822 - DNA, 842 bp, Diabrotica virgifera
cgaccatctctcataaaagccgccgtgtgccgaagagcaacagggggttactgcgagctgtacaggcttcaagaacgagtgctgattttactactgatactatcaggaaataggtttttcgtgcccagttgctttaaacgaactctattaagaaaataacaagaatctacccttgtatttccaagaagaacaacgtccaaatttaacgggacctctacactgacgaacagcaatctctaaaaaaacaatatgaggacatctggagtaagcggaaacagcgccattgcattattgttcctcataacaagctctataattctacaatctgctacaataagcgcacaacaacaggcaaggtacaatgactacccagctatatcggatgatcgggacacctcaaaacgtggtttggatctcggccttggccgcggcttttctggttcacaagctgctaaacatctgatgggattagcagcagcgaacttcccaggaggaccaggccgcaggcgacgtaacgacgacagaatctaaatatatataaactactacggaaactccttttttgtttccttttttctttcgcagcaattctaaacctcccccaggattaagaagaccctttaaaaatcgggaccaaaaaattaaatggaataaatgggtcccgccccacccctcgggaaaggcctaaaaccaggggaaaaacttagcccttctaaaaaaatttttcaaagggtttttcggcagccttcctttatttttcaaattttaaacacccctttatttgggaaataaattatcaaccccccttattaattttaagctcccacaatagaaaaaaaata

SEQ ID NO: 6823 - DNA, 222 bp, Diabrotica virgifera
  misc_feature (93)..(105): n is a, c, g, or t
  misc_feature (107)..(119): n is a, c, g, or t
tttcatccgcgttataaaatacagaaaatgtttaggtgtttgtacctctctattctgttttgcttgcaatatctgcacagggactaatccctnnnnnnnnnnnnncnnnnnnnnnnnnngtggaaaatttccatggaaaagcctatttggctgattggaccgaacaaggaagatactccaactttaactaggaagatcacggaagaactgcgttgttaccaa

SEQ ID NO: 6824 - DNA, 733 bp, Diabrotica virgifera
caaattagtacgaaaccgatccaatccgatgtgatggccatgataccagtctcagaaatatcaacatttatcgtgtattttctgggaattattttcgtttgcatttacttggctgttatcagctaaaacgagagggacgaacgaccgaaaaagaccgaatctagaaagaaagttaacatccaacaactaacaccatgtctttcaaggaacatttggagatgataagccttaacgaatccccttctaagaaggctaagttctggcaggcctttgtcagatccctaaaaggatccgatgacttaagggcaaccgattcagtcagttcccgcaggggcatcttccgtcccatcagtgacatcccagaaaattcatcctcttggccatacaccaaatcaatctatgacgagcccagcgcagctgcagaacgtatccacgttcccggctacagatacgatccagttcacagagatatctacggttactcccccaggccaatttacccacacaactatggctctctagacagataccggcccgcataccacgtcacaaaaccaaaaccaatcgacgctgacgaggcatggaaacaccacattgaccgtgtaaaaggacgcgagccatcacaatggcccagcagcattttccccacatcttaccccattctctcgctatccattgtacttaagggacagtaagagacctgctccagctgctgacaaatacaatccccacc

SEQ ID NO: 6825 - DNA, 267 bp, Diabrotica virgifera
atttacccattccaatccattatgagcgagatattagctttgaccaggtcactatttttatctgatgttatcctcagttctcacatctgtattgccttctatagacgaattctaatgcgctatccattaccatcctctctgcttaccgaattatacgcaaaaacactcttgtgagcaaaacgctcatacgcccattggaaagccctcgcagtcctcttgggagaccactgcggttgtgtctaacacatgagcatttttttatcaaat

SEQ ID NO: 6826 - DNA, 813 bp, Diabrotica virgifera
  misc_feature (33)..(55): n is a, c, g, or t
  misc_feature (548)..(571): n is a, c, g, or t
cttttatagatggtttttcaaattttactatgnnnnnnnnnnnnnnnnnnnnnnntgacgttatcagtaaatttaaggaatatttgtggtttgtagaatcaaaatttaattcaaaggtttctaaattaaggtgtgataatgggggtgaatatgtttcaaatgaatatagagagttttgtaaagaaaatggcattttattagattatacaggaccgtacacacctcaacaaaacggaaaggcagagaggatgaaccgtactttggtggaaagagctagatgcattatgaatgcttcaatggttcctaagtctttctgggaagaagctataagggcatcatgttatgtgataaataggtcaccttcggaaagcctggatagagacgttacaccagctcaaatatggaacgacaaaaaaccagatgttagaaatttaaaagtttttgggagtacttgttatgcttcctgatgaattgaggagtaaggttgatgataaggcaggaaaatgtaatgttgggctatgcacctacaggttataggttgtggaatnnnnnnnnnnnnnnnnnnnnnnnngccagggatgtaaggtttaatgaaaatgaattttattttaaaggactggcaacactagatgaagacagagaagttaggagcaaacgtgatgaagatatggatagtgtagacaatattgcaaaacaagaaatgaaccgcagaaatgaaatatatcaagttagtatttatgaagaaataagaaatgaagaacagaacacaagtcaagcataaggtagagcaagtagaaatgtaaaccccaccaa

SEQ ID NO: 6827 - DNA, 710 bp, Diabrotica virgifera
  misc_feature (550)..(550): n is a, c, g, or t
  misc_feature (607)..(607): n is a, c, g, or t
  misc_feature (613)..(613): n is a, c, g, or t
ctgtgatacatagtgttaacgggaaaacttggtattcaataataatatgaaatacattactagtattgatgggattgaagttgatgctattatagatcccaaactaatgcccggtggcaactacatcaggatcggtaaggattcagcgcacagcacctgcatcgtcttcgcacccccagcagaagaagtaggagttcttgccaaattcttgtcgatcttcaagaaacatgaagtcaatctattacacattgaatctagaccatcttcaaaaactcccgacaattacgaatttatggtagaatgtgccccaaccggaaatcttggagctgcaattgctgatatgaaagacattagcgattactttcagatcatttccagagactacagagataacaaagataccgttccatggtttccaagacgtataagagatcttgacaggtttgctaaccagattttatcctatggtgctgagctagatgctgatcatcctggtttcaccgatcccgtctacagggcacgcaggaaatactttgcagacattgccttncattacaaacatggccaaaaacttcctcacgtagattacaccaaagaagaaactganacatgnggcaaagtatttaggcaactcacaactttatatcccacacatgcttgcaaaagacataatcatgtttttcctctactagtagaaaactgtggataca

SEQ ID NO: 6828 - DNA, 88 bp, Diabrotica virgifera
  misc_feature (15)..(83): n is a, c, g, or t
cgaaaaaccctatannnnnnnnnnnnnnnnnnnnnnnnnnnnnnnnnnnnnnnnnnnnnnnnnnnnnnnnnnnnnnnnnnnnnggatt

SEQ ID NO: 6829 - DNA, 909 bp, Diabrotica virgifera
acttcattgagttcgtgatttaacaacatatcgtcaacatgagtaaatacgtctaccgttcgcctttaaatgacgctatttgcgctcctgaaagggagcaaaagtgcccatggaatccgaaagttgacagatcgacctcaattcatacaaaggtcgattggaacgcacctaagccaaaaatattaccgaatgctttggctgcaattggtaatactccattgatcaagctcaacaggatacctcagcaggaaggattggaatgtgatatatatgtaaaatgtgagttcttcaatcctggtggatccgtaaaggaccgcatggcaaacagaatattaacagatgctgagaatgaaggaatcttaaaaccaggatgtacgattatagaaccatcttcaggaaacactggtattggtttggctatggcagccgctattaaaggatatcgatgtataattgtaatgtcagaaaaaatatccaaagagaaagaatacgtaatgagagcacttggagctgaagtcataagatgccctgtaacagctaattcgttttctccatatggaatgtttggaaccgtacatcgtttatcgaaagaaattcctaacagcgttatttttgatcagttctccaatcccggaaatccactaactcactacgataccacagcagaagagatctatgatcaatgcgacaaacaagtagatatgataataatgggagctggaacaggtggaacagttacgggtataggaaggaaattcaaagagatctctcccacaccgaaaatcgtttgtggagatcccattttggatcatcctttgctttccaaaagccattaataaaacccgatggtcacttttctgggaaaatagaaggaatgggttaacgatttctttccctcactttgggacc

SEQ ID NO: 6830 - DNA, 173 bp, Diabrotica virgifera
  misc_feature (25)..(25): n is a, c, g, or t
  misc_feature (71)..(71): n is a, c, g, or t
cgggacgcgcccgggagcggcgcancaagcgcggcgggagaggcgcggacgcgcagcgcgaccgcgacacnagccagcgctttagcgcccgcgccagaacgcgacgacccaaccgcgcacgccacgaacgccggccaaccccgacaagaacgaaaaagggggcgccctatagg

SEQ ID NO: 6831 - DNA, 961 bp, Diabrotica virgifera
  misc_feature (722)..(740): n is a, c, g, or t
  misc_feature (812)..(834): n is a, c, g, or t
  misc_feature (931)..(955): n is a, c, g, or t
gaaaactgttcaaatcttgtacaaatcagtacaataaaaggtataagggaaggattaaagcagtaagtgtttgattgaagtaaaatctgtggaaacgtccatagaaatgtgacattacagcgattatgcaaagaaaatttatattcaagtttaaaaaggaaggttcgttttgaagaaacataagtatccaattataaatcgcaaaaatggatgtaaaagttaaaattgaacatgaagaagttgatcttcctgatctcatagatccccaatccttatcagaagaacatagtgtcccaaaacacgaaatccatacccatacctgttctgaatgtctagaagatttcaattgcgaattccttcttaaggttcatcaaatgatccatgacaaaacccaatactgttttatttgtaaacataagattcacaataagtttaaagaacatgtgatggaccgacacttcaaccaatgtgatgtttgtttcaaaactttcaattacaaaaaaacttggttcagcatatggagcatcacacaggaaatttaaattatatcaagtgtgataaaaggtttaggcaaaggggcagtttgatttcccatatgagatcataccatgaaggagttaagccatatgcttgcaaggaatgcgatggaacttttacaacttcttcaagccttgataggcatgtcaaaaatgttcacaaccccaacaatccaaaacattcgnnnnnnnnnnnnnnnnnnngtatatgaattgcgatgtgtgctctacacaggttacaaacaaaaaagaactgcagttgaacgagaaagagannnnnnnnnnnnnnnnnnnnnnntatgggggaaaacataatggggggctttattatcttaattaaaccattttcttgcaacatttcaaaaatgaaaaatgtacccttgggggcaactttnnnnnnnnnnnnnnnnnnnnnnnnncatttg

SEQ ID NO: 6832 - DNA, 534 bp, Diabrotica virgifera
  misc_feature (302)..(326): n is a, c, g, or t
  misc_feature (434)..(481): n is a, c, g, or t
gtgtttagtaatagttggatagcttctgtgttatctgataacagcactttgtcgtagtggttttgatcatgtttattgttacgtttatgttcgaatgctctttgaacgatgcattttgagtagtcattttacaaaacgggtaatagcacactgcctttcctcggtcaattgtgttaggccgcttttcagtcttgctgacgcttcttggcgcctatatgttggtgcccatatcatcgttgtttttatttaaacattcattcaagtatgcttgaagtaatcttccgagaaaccggcgtacgaannnnnnnnnnnnnnnnnnnnnnnnngacgtcgtaccacagatgttatttgttcttggaggatgtatgcagagctagagagtcctgtaaattccgccatcctaggccttcacttaaagttgctggtcgggacgnnnnnnnnnnnnnnnnnnnnnnnnnnnnnnnnnnnnnnnnnnnnnnnnacaatcggttgttttcccagatagtgggtatcctacaaatttccattaacaca

SEQ ID NO: 6833 - DNA, 269 bp, Diabrotica virgifera
  misc_feature (23)..(51): n is a, c, g, or t
  misc_feature (177)..(198): n is a, c, g, or t
cccatcattttcttatgaagggnnnnnnnnnnnnnnnnnnnnnnnnnnnnntagttaaatttcgcccaggaaaaaaatgggggtctcccaggggacgggccccaattcgtggaaataaaattaccaagggaaggaaatcttcaaaaaaagttattatggaggggaaaaaatcgagcnnnnnnnnnnnnnnnnnnnnnncgaaggggtaatatattaaaacaaccatttggattcctctaggtccccctccccctccaagttttctggga

SEQ ID NO: 6834 - DNA, 769 bp, Diabrotica virgifera
  misc_feature (749)..(749): n is a, c, g, or t
ttcaggccgcacgatacgataggcgcttaggcggtcggcccctgcgaagcaacaggaccaacaagcacgaacgaatgcaacacgacgacgatcagtccaagcacattctttgtcgtgtgttcacgacgctctgcgtaaaaattaggaagtagtgttttgtagttgtgttttatgtcagtgtggacttagtgagtttttatatacactgtgaacagtgataacaagtgccttatatcaaaatggcactaaatcaggatgaagctaagcaagtagtgagagtggatcaagattcggaaacagatttacaagctctttttgatagcgttttaaaaccagattcaaagagacctttacaagtgccatggagtatgagaaagctcccagactcattttttaatccgccgtcaacgggttcgaaatctatcaaccactctcgcgaaaattcagtggattccgcttttgggggtggtgctacgggtgctacctctgtgaattcggtacctttacaaactgctcatcacagggctcacagttctccagcttcccttcaacagacttatgctgtaggacagcaacaagcaccagttcatcatataaaacaaagatcgtacgacgtggccagtaaatcagaagataacacccctttgccccccggatgagaacaagctcgcaccccccgagggcaggtgtattatttaaagtaagcaatctcatcattatactgataagactatcgcatttttttcgantcccattttctatgctgatg

SEQ ID NO: 6835 - DNA, 621 bp, Diabrotica virgifera
tgggtcacgccgtcgccgcgcttggccagctcggcataatcagggcccaagtcggccatcggtttgaagttgtgcttggcgtcgctggggtctaccagcacgttgccgttggcttccaccagcatcaggtagccgctgtcgccgagcttaatgttgcgcaccagttcggtgagttgcttgagcgacacgtccaggccgacgacgccgaggatcttgcccgtgtcgtcggcgacggtgtgcacggtgccgatcagcgacacatcgtctggcgcccaatagtaggcgccggtacgcacggtcttgcctggtgcggcgatggccgcctggtaccaggggcgcacgcgcgggtcgtaggtgttcagtttggagtcgtcaggtgaactggcgtaaccgacgtcgctcggtcacagggacaggaatgcggtgttgagaagagtgtatggttgtttgtcagaaaattacaatagaaatactaagttactgccagtgaatgatgatctcagtggagatcgacactgaatatatccttattgcttttgggagaacctaacatagtttggactgtccacattcccaatacgagtgtgtctggcggtataggaatggtctttgctgaaatat

SEQ ID NO: 6836 - DNA, 928 bp, Diabrotica virgifera
tctcaggggtgccttctttgtcataaaaaaataactaaattatcttaggttatacttatcctttctcgtggcttcaatatctcttagttgatccttatcgggataaaataggaaaaggaaataaatagaaaaatcataaataagcacatataaatacctttattatcaaaagcaatgctctgaaaatctatcaattaaatcctgtgggcataattgtccaaatgaaacttttaccatattaatctaattcaaacaaatatttatcgctttgttcctaataccattaataaaataagctaaacaaacaaatttaggtatttgcaaaactacttatacatacttcctatcaaatttttgaaatgttggaatcttaattcatatgcttttacgcaaaatttttaacttctgattataaagatcatctatcacataagttattgactgacctttttgattcacacacaatgatgtctcctcttgacccaaacagctcttccttgttgattatgttgggctaccaatcaaaaccctctccgttctcagcatcaatccagcagcataccagcaactatttctccaaaacacaagccaggccgcttttgaccagtactcgttcaataaactccaaaactctctcttctctttctctcaataataatctcctgagacccaagtatcttgtttacttggtgtcacaaataattttaataacgataattcttgtaacttactctcttggactttacataatcaaagaggtatttcttctcgatatgatttgcctctcgttccacttttcagctactctccactaacaaacaaccactagtacttgcttctgaactatcccgcgaaactttcgactgcccttctaggatgccggccacacaatgatctttcttttccaaactgtctcaacattcaaact

SEQ ID NO: 6837 - DNA, 816 bp, Diabrotica virgifera
  misc_feature (180)..(213): n is a, c, g, or t
gaaattaacaaataactttatttaggtacacaccaaattaaagtgaattaaagcaacaaaagaatataaattactcatacttaaatacaaatagcactgtacatcccaacaatagcacaaataaacatccatgtaacttaaaaaatgatggaatcaatcattcgacaatgccaaaattcnnnnnnnnnnnnnnnnnnnnnnnnnnnnnnnnnnccgtattttagacccgtaacatgcatctgcataacaatcgatttctgtgtaacactgatgtaacattacaaacacaattttgtctttacaaaaagcacgttccacctacatagaaattatggcaaccttacaggcgacataattatctaaactaaaaaaatacacttatccattttattatatctataatataattttgttagaactcgacattgcaacgttcaactacactaagctccgaatgtttctgtaacaaggcacaaatatgattaaatatctcattaataaaggttcaacaaccataattttcaatatttgtccactcaaattaccatttgtaaatgatatgtacaacagattagagaaggtagctcattttctcaatcatggagaaattttcatccaagaaaacgatgaatatcattaatccagatccgaaaatacattggaaacaatattttttctcaggatatcacaaaaaaaatctacagcggcgcggaactatggcatgcggcaaaataaacagcactgaaatgcgtatgcctcaaatttgtatgtgttatgcgcagcgtactgagtggtttccgaacgtcgttataacat

SEQ ID NO: 6838 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6839 - DNA, 57 bp, Diabrotica virgifera
gacgtctgggtggtgcgattttatatccagaaaatatcaaatagctgctcttcaaag

SEQ ID NO: 6840 - DNA, 397 bp, Diabrotica virgifera
acatcaagttgtggaaaacttttacggactgttttaattgcctacctgtagcagccatcgtcgatgaaaaaattttctgttgccatggtggtttaagtccggacctattttcaatggaacaaattagaagaattatgagaccgactgatgtacctgaccaagggcttctttgtgaccttttatggtctgatccagacaaagaccagatgggatggggagaaaacgatagaggagttagttttacttttggtgctgaagttgtaggaaagttcttgcacaaacacgattttgatttgatatgtcaagcgcatcaagtcgaagaagatggatatgaattcttctccagagggacagttaaccacactgtttagtgctccaaattattgtgaagagtttg

SEQ ID NO: 6841 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6842 - DNA, 677 bp, Diabrotica virgifera
atttataaatgaaaattgtaccaaaataatatctgtagtgtattattccaattccactaaatataagagttagtctttagccaatatcatacctacttactaatatggttagattattaggttaggttcaagatgaggaagcgcttaaccacccttcaactcgacctaagaagtctattgtggctcatctctaggttagagttatctcttcagcccagcatttttaacaaagtctattgtgggcttaggtgacactcctacgaagttggagggatctagatgataatgctcaaatgtattgagcattgagccttatcctatccaaccctgagaagttgcaaaaaacgtgatccaccgtctcgtcatcggtctgaccaaatctacaattcacactttctgtgcagacgattctgtttacgtgccctttgaggtgatagtgtcttaaagacctacgataattcgcagatcattcctaaccatatctaagagatctcgagatcttttcttaaaatgaccatgtcatagagccttgaagcgaatgttgatggtacatttgttcggacctatggtgacgtatcataagcatcatacgtaccacgtaatccgatatgattcttttcgggtgtacttcttgcaatggaaacaacaggtgaccaacctatgaatgtttatttgtg

SEQ ID NO: 6843 - DNA, 618 bp, Diabrotica virgifera
cctcaatagaatgcatgccgatacactgaaagaccacaaaccaacgagctgacctggaggacgtttattgaaaagctaagaacacatcagatgaaggtgacagaacgcataataccgaatgcctaagtgagaagctacaggagatggtgggcgaagactcaacaccgaaaagattaaaaggataaaagttaaatggaactgttaacgataaacgtgaaaataacaacttagctaattaggaagagaaatgcccaaatgacgaaacattccagccaattgcacaaacagacagctactaaactgcatcaggggctagcaccaccccaagtggaagcgcaatctataatcactgttgaagcaattacacaatcatcttaataggaatgtttggatatcatgcagacagtagaccaggaagatgatcatgccctataaaacatgtgtattcacattacttttctatgcatcatcatgacgtcacaataaaattcccgggataagcgactatatctatatagcatctataacttgaagggagatgaatcctcaacgactgaaagaaaaaatgaataagtatttaaattgataaccatttcataccgcacaaagaaaaatata

SEQ ID NO: 6844 - DNA, 829 bp, Diabrotica virgifera
aacgattatccactatacattagcattgcatcaaaatactttcctaattcgaagattctttgtttaacattcacgagatgttagagtgattctttttacatactttatcacacagtgaaaagaactgtcctcttccatgcattaataacagccaatatatgattcagcaaactgaacgtgcaaatgacatctgacactgctttgtaaattcagaattaatatatgaataagcatcattactatctggtgtatactagttggccagtttatatatcgccactctatgaacaacatcttaaagaattataccaacaacgaatggatcaaatagaacccatgacttatattaaattgaaaacaccagatccccaccatgctgtgataacagataactgcatatcatacttacataaacataaaactatgcttaatgatgtaaactattggcatcagtacatgatcagaaatgtggatcatgcaagaccagaactacatcttactgcgattttgcatcatgtttttccattcaatctaattccagtgacttattgggtaaaggacgactttgtcttttttcttggtcgaaattgtgaactcggatatagacaaactatgcaatgcaaatttatctagtgcccgatccataaagtacaacatcattcatgaccaccattatgctgagatttgcaacaacatcagaatatatgatagacgtacaaaggaatctaggcatctgattgaccaatataaacatcctgcatactacatctctgaacttaaccaaattccacgaagatgacgatctcatagaatttactcctctattaca

SEQ ID NO: 6845 - DNA, 714 bp, Diabrotica virgifera
  misc_feature (643)..(662): n is a, c, g, or t
  misc_feature (684)..(708): n is a, c, g, or t
cgatagaacaaaaagttgttacgttagagtggatggctaaccccgtcaatgacatgtatgccgattctctagttgctgcaattctacaagctgatctgttggatgttcctttaaaatctatgaacacatcaattaaagttgacagaatgcattttaaggaatgtctaattgagatgttacaggatatgtttggcgaagactcagtaccgaaaatatttaaaggagaaaagttatatgtaactgttaacgataaacgtgcagatatcaacttaactaatttggaagtgaaatgcccaaatgatgaaacattccagcaaattgtacaaacagcagttactaaactgtatcagtgtctagcaccacctcaagttgaaacgtaatctataatcagttttgaagtaattagacaattatcttaataggtatgtttgtttatcatggggacagtagactaggaagttgatcatgccctataaaacatgtgtattcacatttcttttctatgcatcatcatgacgtcagaatagtattcccgggataagcgattatatctatatagcatctataacttgaagggtgatgaatcgtcaacgaatgaaagaagaaatgaataagtatttaaattgataaacatttataccgnnnnnnnnnnnnnnnnnnnngttctgtaactttgtgtgtaannnnnnnnnnnnnnnnnnnnnnnnncatcgg

SEQ ID NO: 6846 - DNA, 65 bp, Diabrotica virgifera
  misc_feature (2)..(28): n is a, c, g, or t
tnnnnnnnnnnnnnnnnnnnnnnnnnnnacccttagggattaacagcgtaaattttaattggaga

SEQ ID NO: 6847 - DNA, 591 bp, Diabrotica virgifera
  misc_feature (575)..(589): n is a, c, g, or t
gcgacctcgatgttggtcgtacatcaagtgacattgttacttgggctttagataagttagaagagaacattccagcaccagaagtaactcaaattttagatgacaagtcatttaagaaattgtgtgaagacaaacctctgtgtgtagtagccgttcttcctcacattttagattgtcagtctgaatgtagaaacaattatattaagatgcttgctggtattggagaaacattcaaaaagaagatgtggggatgggtctggtctgaagcaggtactcaacttgatttagaaaattcccttgatattggtggatttggatatccagctatggctgtcattaactcaaagaaaatgaaatattctattctccgtggatcattttccaaggatggtatttatgaatttttaagaaatttgtcctatggtaaaggcaatactgcccctgtaaagggccaacagcttccaaaaataaacaaaatcgaaccttgggatggcaaggatggtgtgcttccagaagaagaggatattgatctctccgatgtagatttagatgagaaagaagagttgtaaatgtcnnnnnnnnnnnnnnngt

SEQ ID NO: 6848 - DNA, 80 bp, Diabrotica virgifera
  misc_feature (2)..(69): n is a, c, g, or t
tnnnnnnnnnnnnnnnnnnnnnnnnnnnnnnnnnnnnnnnnnnnnnnnnnnnnnnnnnnnnnnnnnnnnaatttttttga

SEQ ID NO: 6849 - DNA, 865 bp, Diabrotica virgifera
cagaccaggtgattaatgacggttcgtcgattactgtctctacactgggttcggcgatagacccttgcgatccggacatttcggatgtgctgatgctgttgtgtcgcaagcttgaaggcgtcattcacgactgtgtaaatggcggggtcaccgtccgctgattgaaaaatcggagttatgaaaaatcgaggtcagaccaccacaggtttaaatgtggtctgaccccattttgcgctgcttcttttgtcagacagggtgtgttcattttgagcgtggaccggataacgcatagcgacttgcctcttccatcaagtcatcgcacataggattggctttgagcaggtacgcagccgggtcgattatcgacaagccaagggacgtctcttctgtggcagatgcccaaacttctcccataggcccgacaatctggctttcacctctgaatgtcgcctctgagcctgcatacatttccacaccggtacgattggcacagattagcggagtggcgttttccattgcgcgaatacgcgcaagctgggtcgtccaaggtccgccatagttggctggacaacacagtagctgtgcaccctggcgcaccagcaggcgggcggcttctggcatccagaggtcaaaacaagtcagaacgccaaatcggcaggttccatcatcgaaacaggcgaatgaatcgccaggtgtgaagagcggcttttctatgcatgacagatgacacttgcgttgtttccccaaccatcgccctcgcgatacgacaatcgctgtgttgtagatctgatcgccatctcgctcagcaatacccgcaatgagcgttgcatccttgtctgcccacagttgtaacaagaactgcgcg

SEQ ID NO: 6850 - DNA, 227 bp, Diabrotica virgifera
aagcttggtctcccccctgcaggtcaccggggtccgggaattcccctgggtccgcctctttttctcgtcccgatagatggtatacgacataagtcaatatgtatgatcagatttattccatcatatacgacgggagcaattagctattctttaccattcatgtgtgatagataatagaatctgctggagacgctcatgtctagaaatatggcctaacgcaaaaccta

SEQ ID NO: 6851 - DNA, 629 bp, Diabrotica virgifera
aattaatatgatactacaatgaaatataattaatataattaatattattgaaacgtaattaatttgtacttcgtatcccatgttatcgggttttatatcccaagccgttattagcccaaagattttctacagcaattctccttatatgtcaagactgcaagaactaagtagatcgacagagacaagaaaattttatcagaagctgaacaaaagcagaaaagacttcaaaccgagaaagacgatgtgtagagataaggaaggtaatatattgacagaacagcaagagatactaagaagatggacagaacattttacggaaaagcttgaaggagatgggagtgagacgaaccctgatataccattagaccaagcagacaacagagaaaagagtccaccaacaatagccgagattagaacagcagaagacaaattaaagaacaacaaatcaccgggatcaccaagatatggtcaaataaacagctaccagcggagtggaatagtggtattattgtaccattacataaaaaagggaatcagttagaatgtggaaactaccgtggaatcacgctgctgaatgcagcatacaaaataatgtccaacgtcatttatgaaagaccacactctgaaaa

SEQ ID NO: 6852 - DNA, 912 bp, Diabrotica virgifera
  misc_feature (491)..(509): n is a, c, g, or t
  misc_feature (839)..(839): n is a, c, g, or t
cagatacagtaaattaattttgatattttttaggtcaaaaaatgagtaaacacatgtattcaacagcgaatctgtccgataaggaacttaaagagcaaggaaatcgacttttcaatctaagaaagtatgaagaagctgttaactgttacacgaaagcgataataaaaaatccgagtgttgcccattatttcaccaacagagctctttgttatcttaaattattagaatgggatcaagcctgcatggattgccgaagggcgctggacatggactcgaatttggtaaaagctcactttttccttggacaagcattactagaaactgataattatgatgaagcaattaaacatttacaacgagcaaatgacttagctagagaacaaaaattaaactttggtgatgatattgcttctcagttaagagcagctagaaagaaaagattttcgttacaagaggaaaagcgcatagcacaagaaatagaactacagtcnnnnnnnnnnnnnnnnnnngaaaaagatagagaatcaaggattcaagaaataaaagcagaagagggagacaatgaaagtgccagagaaaagattgaacatattcaaatatcatgtgataattatataaatgatcttaaccatttatttattaaagttgacgatagaaggaggaaaagagaagttccggattatctctgtggtaaaataagttttgaaatacttcaagaacctgttataaccccaagcggtattacttatgataagaaagattttagagaacacctacaaagggtgggtcactttgaccctgtcactagaagtaaattgactcaagatcaattatacccnatttgctatgaaagaagtgtggatgctttttttactgataacgaatgggcactgaactattaacagttttttt

SEQ ID NO: 6853 - DNA, 924 bp, Diabrotica virgifera
ttcaaataaacactttgtttagacgcttgtcgaaaaccaatggagatctgcgtctgtcaaacagtgttgtagctcctgctgttgttaacacctccatttcaaacgtgaatttcaagttaaccccaaatattgcatcagtaaccaatacctattgccccttgcactcgtttagagagatgtcaactcaagcagaagcaaagaaaacaaatagactagcattagaaaaatccccctatttgctccaacatgccacaaatccagtggattggtatccttggggacaggaagcgttcgacaaggcaaaggcagaaaacaagttaattttcttatcggtgggctattctacttgccattggtgccatgtgatggaaaaggagtcgttcgagaatgaatctgtagccgaaataatgaacaaacattttgttaacatcaaggttgacagagaagagcgacctgatgtagatcggttgtatatggcttttatacaagctactgctggtagcggtggttggccaatgtccgtcttcctctctccaaatttagaacctatagcaggaggcacgtatttccctcctgaagatatgtatggaagaccaggcttcaagagtgtcttaaaggatcttgcaaagcagtggaatagcaatagatcaaagatggaagctgccgggaagaaaataataggtatattaagaaaaatggaggtcaaagaaacagagggtggtcaaaacgtacctggagaagatgcttggaaaacttgcgtcttgcagttaaccagaaattatgaatccgattatggtggatttagcacagctcccaaatttccacaaccaaccaactttaacttcttgtttcacatgtactctagaaacaaacaaagtgaacaaggatatgcctgcttagaaatgtgtctacacacattaaaaa

SEQ ID NO: 6854 - DNA, 704 bp, Diabrotica virgifera
gtcaaggtgacgctgttcttcggttcgtaccacgacgtggactcgaacgaaaacgccttcaagatggccggctcgatggccttcaaggaaggcatgcggcgcgccgatccggtgctgctggaaccgatgatgcaggtcgaggtggaaacgcccgaggacttcaccggcaacgtcatgggcgacctgtcgtcgcgccgcggcatggtgcagggcatggaagacatcgccgggggcggcggcaaggtggtgcgggccgaggtgccgctggccgagatgttcggctactccacctcgctgcgttcgctgacgcagggccgcgccacctacacgatggagttcaagcactacgccgaagcgccgcgccaggtggcgcaggaagtgatcgcggcccagggttcgggccgctgaattccgatcggctcggaacaagggccacccgtgcgggtggcccttttttcatgtcggcgctacgtgtgcttcatgccggcgcggcggccccggccgtcgtcgcccgcatgcgcgaggacgccagcttcacgcccagcaggatcatcacaaagccgtaggcatggaacagttgcggggcctctcccatcagcgaaccaggtcagcaaaagcggcctaacaccggaaacaaaaacatcgaccggtccgttagtgaaggaaccagtgaaaatatataattatattcgcactcaaaatca

SEQ ID NO: 6855 - DNA, 868 bp, Diabrotica virgifera
  misc_feature (6)..(33): n is a, c, g, or t
  misc_feature (780)..(780): n is a, c, g, or t
cgcgannnnnnnnnnnnnnnnnnnnnnnnnnnncatttggcttcaacttttttttcaatatgattttcacatatcgatattgtagaatgttagaggaaggttcatttagaaataggacagctgattttgtattgatgttcctctttggagcagcttgcatgattggttttgcattttttgttaacttattattcttagggcaggcgtttacaataatgctagtgtatgtatggtctaggcgaaacccatttgttggattgaatttctttggactcctgaattttcaggcgccatatttgccgtggattctcttggcattttcgataattttaggaaacgcggtgtatgtagatttaatgggtattgcggtagggcacatatattattttctggaagatgtgtttccaaaccaaagaggaggtgtcaaaatattgaaaacgccaagtttcatgcgaatactattcgatgctcttcctgaagatgcagactaccaaagattgccagaggaaaaccccggcggatttcagtggggaaatcaaaacgatgttcaaaaccaagaagacgctgataacaacgcagaaaatcgatagaaataactgacgatcgacctcagatattgtaacttgctttaaataacgtttttagttgtagactaagactagacagtttatgtatatgcaaaacaattatcgttatttgtttaactaatttatttaaaatacttacaagttttagatatgtagcagatattgcttaacctttgatattcatattgccatnagggtcgtcttacaaactaaatttaatgtgggagattttgagactgcattaatgttcaagaatatgggacctacattgatgcctacta

SEQ ID NO: 6856 - DNA, 1085 bp, Diabrotica virgifera
  misc_feature (110)..(138): n is a, c, g, or t
  misc_feature (421)..(444): n is a, c, g, or t
  misc_feature (468)..(498): n is a, c, g, or t
  misc_feature (505)..(612): n is a, c, g, or t
  misc_feature (689)..(727): n is a, c, g, or t
  misc_feature (730)..(743): n is a, c, g, or t
  misc_feature (745)..(758): n is a, c, g, or t
  misc_feature (819)..(852): n is a, c, g, or t
  misc_feature (902)..(928): n is a, c, g, or t
  misc_feature (1013)..(1037): n is a, c, g, or t
agcggaaaaacgagctaatgaaaataaaaatcgataaccctgtacagaaaaaatcgaaaattgttccagaacctgtctcttcagtcgaacatataccacaagaactaacnnnnnnnnnnnnnnnnnnnnnnnnnnnnncgaccacttcgaattctgctagaattgtaaatgaaattaatagagacgtttcgaagatgttagaagaaaaaccaaagtccagaaaagcggtggttcctactaaaagtttacacactaaagatgtaattcatcaacgattaagggataaatctacttcgttaagaaataaaattaaagccattgaagtttacagaaaatcaaaactaggtcccggatatgttcccaagcgtaagaagacagtattaattccgaaagaagatgccgaattatctgaagaaagtgnnnnnnnnnnnnnnnnnnnnnnnnattgatcgcatgtactttatgaannnnnnnnnnnnnnnnnnnnnnnnnnnnnnnatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaaaaagaataaaaagtttaacaaaaaaggggagtgaggaaaaaaaaagatcattaatataaagtaaacggcgnnnnnnnnnnnnnnnnnnnnnnnnnnnnnnnnnnnnnnnacnnnnnnnnnnnnnncnnnnnnnnnnnnnncccacaaatttttctttttttagtggggcccacaaaatatttttttctcggggggcggggnnnnnnnnnnnnnnnnnnnnnnnnnnnnnnnnnnccgtggggggcccacccatttattccttttggggaaaacccccccctttnnnnnnnnnnnnnnnnnnnnnnnnnnngggcccgcgcccgcgcccctcccccacaagtgggggcccccgggaggggggagggggggcgcccccccgggagggggcttttatnnnnnnnnnnnnnnnnnnnnnnnnntagcaaggggggggaccctaaatattttgggggggcccccttgccccc

SEQ ID NO: 6857 - DNA, 70 bp, Diabrotica virgifera
  misc_feature (6)..(31): n is a, c, g, or t
  misc_feature (35)..(68): n is a, c, g, or t
tatagnnnnnnnnnnnnnnnnnnnnnnnnnntagnnnnnnnnnnnnnnnnnnnnnnnnnnnnnnnnnngg

SEQ ID NO: 6858 - DNA, 889 bp, Diabrotica virgifera
  misc_feature (562)..(579): n is a, c, g, or t
  misc_feature (742)..(765): n is a, c, g, or t
caacaagcaggtctgtacatgaatatggacactgtcaaagatggaaatgagtcgcagccagttttagtacaaaaaatcgcttattgtgacacacatgctcctgctgataatggtgattcaaagaaagatgactcccgtaaaaagatgatccaggctcgtaaaatgctcgcaaagaaacgaacttctgctccagtaattcttattccaactattccaccggaaagaattcaagaaatcggttctttagtaactatcgccaaaaaatctcagtttatccaacgcttaatagcgtattggacgttaaaacgacaattccgtaacggtgtaccgcttttaaggcggttgcaaagcgctcagggtggcacacctcgagattcgaatacaagtaatgtggatacgttggagctatgtagacagttgaaatattggcagtgtctacgacaagatctcgaaagggctagattgctttgcgagttagttagaaaaagagaaaagattaaactagaatacgttaaagtatctgagagagtcatgcgaattaaactaaaacctttagaagctnnnnnnnnnnnnnnnnnngattccatacatgcaaaggatactaacgaaatttttactgaaccagtagatcttgaagaggtaccagattatttaacagtcgtaacagatccaatggacttaagtacaatgaggaaaaagttagatgctggggaatatccagacttatgtgctatggaaaaannnnnnnnnnnnnnnnnnnnnnnntgtttagcatataataataaggataccgttttttttacagagctgccattaaaatgagagatcagtgtggactaatattccgacaagctaaaaaaaattggaaacagcaggccttttgcccact

SEQ ID NO: 6859 - DNA, 777 bp, Diabrotica virgifera
cccaattctagtcaaaccactataacagaagaatttacagaaaaaacaactactacttacagtattaatgatgaagacattacaacagaaataaaagaagatgaaagtatgactacgacatcaacaacagatggtccaacgagcaccagtacaaaacatgtaaccaatgctagtacagaaacaattggatctgagagttctgttgatatatcttcaagcagcgttgaaacagaagaagatacagtagaaacaactactaaagagtctatgtacagtacgaatcatgaagagaatactatagaaacaaaagaagatgaaactatcatttctacatcaacaacagacaatgagaatatacccaattctagtaaaagcactataacagaagaatttacagaaaacataactattacagaaactagttacagtaccaataatgaagacaatactacagaaacaaaagaaggtgaaagtatggcctcaacatcaagaacagatggttcaactaacaccagtacaaaacatataaccagtactagtacagaaacaaacggatctgagaggtctgttgatatatcttccagtagtattgaaacagatggaaatacagtagaaacaactactacagaatctacatacagtaccaatcataatgagaatactacagaaacaaaagaagataaaactatcatttctacatcaacaacagacaatgagaatatacccaattctagtaaaagcactgtaacagaagaatttacagaaatataactatta

SEQ ID NO: 6860 - DNA, 451 bp, Diabrotica virgifera
cccccttaaggggccggcacaacgaaccaaaaaagcattgatgcccttaaaggaaggcccgccgacacgccgaggggaagaaaggccgcaggaagagaaacgcagaaagaaaaaccgcttcttctggaagatgcactgcgggatgatgcagcagcctcaaaagaatgcatggccagacagctccaatttcaaacaccgcatatatgatcggtttgagcagaggagaaacaatctaaaaaagacacggcgggttggccatgtagagctgccctagaaattgactatgcgcccacaaatcagaccacccatgtgcagccgcaagagaaccttacccaagtagatctgcacgaccatgatccggcgatatcacgtgtgtagggaaacgtaagacggaggtcacacgaatatctccaataggccttctgtcaataaatactactacatcagaaac

SEQ ID NO: 6861 - DNA, 207 bp, Diabrotica virgifera
cccacgcgtccgcttttgccggggaaaaccatattttgtccaacccatcaaaattgtacggttccattatttttgcggcactagataaaaatgcttttattttgacgtcatctttagaaagatccctgaagagtgtttcattagtggctctactaccaccaacactgaggagcacttttagaacttagaccctctgctttcgacatt

SEQ ID NO: 6862 - DNA, 785 bp, Diabrotica virgifera
  misc_feature (711)..(728): n is a, c, g, or t
tcaatcctctgttacaaaatgaataagttagcagtgttcactttattgtttgctattggtttccaatcatcagccggattccgggcggggttcagatacaatagagatgtgcaagtaatggtgcctgctggaccagtaactctagaagctcaacctgcagttcaaactctagaagctaaactaccagcagttcaaactttagaagcccgaccactatcaattcaaactctagaagcccacctaccagaaattcaaactttagaagcaagacctgaagttcaaactctagaagccagaccagcaattgcaacacttgaagctagacccgaagtttcaactcttgaattgagaccagaagtttcaacccttgaattaagtccagaagtttcaacacctgaacataaactaaccgtaaatgacaagttggctatgatcaaacaatgggttgaagaacaagctcgtcaaagtgttgttgacttagagaacaaggtcctcccagccatccaaaagttgaaggctgatgcatcccatgctattgacaccatcaaacaaaaagttaaaggtcaagaagcacaggctgaaagaacaaaaagagcgatgaagcagttaaatagacaaacaagagcgatcaaaaaacattgatgatgtcttagccccaaagacaaagattggtgtaatttttgaaacttactattatctataactgattcnnnnnnnnnnnnnnnnnngttaatgcattttaccacaattgtctcatattcttaaaataaacacagtttatcact

SEQ ID NO: 6863 - DNA, 822 bp, Diabrotica virgifera
  misc_feature (9)..(57): n is a, c, g, or t
ctgggcgtnnnnnnnnnnnnnnnnnnnnnnnnnnnnnnnnnnnnnnnnnnnnnnnnntcgtaccacacccgaactgcaatcagtactacttgtgtaatcaaggagaactacaattgcagtcatgtccaagtagtctgtactggaacgtggaccactgcgattggccagagaatacccagtgccacccagacggtagtaccttggctcctgtcgatgaggtaaccgaaagctctctggagtttcccgaagaagaagaagaaccgccagttgtggataatggcatcgacacaccttcaggtggtactgatctaagtgaacaaggaaataaagttatttgttattttacaaactgggcgtggtatagacaaggcgatggcaagtatttaccgtcggatatagatccaaatttgtgtacccacatcaactacgggtttgctgtcctggatccccattctctcacaattaaaccgcacgactcatgggctgatattgataatgaattttacaagaaagtggtagaatacaaatccaaagggataaaagttttgatagcgattggcggatggaacgactctttgggagacaaatattccagactggtaaataacccacaagctagggctaggttcgtagctaatgtcatagaattcatagagaaatatggatttgatggtttggatctcgattggggatatccaaagtgctggcaagtggactgtgaaaaaggcccgcttcagacaaacaggttttgccgctctagtgcggggattaagcttcagcttcagatctaaaggactgctattatcttccgctgtatcgcca

SEQ ID NO: 6864 - DNA, 801 bp, Diabrotica virgifera
cttcttttctcttcagtttccaattttcgtctttgtaatgtcttctagtagttagtctttccattttatttttagtctttctcttggtttgtttattactggtttccagtttgttatcctccttattagtgcgtttctttctcttctttgtatgtttccaaacatctgtctttgtgctttaataacttttactatatcttctccttcagttgtatttattatttcatggttcatctgtcttctttattctccttgttctgtctttattggccatgtatttttctcataatttttctttcaattattcttagctttcttcatctttttccataaggcacattatttccacttcatatgctattactggtctaattgctgctttatatatttgtctttgtttttttgcttagatttttgtcttgtcaatttccagtacacccgtttccccgctctaattcttttgcttatttccgcactcttccagttttgctgtcactaacacccccaagtatttaaagtaatctacccactgaaatttattttcacctaattttatttcaattattctgtttacatcatctcttgtacttattaatcattttgttttattctgattgattattattcctctgttcttttatgacacatttacatgtatctagtaactggcaccagtttcactgatatgccagtgcttgactaggatagcgctggacagctgtttacatgtatccagtcattggtgccagtgccactggcactcttattaaaaatccaaacactgcctatgaaactttactc

SEQ ID NO: 6865 - DNA, 194 bp, Diabrotica virgifera
  misc_feature (2)..(39): n is a, c, g, or t
  misc_feature (59)..(72): n is a, c, g, or t
  misc_feature (75)..(97): n is a, c, g, or t
  misc_feature (105)..(127): n is a, c, g, or t
  misc_feature (157)..(188): n is a, c, g, or t
gnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 6866 - DNA, 255 bp, Diabrotica virgifera
acttcacacaacacctttttgatgaacactttacaggaccagcctttttatcttggctacctatgggaaatatgagaggatggggtggacctttgtgtgcatcatggaacgagaggtcaatattgctgcagaaaaaaatcgttgtaactgaatgaagatagtttgaggaatacatttccagtaattgctctggtttctgcttggatatgttacctaagacgccgtttactaagaatttacccccaattgtcgtaa

SEQ ID NO: 6867 - DNA, 382 bp, Diabrotica virgifera
caactctcttgggttacgactgtctcgtaccggaacagtgttctttgaaggtggccaatagcagctgtctggacggtgcatgtcgatgcgttgacggcttcctgcagttccggaagcacacttgccttggacctgcaagacctggaaacgtatgttatagcaatgaacattgtcgcctttggactgcagacagccactgtgacttcctcatcccaaatctgtttggaagatgttcctgtaattcccctttcacaccagaaggggattcatgcgctagaactgcgttccgactaaatccacaaggcgcctaccaccgttcctacctccactactaccatgagaataccacttcgacttctactactagtgccatacccactac

SEQ ID NO: 6868 - DNA, 193 bp, Diabrotica virgifera
acgaacgacagtgcgcgaggactcgttgtccaggtaccagtcggcgtgggcaggcacggcggcagcggccagcagcaggacggccatgggctttgaacagcggacatacaacgactcttcggcggcaataaaaccctcggactgaacccttaacgccgcacatgctaacccgagccggccgccaatatcccaa

SEQ ID NO: 6869 - DNA, 298 bp, Diabrotica virgifera
  misc_feature (16)..(35): n is a, c, g, or t
  misc_feature (46)..(77): n is a, c, g, or t
  misc_feature (80)..(108): n is a, c, g, or t
  misc_feature (116)..(155): n is a, c, g, or t
  misc_feature (163)..(176): n is a, c, g, or t
  misc_feature (178)..(208): n is a, c, g, or t
cgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagactaattttactaaaatttttttattacacctgaacacaacacaacaaagaagaacaatgatattctgttgggtattagaca

SEQ ID NO: 6870 - DNA, 372 bp, Diabrotica virgifera
aagaaatgggcaaactctataaaacaccctgtaactcggatatataaagtctgtgcggcagtaaatgtagtatatctggagccgcttcagtgacctctattcatcattcgggtattttcgtttcccaatgaaacactctgtataaagaaacacgtttttttgtaaataagtttctaaaacgtttctctcgaatctaaatataccatatccgaatttctgcggtttagcgttgcattggctaaaatcggctaagtataagactaaagttattatcagatgtattaagtttattgaagttatatcaatttactttattttgaagacttaaatagtttaaggtttaagaattgtatatatttattgattaccatt

SEQ ID NO: 6871 - DNA, 846 bp, Diabrotica virgifera
gtttgtacgaactgtattatgtggaatttactttcaaatagtcgaaaatgtttacgggaggaactccaacaaaatatacctgtagtcggggaatttgatgtctcataagcccctggacaaacagtcaattacgttgtaacagattcgaagggtcatatattggcgaaaagagaagcaatttccaaaggcaaattttcttttaacacggagagttttgatacctacgaaatctgcttcatatcacaagttgctccacatatagctggtgtaactcaagaagtttccttaattaccaaacatggtatagaaacgaaaaattatgacacttatggcgaagctgcccaacttaaaccaattgagaaagaattgaaaagattggaagatctatctgatgccattgtccaagatttcgccattatgagaaaacgggaagaagaaatgagagatacaaacggcgctctatacatggagagaagaaagctaattctgttggaaataacttcttgtggagttgaattagttgttttagaaacttcagcacattcagaatctacaaacagtcgtgtactatacttctcgatattttctttgtgctgtctgatgggattggccacatggcaagttctgtacttaaggacttacttcaaggcgaagaagctcatcgaataacgagaaggaagtggtatctactacctagatttatttttgtaaaaagaactgtcacaattactgtaaaaacattgcgaagattttgtgttatttatttgtacatctttggcctgttttgtactaaataagtttgttataaaaagttcaaaacctccaaaggttttattcacactgttt

SEQ ID NO: 6872 - DNA, 583 bp, Diabrotica virgifera
  misc_feature (5)..(71): n is a, c, g, or t
  misc_feature (178)..(195): n is a, c, g, or t
  misc_feature (255)..(281): n is a, c, g, or t
  misc_feature (318)..(376): n is a, c, g, or t
  misc_feature (471)..(488): n is a, c, g, or t
  misc_feature (526)..(543): n is a, c, g, or t
  misc_feature (553)..(577): n is a, c, g, or t
gaccnnnnnnnnnnnnnnnnnnnnnnnnnnnnnnnnnnnnnnnnnnnnnnnnnnnnnnnnnnnnnnnnnnnggaataaattacctttagggataacagcgtaattttatcgtagagttccaatccataataaagattgcgaccctcgatgttggattaaagtttataattgtagaacnnnnnnnnnnnnnnnnnntgtcccaattttaaatttaaatgatctgagtttaaccgtgggggcccggggggttcctcnnnnnnnnnnnnnnnnnnnnnnnnnnnggggccccttttttaattcttttttattttacctagnnnnnnnnnnnnnnnnnnnnnnnnnnnnnnnnnnnnnnnnnnnnnnnnnnnnnnnnnnnccataaggaccaattttcccaagcgcggatgggcgtgtaaactttttttttggggtcccccttaaatttaattcccgggcccctctttacaaaannnnnnnnnnnnnnnnnnccccccgggggggccccccttataaacccctctggggnnnnnnnnnnnnnnnnnnctccaccccnnnnnnnnnnnnnnnnnnnnnnnnncccccc

SEQ ID NO: 6873 - DNA, 849 bp, Diabrotica virgifera
  misc_feature (495)..(511): n is a, c, g, or t
ctggcgggcacccccttagggggcaattataaaactgctgatcttaagaaactccccttttgagggagagacgtgataagcgacaatatccgaaaaggccggctgagagactctgctagatgaatgttatatttgtttggacagggagagtgaaggacgtgatcatgatgatagacttgatctacttaaaccagacgatggtcgtgacgatttgactaaagatgggagcgataacgctaccaaccagatggccacaagggatgcacagtgggacgtgagatgccacgacgccttatgcgaggtgggagtggtggtcacgtggggtcgagcaagcaacgctcgacgaaggccgagagccagttcctcacagaaccttcccatccttacatcgcgacgatagtggatctttccccagacacgcgcaaaatcccaggctccccttaggcgaaacgattaaaagcacatcgcgacgtcgacccaaaagtacttgattannnnnnnnnnnnnnnnnctgatagcttcgcactgaaaaacggtaattggccccttgacgatgcaagacacgttgtaaaaagagtagtgtgctccaacactgctacaacactgcgccatatctcggtacatcccttggaaggagactagatcttggccagacccgaccaaatcgggaaaaagaaagagttaattttaccaaaatataacgcgaatattacaacgaaataaccgctcacccctacgttgccatcattccggaaagaactagcactcaacccctagctgcaaaatgtttctccattaccccccaaatatggatagggccaaggaaaaaaaaatcgagaataaaatgtt

SEQ ID NO: 6874 - DNA, 795 bp, Diabrotica virgifera
caacaagtaggcccgaagtttctactcctcaacctaccacccaaactagtgcacctgaaactcaaagtaccacagtttctgtattcaccactaacgctcctttgaccaccaccaacgaacctactacacccaaagaagagtgtattgaaatagtatgtcctgaaggatttaaaagggtaccaaagaataataagtacagaaaaactagcaatagatatacatcacaaatgataaggaacaataacgttaaaacttcatacagcaagggtggtactaaaggaggcactaaaggaggtactaaaggaggataccaacctgtcaaacaaccacctaagaaatggaatctgcaaaaaccgacatacccaactaagggaggcaatcacgacctcgaacaattagtagaagaatgtatagtgtacatctgtgtaccagattggcatccaggtggtggtggtggagaaatttgtcctgatgttcagtgttccaatggattaattttagtttttgatgaatttgttaatgactgccaagaattccactgtgaactcccacccaaaccagacgcaacatgtaaagttactggaaaaactttcgacaccttcgacaatgttgaatataaatatgacatatgtaatcatgttttggctagagatttggaacatgacgaatgggaaatatcttgagaaaggcctgcaccaccacatgctctaaagaactaattattcaacatgattgggaacaattcgtcatccatcctgacttctctatcgaaaacgacggatacacctacccctt

SEQ ID NO: 6875 - DNA, 555 bp, Diabrotica virgifera
  misc_feature (493)..(513): n is a, c, g, or t
tatcaggggaaatgctggggtacgcctcgcagggcaccgggaccgagaattccacggggcccccttttgacgtccgcgatggttaggactcgttaccatgccaggttaacatttttactctccgacaccatgccaatccatttgttgatatgtccttaaggattctggaagctagagagcttaatactcaggtcacttttgctttacctagcaaccttggcacacatggccacacgtagcaaggtattacctccttgtgggagaagcacaccggaaatacctaaccgcgcacacatacacgagcccatgactcgtaattttactcagaagctgggagtgggtacatgattgcaagacataaatatagaagatattttatcaagcacgagaatcaacaacagagcactttgttatcagagacgaagtaaacgcaagagagcgaatattgaacctttcccgtgggcacgtacttagaaaaaacgacaacggttcnnnnnnnnnnnnnnnnnnnnntctccaaatgctaatttgtttctcccacggagtttcccttat

SEQ ID NO: 6876 - DNA, 786 bp, Diabrotica virgifera
  misc_feature (43)..(60): n is a, c, g, or t
  misc_feature (62)..(79): n is a, c, g, or t
ggaagtgtgaagacacaatgtgtaaagtgatatatttcttagnnnnnnnnnnnnnnnnnngnnnnnnnnnnnnnnnnnntaacggaacatttccagctaactttttatttggagtagctacttcttctttccaaattgaaggtgcgtggaacgaagacggtaagggagaaagtatgtgggatgaatataaccatcgagtgccatcaccgataaggaatggtgacacagcagatatagcttgtgattcctaccataaatataaagaagacgtcaaactagtggcagatcttggcgccgatttttataggttttcaatctcatggccaaggattcttcctactggctataccgacaacatcaatcagaaaggtatccagtactaccagaacttagtcaaagagattctgaaatacaatatggtaccaatagctactttataccactgggaacttccacaaacgcttgttgcttctaatttagactgggttaatcctgatattgttgacatttttgtaaactacacacgtgttgtaatccagaatcttccagatgtaggcctctggataaccgtaaacgaaccaaagcagatctgccatcatggctatggtgagggtaagtttgctccaggaagacacaatagcggtgtggacgactatcaatgcgactatgttgtacttaaagctcatgcgaaggcttaccatatgtataaggaggagtttccacattataaagctctaatgtcattaaccatagattgtgaatggtatgaacctttaacagattcca

SEQ ID NO: 6877 - DNA, 916 bp, Diabrotica virgifera
  misc_feature (96)..(113): n is a, c, g, or t
  misc_feature (571)..(591): n is a, c, g, or t
tggggagcggttccctcctcttcaagagggtggaaagtgttttggtcggagtaaccacgaaattggctagagggcctaattctgggcaagaatcgnnnnnnnnnnnnnnnnnncaactcaacactttttgagtaaaaattacagagaattaaaaattgagagaaagattacaccttttcggaccgttttttgcgaataccttgaaacccgtgcatctggctaaagatctatacggggcatttttgtagcttacaaaaagaaagcaaggagatttgttccttcataaatcttctggttatgatacgggaagagatatggtgggtgaggggagtttgtttttttgttgcattctcaactcggtgtattcaacttaaagaatgacagagaaacaatctgtaagcgagatatgctgcaaaaacaatcgatggctggtgcattttaggaaaaaatgagaagtttatttaaccccccattcaccggaatttgagtacatcgtttctcttctacaattaacttttactatggtgttatttctatgttcagtaagttggatgggtttgaagtgaacggnnnnnnnnnnnnnnnnnnnnntatagagcgcatttttaaattttcttaaggatcttcctttttctccacgtaactcgaaaattataagagatacgaaaaaagataccatacaaaaatggaagggtttttctagttgataactttgtttctgtttttcattattgtatcgcttatcattttcaagttacattgagaagaaggaagatttctaaggatatttgaaagtgcgctgtataatttgatcttattgtcttcagaaacagttcattttgaacccgtccaactgtttgaacatggaaatggcactattataaaaggtattgtagaaggaaagggatgcatgtga

SEQ ID NO: 6878 - DNA, 68 bp, Diabrotica virgifera
ctttgctattctttgtattgtcgaaaatattttacgcggtttataggctccatcgtgcaacccaaaca

SEQ ID NO: 6879 - DNA, 665 bp, Diabrotica virgifera
  misc_feature (162)..(181): n is a, c, g, or t
  misc_feature (590)..(608): n is a, c, g, or t
  misc_feature (615)..(632): n is a, c, g, or t
atcagcagacatcaaatcaaatctaataaacatgaactccttggtaattgtaaccattttctcctgcttggctttggcaaatgcaggcataatcgttcaaggaccaagtgccaaatctacagttgtaggtaatgatggcagtgttatttcttctgtagcccnnnnnnnnnnnnnnnnnnnngatgaacatcctggagtggttgctcacagtgccccattagttgctgcttactctcacccagtagtaaccgctcatgctgccccagtagtagctgcccactctgctcatcttgtaaatgcacatgctgccccagtagtagctgcccactctgcacatcttgtaaacccacactctgccgcagtagtatctgtccactctgctcctgttgtagctgctcacgtagctccagtagtttcagcttactcacattcagtagttgctgctccacttgtagctgctcattctgctccagttgttgctcatggagtagttgcccataaagaagttgatacagtagtagctggaccatctggaactattactactagcaaacttgttgcctctccagtcgtagttcctgcccacggannnnnnnnnnnnnnnnnnnatggacnnnnnnnnnnnnnnnnnnggtgtaagttattgaaaaataaacaattgtttt

SEQ ID NO: 6880 - DNA, 796 bp, Diabrotica virgifera
  misc_feature (7)..(27): n is a, c, g, or t
gttaacnnnnnnnnnnnnnnnnnnnnnctcacaacaaatgtacatatcgtaaaataaataatacttatctcgaactgatctacaagtatttaaaatcgcgactagaccgtcatttaatcacaacagataaaactaagcaactttttttagtaacaatgtaattatattacaaaatttaaacatcaataagtaacgaggtagtaaaattttatactaacttcaatagttttctacattttccaggttaactgtatcgtgtctttagataacattgggtttattgtattcattacgatatctggaatcatttactacttatcctagttcatcctttcatagctagcaagacggctctcaagcactattataagaccgacttcataaacaatttaataaatactgacgcttcaaaaaactttaatttttgatccacttcgttcattccactatatggtatctgaagatacataattttaacttccgtatcctaatatgtattaatataataactaattcctctaacaatccaataacattcgatcaaaaagtgatgttgatgagctgttctgccaccaaattgctcgtcctcattggatgataaaaaactacagcaaacaaaatgaccttcctcgaactatcataaaaatctgccttgttattatctacaatgattaaatttcgccacaaaattgcaatggttcttctaagcagttttttggtatttccaggttgctaaataactgcataggtaaactgctgggtagtagattgtcccccaacatcctttgtcttgatc

SEQ ID NO: 6881 - DNA, 867 bp, Diabrotica virgifera
  misc_feature (353)..(389): n is a, c, g, or t
  misc_feature (786)..(803): n is a, c, g, or t
aatttcttcaaatctacaaaaaatcttctgtagccgcaagacacttcgctgtagaaaacttcctttcgtaccgaaccttaacaactatcgccgatataaaaaaacaatttttggaacttttagtcgatataggttttgtaccagtcaatttaagtacgagaagaagattaggttgggatgatgtatacgaaattactggtccagagtttaacaggaatggagaaaacatccgtttgttatcatcaatattgtgcgctgcattatatccgaacgttgtgaagatcctaacaccatccaagtcgtatatcatgagctcggcaggagcagtacccaaagaaaacgaagccaaagannnnnnnnnnnnnnnnnnnnnnnnnnnnnnnnnnnnncatccaagctctataaactacaccgtgaggaactttcccagtccatatctagtctaccaagaaaaaatccaaaccagcaaagtattcttcagagaatgtacgatggttccggttctacctctcatactattctcctcgtatgacttgaacatcaacgttcaaggcggcaacactttcatcgtcttggaagatggttggatcgtgttccaggtagatgaacacaaaatagctgaaatgatcaaattcattaggatggagctgttcaatcttttggaggaaaaaattcgagatcctctcttaaatttgcttcatcacgatagaggagaaaaaataattgcgactatattaggaatgatcaattctcactgagagtaacaacactgccgcgtttgaaatnnnnnnnnnnnnnnnnnnccgaatgtcgtgagaacgaatctttgatttgtcaaagtttatggaaatacattaatcgttttac

SEQ ID NO: 6882 - DNA, 947 bp, Diabrotica virgifera
  misc_feature (2)..(30): n is a, c, g, or t
  misc_feature (61)..(80): n is a, c, g, or t
cnnnnnnnnnnnnnnnnnnnnnnnnnnnnncgcgaaaatttattgttaaaaggagaaccgnnnnnnnnnnnnnnnnnnnnccctatgggataggagttctctagtagtatagatctcaacttttttagtcccttgtccctgaactcgatgtgcgacaagttaataaccctactttttaaggccaaaaccaaatttgttttcatcctagatggatattgagaatgaaaatttatgaaacggttactaaaacaaggcttacgataccactccgtccttagcatgccatcattgccacgatgaataagcatgtccaaaaaaggaatcatatcagcctccctctcaactgtaaacttcaggtgttcacattgggcgttaaaggtgtttaaaacatcatttactttgttttcagggaccgataaaatcaaatcatctacatatcgcttaataaaaggtatgtgaaacagtatcttttctttacaagttgttacaagttcatccagaacaaagttacataggatgggggatattttgatgcccattggagtgccaaagatttgtttgaaaaagttaccattgaacaaaaagatgttagagtcaaatatgaatgttaaaattcttatgaaatcatctaaactgatcttgggatgcggagaaatgctgttccaggtattttttgatggtgttaagaatagcatcaagtggtaagtttgtaaacagtgacacacatctaaaataatccatataataatttattccgaactttaacattgttaatgaagtaactaaacgtggaaagaatctctaatataaaattcttggattccttggaagaaatgggagaaatattgggagggggttaccagttactatttgggagatcatgggaaaaaaaaaaggcccctttgaaacgggggttgggaatttttggaaggataaaaaccgggggg

SEQ ID NO: 6883 - DNA, 887 bp, Diabrotica virgifera
  misc_feature (32)..(52): n is a, c, g, or t
  misc_feature (364)..(383): n is a, c, g, or t
gtatattgtaaacttacaactgaaatttgttnnnnnnnnnnnnnnnnnnnnnggaaatgaagcaagaggctagcgagacaacttgtaaaatagaaacagattctgaggggtctgatggtcctttggatgccttcaaaattgatattaaagaagaacctaagagagaaagtatatatcaagcatatgattgtttagagtcaaatgtgtcatccgtaaatactaaagtagaacaagatgaatataaatttacaccatttgaagaaaaacacacaacaaatgaagaaggattcataaagtttcttgagggatattatatcattctaataaccaaaagaagaagagtggcactcattggacattacannnnnnnnnnnnnnnnnnnnacaacaatggtttacattccacatgaatctgtgagagtagtacattctgatgaatctcgttatgtgaagatgtttcagaatattgatttagctagtaatttttactacagttatagttatgatctgacccataccctccaacacaacctcacaaaccctaaaagatttgtagcaaccagcgagtcagacgaaaaagaatttaacttgagtgaaaagagcactgacaatctctcctcttctataatatccaactcatccagctcagataatggagaaacacaaaattacggagtgagaacacaacctcataataagtttgtatggaatatgcatttactaagtgatgctgtaaaagctgagctccatcctgactgggttctttatataattcatggtttcatcgaccaatctaatataaacgtatttgggcgctctatttatgtcacactgatagctaagagggcatgcagatatgctggtactaggtttttaaaacgaggtgca

SEQ ID NO: 6884 - DNA, 1226 bp, Diabrotica virgifera
  misc_feature (102)..(125): n is a, c, g, or t
  misc_feature (341)..(364): n is a, c, g, or t
  misc_feature (377)..(394): n is a, c, g, or t
  misc_feature (428)..(450): n is a, c, g, or t
  misc_feature (676)..(696): n is a, c, g, or t
  misc_feature (775)..(794): n is a, c, g, or t
  misc_feature (823)..(823): n is a, c, g, or t
  misc_feature (859)..(907): n is a, c, g, or t
  misc_feature (1050)..(1135): n is a, c, g, or t
  misc_feature (1148)..(1198): n is a, c, g, or t
gtagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgngatttatccaatgatttcccttatttacaggtatannnnnnnnnnnnnnnnnnnnnnnnnnnnnnnnnnnnnnnnnnnnnnnnngtgtaaaatttaaccttcttccctcaacattttttaggattaataagaatacctcgacgaaattcaaaatattccggatgtatttatattatgaaaaattgaatccttcaattggatccctaatttctttaattgggggattnnnnnnnnnnnnnnnnnnnnnnnnnnnnnnnnnnnnnnnnnnnnnnnnnnnnnnnnnnnnnnnnnnnnnnnnnnnnnnnnnnnnnncaattggaaaggnnnnnnnnnnnnnnnnnnnnnnnnnnnnnnnnnnnnnnnnnnnnnnnnnnngaaatttggccaaaaatttttatttctc

SEQ ID NO: 6885 - DNA, 916 bp, Diabrotica virgifera
gaaatacaagaatatggtacagataaagatgatcggactgccaaagaccgatttttgtctgaagaaaagcgtgcgctggatagaatgcataatgatatctataatgaagtgcgtcttgcggcagaagcccacagacagactcgccaacacatccagaagtggatcaaaccaggaatgactatgatagaaatatgtgaagaattggaaaatactgccaggaagctaattgctgaaaatggactgaaagctggacttgcctttcccactggatgttcaaaaaatcactgtgctgcccactatacccccaatgctggtgataagactgtatttgaatatgatgatgtggtgaagattgattttggaactcacattaatggaaggataattgattgtgcatttactcacacttttaatcccaagtatgataaattagttgaagctgtaagggatgctactaatactggtattagagcagcaggtatcgatgttcaactctgtgaaataggtgcacaaattcaagaagtaatggaatcatatgaagttgaattagatggaaaaacttaccaagtcaaatctataagaaacttgaacggccattccatatccccttacaggatacatgctgggaaaactgtaccaatagtaaaaggtggagaagcaactgtcctggaagagaatgaattttatgcaattgaaacttttcggtctactggtagaggtgttgtacatgacgatatggaatgttctcattatatgaagaattttgatgtctcttatgtggcattaagattgcagtcttcaaaatctccttctaaaattctaaacaagaacttccgtacactggctttctggaaaagggggttggaccgggctgggacaacaaaaaccaatggccttaaagggatttggggacaaa

SEQ ID NO: 6886 - DNA, 962 bp, Diabrotica virgifera
  misc_feature (879)..(893): n is a, c, g, or t
  misc_feature (895)..(910): n is a, c, g, or t
  misc_feature (923)..(923): n is a, c, g, or t
ggggaagttcatgttttttgacatctctcatatactattaataaaacttaattgatcaattgatgcaatcagatgattgcatcttcggttttagaccatgtagagctttttgtggggaatatctttttttcgtgaagtcaatgataaaagagttttccgtgtggttccaacttgcagggacgtcctgtatatgttcgtgcattggtgattattcaattgttttaattttcaatattatccaagtatgtattgttcattttaattttcaaaacgtatctaaattttatgatatactgataaatccacttggtaaatgtttgattggttttacttgcatgactgaggcactatagatatttgctgggtaataaccaaaaatttcgtttgcaaatcctacaccaatacagtaaattcgcttccaggccattgtatcacatatttaattgttcccttcaaattccagattactggaaagaaagttttcttaaacatatatttaaagatggagataaatctcttgttgataattatcgtcctattagcatcattggtgtgatacccaaagtgtttgagagtctggtttgtgacttcttaaatcctttactcgagcctaaacttatcaatcaacaatttgggtttagaacccatagatctactgagctgaacctattaacttatgtagattttttgtttgactccctggagaaagggtgtcaagttgatacaatttttacagatttctccatcgcgttcgacaggatgtctcatggtcgataagctcagaatgattggtgttgatgaaccaatgatttcttggtttagcagcagggttggcaggtttaaaccacatgcttaaagccttgggtttaaccaactggnnnnnnnnnnnnnnncnnnnnnnnnnnnnnnnaactccaaactgntgtttttattagaatctttaatacagctgccgcaaatga

SEQ ID NO: 6887 - DNA, 389 bp, Diabrotica virgifera
aaagaaaaaaaggtgagaccccagggaggcccggcgagattctcggggggccccccccgcggccggggaggaggagggatgccgatcacgatgctcgcaagagagctaacgacaatcttgacagtatatagaggagcagctgcatgtagcgccgaggagacctctttatacggttttcgtacacattaaaaccatggcgaatcacattttctgaggggggtaagaggggaatttattttcatatttttggtactgttctttggcacaccttgcatcgctccttctactacagaaaggaggcccactgtcgtaatatccgcagcataccatcaagcaccagagagccggaggatccgctgattcgtctcctagacagaactcagggctca

SEQ ID NO: 6888 - DNA, 969 bp, Diabrotica virgifera
  misc_feature (625)..(642): n is a, c, g, or t
  misc_feature (787)..(787): n is a, c, g, or t
  misc_feature (855)..(856): n is a, c, g, or t
  misc_feature (882)..(882): n is a, c, g, or t
  misc_feature (903)..(903): n is a, c, g, or t
  misc_feature (913)..(913): n is a, c, g, or t
  misc_feature (948)..(967): n is a, c, g, or t
acgaggacaaatacaaattcagcgttgtgtttgctttgaatcaaaacacattcttgtgagtcagacgaaggcgttgtgtgaaaactttgtagaatcaatatttgaatttgctcgtctaaaaatcagtgtgaattacatttaaaaatggcaattagtcggttatctatcatcaaatttttggaattggccattgccatcgcatgtattggtcttcactacaaaagcaaaaccaatgacttagacaccgacacattatcctcagcagcttttggaggatatgttattattttgataggaggatttgcaggttacctcatgagtactccattcaacaaaaggatcgacatcttcttctccctggtcggttgcgccctcttcgttgccgccggtgcattgaacattaaaatttatgacaaatacggaaaatcagaatggagagacttcggcctggctaaagcttcattggctattgtcaacggagccctattcctgttggactccctcttaacgtggagaggcgatttctaaactattttaagttgtttttaaatataaacgaacataccaacagataagttagcgatttgttaaagctacctcgattattgactaaatgtgaagcagnnnnnnnnnnnnnnnnnnggtactcccttagtccataaatatggcaaacattttggccttttatctcattttttcggaaatatgtacaattgttattaatttacaaagtaaatgaagtacaaaatattattttaacccttttaatataaagtccgagcattanagttttctttgaattaaattcattaaatcaacgtttttaagacatttataccatattttctgacaggnngagtatcaatgatgcattttttattntggatattaatgttaaccttntatcaatatngttattttcgtgttacatattttttcgtggtaaannnnnnnnnnnnnnnnnnnnga

SEQ ID NO: 6889 - DNA, 317 bp, Diabrotica virgifera
  misc_feature (174)..(211): n is a, c, g, or t
  misc_feature (225)..(316): n is a, c, g, or t
acccttagggataacagcgtaatttttatgggaaagttcaaatcgattataaagattgccacctcgatgttggattaaagttaatatttgggggagcagctttattaattaagttctgttcaactattaaaatttaacatggtttggaggttaaaaccggggtggagcaaggtnnnnnnnnnnnnnnnnnnnnnnnnnnnnnnnnnnnnnncgaaggggcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 6890 - DNA, 784 bp, Diabrotica virgifera
  misc_feature (125)..(146): n is a, c, g, or t
  misc_feature (461)..(481): n is a, c, g, or t
gaggttttgcagtttaactgtcaacttggtgcatcggtagtatctaatatatcacgttattacataaaaattctgcacgttatgcaggtttctttctgatgcaattcttatgcaatttcttttannnnnnnnnnnnnnnnnnnnnntcatcaaatacaaagagctatggtacaacaagattcgatccaatgtttttgcacaataaaccttctttgaatgggtgatgaactgtgtgggtacttgtgctcatccagtgtgttctagttttaagattctgcaagacatcaagccaatgttaagtatcttgatagatcgctaattaagacgacataataatatatgatgcatctaaccgaaatcaggaaaatcttaagatacagatagtcaaagatgacttaaaccaaatttttccataaacgattgtaattaatatttcgtgtttacggattaccatgtacttnnnnnnnnnnnnnnnnnnnnnattgagatcaagtccatgttttctacttatgtctgatatgcgaaacattattctttgcaaaccatctaagctatttgcaaaaactactgcttcgtcgacatatctatataatgtttcctagaccaggggcgtcatttgatagggcccccccccccgcggccctgaaattactgagatttacaaaaaatacatcaattttcatcattacctcatatataatgtattgtatatataatgcttgcccccccccctcaatcaaatttcaaatgacgtttctgtcctagacgcactctattctaaaac

SEQ ID NO: 6891 - DNA, 1020 bp, Diabrotica virgifera
  misc_feature (341)..(366): n is a, c, g, or t
  misc_feature (446)..(463): n is a, c, g, or t
  misc_feature (714)..(736): n is a, c, g, or t
  misc_feature (966)..(1001): n is a, c, g, or t
agttttcaaagttctctgttcatactttcgctctttttttgggcggattttcttttttttgcgatgttattactgtaccactttttgcatttccccaatctgactcgggtttgaaactaatttaatatttatcccgatatacatattgttacacttgttttaataatttttcattcattctgattttagtgaacacttctttccatatttccaaattattgaagtactttttcagtttttgcaattacatagcaccaaatcgccagtaaacacttctttcataatttctgccctttgcagatttctataccctactttcaactttttactcgttgttgcgnnnnnnnnnnnnnnnnnnnnnnnnnngtgttgagctacgtgccatttattgtaaacgtatctaatgctgaattattttattactaattacggcactgttgttttcnnnnnnnnnnnnnnnnnncatttttagttacttgttatccactcctttttctcttaatattttccacagtttctttcttggtacttaattgaaggctctttctaggtcaagaaatgctaagtatgttttctgtttcttttgcagcgtgtttcgtgttatctctttttaatatatgattctgtataatcctactacttccaaatccactatgttgttcatctaatgtgtgttccgtgattattcttaaatcgttttttattatctttttnnnnnnnnnnnnnnnnnnnnnnnaagactttttatatattacattagcaccctattctgcgggacttaatatatctattgttattaatatattcaaatcctaaaattcgattttcagaagtggaattgctgggtaaaaaactttttcccaaaatgggcttttctcccgggaatcatcccagaattaaaaggggaaaggcaagcgaaaaaacccaaacaagagcccgacggttgcctggaatgacccaatatgnnnnnnnnnnnnnnnnnnnnnnnnnnnnnnnnnnnncctaaattttccaaaacgg

SEQ ID NO: 6892 - DNA, 548 bp, Diabrotica virgifera
gtccaagtataatttacagatcacaaataatgccatggaagcaacaactccatgaaatactaaaaagacattgatactccaagattagtatatgaaacaaacaaagcatatcaaaattatttaagatatcggagaccagatagactatttcttcttttgggctttttccgcagcttttgtgacttttacggtgctgggatactttgaaggacacactgttgatgactcctactgcgaagaatagcctacatgtccggacggcaaaacggacaaggggtgggaattcatggaatggttctacacacatgggatgggcgggaacaaagtcgacaacggcgccatcaccacaattgagggcttcggcattttcttcaatgatcgtaccataaccacgaacaaccttttctttgagtttccccgaatttgtaggtagtgtgacgctgagagagaatcgaaaacaggggtatatccgctcgagatttaaccagagtggctgagaaccatgacttggacatcgaagtatgaagctcctctggtagggtagatct

SEQ ID NO: 6893 - DNA, 829 bp, Diabrotica virgifera
tttcgcgtccgaaatggttgaaagcgtagaaccaagtgtttgtttatttacgtatagttgtgaaacttcaggttcttcaactatacgtaaatggacaaatggttgaaagcgtagaaccaagtgtttggcagcaatggttaattgcacaaaaacaaaaatacaacatcgatataagcgttatagaaaactggataaatcaacaacaccaacaaatgaagttggatgttggatacttggaagggtggatcatgcaacaacaaaacgccaatgctaacttcttggtcaactggatcatcaaaagacaagttcccagtttttcataccaatggaaaatggtacgcatggtttcacaaccacaaaatagcggcactttccacgtttggatcaacaatagaagcgtagagaaagtttcccctgaggtttggaaacaatgggtcagtgaacaacaaaggaacggcatggatatgagtcttgtagagagaaacatcaaccaatggcacgaatcactgaaggtagatcttgcatatttggaagcatgggtaatgcaagaacaacaagctgactccaaatttttgtatatatggacagtcgagagaaaaatccccgctatctcttacaagtggaagatggaaagtcagagagtacaacctgtaatcacaagcagctctttacatacctacacctggaaagtacaaaagcaaacacaacaagtaggaaattaaataaacatcttatatatgatttagtcatagtcacttttgaattgacaagtcgattatgttttctttcctaatgccttgttggtaaaactttaattaatttggatact

SEQ ID NO: 6894 - DNA, 864 bp, Diabrotica virgifera
  misc_feature (66)..(90): n is a, c, g, or t
  misc_feature (335)..(375): n is a, c, g, or t
  misc_feature (419)..(439): n is a, c, g, or t
  misc_feature (459)..(483): n is a, c, g, or t
  misc_feature (739)..(763): n is a, c, g, or t
gaggaaacgagatctgcgattctttgttggtgatcgagtcttaaagcgcaattttgtcaaatccannnnnnnnnnnnnnnnnnnnnnnnngttttgccagaaatatgtcccatgtactgtctcaagggtaatatctcctttgatttatgaattaaaggacaattcgactaataagcgaattggtcaatttcatgtaaaggatttactgcctgacaacaccatggacgatgtggattcttcaacttcatcggaagaagattagcttaacagggttgtttaagctaatatcttcctgtgtttgcctttaattagttttattatggtatagtattttnnnnnnnnnnnnnnnnnnnnnnnnnnnnnnnnnnnnnnnnnatttttatccttcggcatggcttgatgatttctcacgtattagnnnnnnnnnnnnnnnnnnnnntgtaataccgcttgtatgannnnnnnnnnnnnnnnnnnnnnnnnagattgcatttgagtcattatcgacaaatattctcaaatactaatccagccagtagtattaccaagttaataacctccacttgtactcttagttttgtacccaacctctcagaataaaagggctgttgattattatatattaagatatttggatgtgtgggctcatacaagtattcttgcttaatatagatggagctatgttacactaccatatcttagattatgtgttatatcttggatatttgattacataccnnnnnnnnnnnnnnnnnnnnnnnnnatcatgtcattggatttgccatattggaaagagttgtggttgttaatttgttattgggttactttattgatatttgtcacaggtaccttaaatactttata

SEQ ID NO: 6895 - DNA, 73 bp, Diabrotica virgifera
ggaacaaaggggttcactctcaacataatttcccaaaagggaaaaaaccctttaagattttcccccccccaaa

SEQ ID NO: 6896 - DNA, 1234 bp, Diabrotica virgifera
  misc_feature (254)..(266): n is a, c, g, or t
  misc_feature (268)..(282): n is a, c, g, or t
  misc_feature (463)..(482): n is a, c, g, or t
  misc_feature (945)..(972): n is a, c, g, or t
  misc_feature (1025)..(1046): n is a, c, g, or t
  misc_feature (1066)..(1084): n is a, c, g, or t
  misc_feature (1098)..(1143): n is a, c, g, or t
  misc_feature (1152)..(1174): n is a, c, g, or t
  misc_feature (1182)..(1215): n is a, c, g, or t
atttattatttttgaatataaaggtatcatgagacatgtagtgttcccttgtttttggtttcttctcgcgtatttctaaaattttatcattaagaagcaacagtagcgatcaacaggtagcaacaaacgcggtccaagatttcggccgtaattttgaatattttgtcgagatatttattcgtaatatagtaaagaatggcgatacagagcctaatttgagaaatatgttagtatgtggaaattactctataacnnnnnnnnnnnnngnnnnnnnnnnnnnnnaaaaatacactttcttcaaataaatttttttatcccatgcctagattttgtgtcacattgaatctactaaaaatagattttatgagtataaaaatgattgtttttgatagtataatgtcactgtcagtgtggaattaccgacgcattgttgcctcaccgttaaaagttcgcagaactttcnnnnnnnnnnnnnnnnnnnnacgcgctactgtttactcttaagaatgaaaagttttgtcagaacccggttgtcaagtcataaaggtattatactcatatattagcatcttctttttcttatataagggcagtactgccctgtttttcttcatcggtgccttttattcagccccctaaattgtttctcaattttttgcttgggcgtcctatacttctttttgcctaacgatgacttgtccctggctatttcttacgatccttgattccgaaccctgcttatgtgttgattcccctcctttttttctgttctttacccaggtatttatatttattccttttaatgatatagtggaagccatttttgaaaaagatttactatttccaagtaaggaaaaataaataacggaaaaacttttatcaccttaaaaaattgcgatggacccctggttttttacaaaatctggtgaaaaacttcaaataacnnnnnnnnnnnnnnnnnnnnnnnnnnnnaaaaatttgggcttagaaaagaagggtaaaaatgacccaaaaacctaaaaatnnnnnnnnnnnnnnnnnnnnnnctcccttataaaagggtggnnnnnnnnnnnnnnnnnnnaagagaaccccggnnnnnnnnnnnnnnnnnnnnnnnnnnnnnnnnnnnnnnnnnnnnnnccacccatnnnnnnnnnnnnnnnnnnnnnnnggggctgnnnnnnnnnnnnnnnnnnnnnnnnnnnnnnnnnntgttccaaaaaaaataaaa

SEQ ID NO: 6897 - DNA, 767 bp, Diabrotica virgifera
  misc_feature (719)..(737): n is a, c, g, or t
gaaaaggcttaccatgaacaactttccgtagctgaaatcaccaaaaaggaaaccactctcaccagacccaccatctcctcagttgacacaagtatttcagtctaggctggaccatcacagaggtcagtaaaacacagataattactgcgcacaacttcaacaagtcaagatgataatgtttttgaccaaatattaattcctgagggtatagaaagtgattgataataattcatcatcccaaattacatcagattcagtaaatctgctactggatgtacaggatactacaacaagtcggcactgttaaacagccgatatcgcaaggaaagcttctttcatctgaaattttacctcaaggtgaaaaacccagaacttatttttttcttagccaggtcactcagaagctgattgctaagaatacaatagcaaaaaagactgttccaattgccaatattgtttctaagtttccagtaggaactagaaataaagttcagatcatgacgtatcattcccgttggcataattaataaacttggaacagtccttttcactattgtcttttttagaatcatttcttgctttctagtactaggcgtacctctgactaagaaaagaataagttcccggttttggaccacaaggtgaaactttcgtcggaagaatattttctttggtatatcggctttttagcactaacagttcgtggtatcctggggttnnnnnnnnnnnnnnnnnnnggtgggtaaatgacttcatacgtataacgg

SEQ ID NO: 6898 - DNA, 407 bp, Diabrotica virgifera
  misc_feature (198)..(217): n is a, c, g, or t
  misc_feature (220)..(235): n is a, c, g, or t
acactagataagagccccacatgggataccgtcttcggtaaacttagttctttgtggctcttttcttccataggccgatcagacaccagtttattccatgccaagtcctagattctatttagaattttaaactacgacggcagccaatttatgatgctattcaccggcctgggagtcgactggctaatctgaccgacnnnnnnnnnnnnnnnnnnnncgnnnnnnnnnnnnnnnncaactaaatagacatattctacccacttttttatgaatacgttctcaagttgcgtatcttcacttctgtcttgggatgccggtagagcttacgccaaagcctcttccggaccattacgttaggtgtttccgggggccggggttggaggagccgaggttttttatcgcccccc

SEQ ID NO: 6899 - DNA, 894 bp, Diabrotica virgifera
  misc_feature (86)..(116): n is a, c, g, or t
  misc_feature (201)..(215): n is a, c, g, or t
cggcaaaaacacgcttgaacttgaaatgttatgaatttgtagacacccaaaggagacgagagaggccagtattataacattctgcnnnnnnnnnnnnnnnnnnnnnnnnnnnnnnnctgttttaaaaataatgcgatactttttgtaattaatgtatttctgttaaatgggtaaacagtagataatttttattccgcggtnnnnnnnnnnnnnnntgaaacaattaaaatcaattttcttttatcacatttccagaaaattcaacaatggtacaaagacaatgtcaaaattcagttaatataaaaatagcaatttttcggacaaggaattacttagaaatgagatcttttttaaattgaaatggtaatagtactttccgtttacaaatcttaaatatagaatttaataaaacaagtcattgatatattaatagaagtgatacaattccaaaaaatgtattattaacattgtaaaaatctagccgaaactatatttaacaacaaaaaacgatatttggtagttgataacaggaaaatttatagcatttacaaatttttaatgaatagatcctttataagtgtaaaatgggctttgtaacactattattttttaaatacaactaatactccaatcgtcagagacaaaagtgccattacccctctaaaaaatcaagaacaaactgaatttttgctgagaatatcaagttttggggacccccaaaaatcttggtttcaaattataatggtattatttgtaaactacccacttgtgcttgggttgattgcttggaattaaggaaatactaaaagttcattttgaattgctatttttgtttgatttgtaaaagccattatgaaaataaatggggttatggtttttcttcccccatttttt

SEQ ID NO: 6900 - DNA, 353 bp, Diabrotica virgifera
aaaaagactcttaagaatcacggaaccctgcgtttgcagttgggttcttcacttttcttgatgctaaggtaatatatgaaacattgatatgtttactgctggtgaaatatatctcatactcattcaatccttgatctaatacttatcgtgcagcgtcgcattttgtcatgtgacgtgcaaagggtcttgtgcacacattgatcgaggatgtaccgaacagaaagacattttccaatttgtggggaacgattattggtttgtgaaccccctcaaaaccaaacgggcgtgtcccttgcaagtcaagctaccccgagtactgcacctaccgagagtttctgtgatgtaagatagcg

SEQ ID NO: 6901 - DNA, 938 bp, Diabrotica virgifera
  misc_feature (524)..(538): n is a, c, g, or t
cggaacaggtgctttgacatgcggagtatgcgactgtccaccaggaaaatcgggcaaattctgtgagtgcgaccttctcacacaaagtaaagtagaaaatgtcacaaaatgtatgaaagaaggcagtaatgaagtgtgctcaggagcaggaatatgtaaatgtgaacaatgtgtatgtaatataattcccaagagtaatgatcaaaaatatacaggaaaatactgtgaatgtgataatctatcatgtaaaagagaaaaaggtttactatgttccaacagaggtaattgtaattgcaataaatgcgactgttttcctggatatatgggagatgcgtgtgaatgtgaaacagctgtaacgaactgcagacgttctagtagtgacgatatatgttccaataatggaaaatgtgtatgtaatcggtgccaatgtgctataaaggataataagagatattctggaaaatattgtgaagattgtccgtcctgcgaagcaaagagatgtaatgaattacgtgcttgtgtcnnnnnnnnnnnnnnnaagactggaagtttaaatgcgacgtgtgctacgtcatgtacggagttccaaacacaaatcgtacacaaattggaaagtgaaggtctggaagatgttaaaaaatgtagagtcccctttaatgagtcctgcttcatacatttcgactattattatgtagaagataaactggttgtaaaagctttggaccgagaagtctgtacggggccagtggatcccttaccctggatattgggaggtattgcaaccatccttatagctggaattattatgttattgatatggaaaatagtgacttccattcccgataagcgaaaaatatgccaaattccaaaacgaacggcagaaactcaaatggggaaataatcaaaaatcacctatacaaaaatgctacttccccttt

SEQ ID NO: 6902 - DNA, 1214 bp, Diabrotica virgifera
  misc_feature (184)..(213): n is a, c, g, or t
  misc_feature (987)..(1010): n is a, c, g, or t
  misc_feature (1049)..(1126): n is a, c, g, or t
caaaattgttagatgtgaaagtagagagtaaggctgattcgtggaaaaatgattttagccgattctttcaaccacaaagtgatgaaatttcattaggcagaaaagatgaacataatgttcaaattcccttaaaactgtctcttggagttgaacaaagtggcgttaatgaggattattctcagannnnnnnnnnnnnnnnnnnnnnnnnnnnnnctttggtgggacgaagtaaaacaccaatttgtcatcttaatccacttccagaatattcagataaatacaacgcttatccaggaagttgtagagaaattttagataacgttagtaacaaaacaggaatatacacaattaagcctagaacaagcaagaaaccattttctgtcctctgcgatatggaaaccaaaggtggtggttggacttacattcaaaaaagatttgatggatctcaagagttttatctgggttataaagattataaatttggctttggtgatcttaatggagaattttggattgggctcgaaaatattcatcatatgaccggttctgaaatcaatgaacttttgattgaactcactgacagagataagaagacggcttatgcacaattcaagacctttggtataggacccgaaaaagacggatacattttaaatgtattaacaggatattcaggagatgctggggatgctctatcgcctcatctaaactcaaaatttttcaacttttgatgtagatcaagatgaaaatccaggaaattgtgctgtcattcatgagggtgcatggtggtacaaatcttgccattacagcaatttaaatgaaaaacactttaacgtaaatctttctgccacttataactatcatggtgtaaactgaaagggtttagaaggactccgtacatcctagcaagatctaaaatgatgagtcgggcagttgaggggaaagaaaaaaatcacaaagggaactatgggggaaaaaaatgaaccnnnnnnnnnnnnnnnnnnnnnnnnattaaatttttgtaaaatcattaaataatattaaccccnnnnnnnnnnnnnnnnnnnnnnnnnnnnnnnnnnnnnnnnnnnnnnnnnnnnnnnnnnnnnnnnnnnnnnnnnnnnnngctctaaaagaaacccaaggttttagtacccgcggggggggggggacccctaaaaattctttttttttataggggggctcccccaaaa

SEQ ID NO: 6903 - DNA, 464 bp, Diabrotica virgifera
  misc_feature (92)..(112): n is a, c, g, or t
  misc_feature (224)..(242): n is a, c, g, or t
  misc_feature (277)..(294): n is a, c, g, or t
ctaaattgttcctcttagtataaaattttaacttccaagaataagtgccaacaagataaaagactggagaaaagactgcgactacattggcnnnnnnnnnnnnnnnnnnnnnaactgttctgtaataatctcagtatttaaataatcatctcgtgactgtaaaatgtagctgtaaatggggatggtcttaagaaagcgctcgtttaatttttgactatagaatnnnnnnnnnnnnnnnnnnngtctaaaaatttttaacattccctgtcaatatgannnnnnnnnnnnnnnnnngaaaatactcagctaactttaaaaaccattactagtttcaactacttgtgataacgtaagttttgtcatcactcttttgtttaaataaattaatttggtgtatcaatcggtccaaagaggccctatttattgtatacgttcaagcaccataataaaatttttgtagcgtt

SEQ ID NO: 6904 - DNA, 77 bp, Diabrotica virgifera
  misc_feature (17)..(54): n is a, c, g, or t
accttaaggataacagnnnnnnnnnnnnnnnnnnnnnnnnnnnnnnnnnnnnnntgcgacctcgatggtggattaaa

SEQ ID NO: 6905 - DNA, 857 bp, Diabrotica virgifera
  misc_feature (603)..(628): n is a, c, g, or t
  misc_feature (718)..(739): n is a, c, g, or t
cggaagaacttcaacaatacatgattggcgatgaaggaagctgggccttaagtgatgggtttttggatttcgtaggacgattgctcaacgatccccaactgtctgttgacgttagagtgaagactgtcaatgttttggctatggcggccttgaaagatgacgtcatattagttctacatcaggatcgaaaggaccacgtcttgatgaactacgcttttgaaatcgacagattgagcatgccagaacaggaagcaattgctgtttttatggcgaatatgtttgagaatttgagctcttcggagtggttgctgtacatttccgaatggtcatacaacaaccaacagaccagcaacatcagggtgacgaccaaagtagcagtccactcccttttatcagactcgccagttttgcaagaccgaggctcggctattatccacaatcttgcgtgcaaggaggtaaaaaccgtggtgttcgatgacgtggccgtcgagcttaccatggctctgctgcagtatttcaactccaaaccaccagaggaacaactcttcaggtgcttaaaagcgctagccaagttcgtccaagtctccacgcaagaagtgcctnnnnnnnnnnnnnnnnnnnnnnnnnntccaagaagctttaagggtaccagcgaaaggatcgatatcctagttgatcaaatcgccgcaaaattgcggtagatgttttgtttgctccnnnnnnnnnnnnnnnnnnnnnnaaagtttattattaatgttaacgcagtgtcacgggtgctgggataaagtctattgttaaattattgaatgaaacaaatttaataatcaaaaatgtgttgtataagttgattctgacta

SEQ ID NO: 6906 - DNA, 766 bp, Diabrotica virgifera
attcgaaggctcatccagtgctctaagtttaagtagtacgttgaaacaagtccagaagagcaaagtttttgtatgccctccccatccaaataatattttagtacttttcattccatttatgtgttttttagacgaactagatcaatccataagcatcaaaaagcaaggaaatcccaatctgtatacatttttgactgagtatgtatccaatgtgtatcttaaacgaaaatctgacgaaatattggatcaaatagagacttgcattcgaaagtcagacgcttggaaggctactattctcttagatcttacatcagattacaagcctttgttagtgagtactgtaacagtggaaaggtgtatcagagaatggaaagcagtattaaaagccctacctttgtacagcgagatggtggcgggttattcatcgaaggccttaaaagaatataaagaaacctgtgatatggcatatagaagaatagtgcagccccaatctgaagatagcagaaagatttgtagtgcagcttggctcaaggatgatgatattagtcgatttttgaaatccttacccaactggctcaatctaaaggcccagcaagaataccgtgcgcgcggagaaagaaacaaaaaactgttaaagagagagcacccctcggaagaagaaagccctgaagatgttcgcatgaggaatagacgagaagctgaaatgttggccagtaatttgtgagagggaggagtttcagcaggggagtttctttcggatatgaac

SEQ ID NO: 6907 - DNA, 496 bp, Diabrotica virgifera
gtgttgtaaatttggatggaccagcattagctatatcagaggtacggcatccgactcctttaccgttaccaccaaaccaagaagcgccacctctggttgtcagacaacacgcggaaccgcctaagaaatatgtggttctaacatctcacagtgttcagatttttattaaactcaggccagttgatattctcaatcagattcttagagatagccaaggcttagatactgaagcacttaagacattttttacgattcaaaaagaggatcaggcttgcgcaacttgtttgattctggcttctttagaaagtgatgagaacgttgaggttgcagaatatgccacaagggctttctttttgtatggtggagaacctaaactggtgccagctaatatatatgcgggacccagcgtatttgctcctcaaataatatcaacacccgctccacacaattaccagacgcagcaatatcaaaccgctcaacactttcaacctaatat

SEQ ID NO: 6908 - DNA, 62 bp, Diabrotica virgifera
agtaattttattgaaaaattacaggaaaattgagaatagtcaaatacaggtgtacaatatac

SEQ ID NO: 6909 - DNA, 646 bp, Diabrotica virgifera
  misc_feature (340)..(361): n is a, c, g, or t
cttttaatactgctgttgatattaaactcagactatgggcagatacggcattaccgacacaatcggtacagtcaggttgggagactctccgaactgaatttgaaaggtttttgcaaaaagcagctgaagcacctgatcatgatgatatatttgatctacttaaacaagcagttgttaatgaggcaatggttagacatgtgtgggaaagtaaagcttccgaaatgcttagagtgattcaactcaatacattagaggataggacgataggtgataaaagggattgggatcaagcagttaagttccttgaatcaagtgttaaagaaaaacttcgggaaagcgnnnnnnnnnnnnnnnnnnnnnnagggccatccgccaaagaaagatggctttattggaaatatcaatcggagctagaaagcaaaagcagaagtgttaagaatgaactcgataaaattttgtatgctaatgaaaaacatccaccaggattaagttacgatgaattaactacaataagaaacaatcttcaacgttctagtattgaagtcgataatgaatttataagggaagttttggaattggtgtataatcgacggcatttttcctatatgcttcttttaaattagagcttattgactggggaaaagct

SEQ ID NO: 6910 - DNA, 907 bp, Diabrotica virgifera
  misc_feature (100)..(906): n is a, c, g, or t
acagtcccagccggcgattgggagcgagaattacgtttttgttcagaaattacagagaatcttttacccctcaaatagcaaatatggctgactacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 6911 - DNA, 893 bp, Diabrotica virgifera
  misc_feature (353)..(376): n is a, c, g, or t
gttatcatgaaaaatgtacgtttagtggttttttgtgtatttttgggaagtttagtaaagtgcgaaataagtaacaccaagtttttaacaacttccacaagatcgtcagtaatgagtataccaaagccagaatcgaatataccaagaacaattaaagatcaaaataaaacgttagacgtatcaacttcaaccaaaggtcccataataagacaaaatgaagtcacaactccagagagcactactcctacggaaaccaccaacacagaacctgtcgtagatttagagtgtccagaattatccaccatacccaacttaaataagtatacgcaagaggaactcatcttgctattaannnnnnnnnnnnnnnnnnnnnnnnttataaagccacctggagaacaaatagaagtatttttccgaatggatataacacatattgagtcagcagaccatttgcaactcaaagctcacattttggtccaaatgagatataaagatatccgattgagttatgctgctttgagtccaaacaaacgatttatcagaggagaagaggatttaaaagacagaatctgggcaccgcatttgattctgtctaacgagaaggaatccagtttgatgggtttaagtgataaagatatatttatacagataaacccagatggagaagttgtatatggatatagactaagtaccttattctattgctggatggacttgaagaagtttccgtttggatcgcagacttgcgatcttacatgggttagttgggcctataatgcaactgatctagctatagaatgggaaaacgatttctcatttacgataggaaaaaatcttcattttgacgagttattatagaggagagttggacagaatcgcatattttgccaaat

SEQ ID NO: 6912 - DNA, 305 bp, Diabrotica virgifera
  misc_feature (2)..(59): n is a, c, g, or t
  misc_feature (62)..(94): n is a, c, g, or t
  misc_feature (266)..(293): n is a, c, g, or t
gnnnnnnnnnnnnnnnnnnnnnnnnnnnnnnnnnnnnnnnnnnnnnnnnnnnnnnnnnncannnnnnnnnnnnnnnnnnnnnnnnnnnnnnnnntaacagcgtaatttttatgggagaggtcaaatcgaataataaagattgggacctcgatggtggattaaaggttataatttggtggagcagctatattaataaagcctggtccaccttttaaaaatttacatgatcctgggtttaaaccggggtggggccccggtgggttccnnnnnnnnnnnnnnnnnnnnnnnnnnnnccaaaaggaccc

SEQ ID NO: 6913 - DNA, 588 bp, Diabrotica virgifera
gtagtcccggtttttttggctagttcttggtgaataatctttcctattgagtcatgtcattctttacaatcatttgcgacaaacacctggcaatccccgttaaaatattggatggtttttggggttgacgtccatatcggcatttgttattttggacatgagggtctttgacgatatatttcaggtaatttttgtttggtaagttggtataagctgatcctgaatagtgactaaggaaccttcaatttcagagaacatcatttctgatgtaagccaatagttggacggtattgtcatattcctggctgatctcattgggatgtcgcccatgaagtggtttacccatccagctgcgcatttttttcttgcttagaaagataattttatgcgcgtgccatctactgtacaaatttgcgatatgtaaagcaaatagcctgtttatgcaaaaataacttcttaaagtggcaaactgtttttcccaatgctcacctatgtaaaaaattattttcaaggatacgaaccaacttaaacttcccattctataattgtttcaattttatttttctgtgctttcgctttacaataaaa

SEQ ID NO: 6914 - DNA, 203 bp, Diabrotica virgifera
  misc_feature (7)..(44): n is a, c, g, or t
  misc_feature (81)..(103): n is a, c, g, or t
  misc_feature (112)..(134): n is a, c, g, or t
  misc_feature (165)..(196): n is a, c, g, or t
taacagnnnnnnnnnnnnnnnnnnnnnnnnnnnnnnnnnnnnnntgcgacctcgatgttggattaaagtttataatttggnnnnnnnnnnnnnnnnnnnnnnntgttcgacnnnnnnnnnnnnnnnnnnnnnnnagtttaaaaccggggtgagccaggttggttnnnnnnnnnnnnnnnnnnnnnnnnnnnnnnnnaaggacc

SEQ ID NO: 6915 - DNA, 118 bp, Diabrotica virgifera
accttggggaaaggaaaaaaaatggctaaagaataatttgggggggcccagaggtggttaaactccaaattggattttccaacaccgggaaaaatccctttgaaaggttttccccccg

SEQ ID NO: 6916 - DNA, 854 bp, Diabrotica virgifera
  misc_feature (2)..(35): n is a, c, g, or t
  misc_feature (101)..(127): n is a, c, g, or t
  misc_feature (346)..(364): n is a, c, g, or t
  misc_feature (374)..(390): n is a, c, g, or t
  misc_feature (534)..(590): n is a, c, g, or t
  misc_feature (709)..(709): n is a, c, g, or t
gnnnnnnnnnnnnnnnnnnnnnnnnnnnnnnnnnnctgtacgtttattcaaatattcgtaagaacatagtcacagtaattaaaatataaaagtcaatcccnnnnnnnnnnnnnnnnnnnnnnnnnnnttcattttgtagtttttgtttatatagctatcttcaggatgctaattatcatttttttttctttgtacaaattgcattaacagagtaggtaataaatcctagatacatctatatgtcttcctgaatacagctacattgatcaatatttggagattaacctaaaacgtctaacactagaagtaatgaaacttatattgtccttactaacaaaactattgnnnnnnnnnnnnnnnnnnntcagtatctnnnnnnnnnnnnnnnnnagtattctacgaaagatggcgaagaaaaaactgttttagattatttccattagaaaaattatctagcttgtcacttgtaataagattaagttactgtaaagttgagccagaaaaaaatgcataagtccaaaatattaaattttnnnnnnnnnnnnnnnnnnnnnnnnnnnnnnnnnnnnnnnnnnnnnnnnnnnnnnnnntctaatatattttactagattttgctaaaattgcgaaaatgaaatatgcataagtccattaatgttgaacaccatatgaaatctgcacaagtccgctcttgttagtgaccaaccattanaccgtttcggtgtttttctgatgtttatacaataaaaagtctttttactgtaaacgggcgagtacctacagggtgcatattaaataacacaacagattgattactaaaacgtgaaatataattatttagggacttgtgcattttc

SEQ ID NO: 6917 - DNA, 212 bp, Diabrotica virgifera
  misc_feature (94)..(111): n is a, c, g, or t
  misc_feature (119)..(141): n is a, c, g, or t
  misc_feature (175)..(205): n is a, c, g, or t
ccttaaggataacagcgtaattttattggaaagttcaaatccataataaaaattgcgacctccatggtggattaaagtttataattggtggaannnnnnnnnnnnnnnnnntggtccannnnnnnnnnnnnnnnnnnnnnnagtttaaacccgtgggaggcaaggtgggttctannnnnnnnnnnnnnnnnnnnnnnnnnnnnnnaggaccc

SEQ ID NO: 6918 - DNA, 866 bp, Diabrotica virgifera
  misc_feature (498)..(545): n is a, c, g, or t
aaagaaagtgaaatatcgttctcccttgtgtcccaaatccctggtctttcaaaaactgcagtaatcaatgcctccttattcattttacaaacgctaaacccgcgctacaaaaagcggaaataaactaaatttaactaagtacgcgtacatgtaaaaacgtgcattcattttgaaaacgtataaaagcgggtcagcgcggtttgaccgtaagcggaaacctcttcaactgtgttcgtttacttacgatcggcactgcgtgccggtcatggtaatacttgaatcccaacctcatcacttgtcacagttgattcttgtggtatggcaatgtgcattgtcatgcattataaagttatatctaaagtgtcaccgatgaacggtgcgaacggcatgacatgttcttggagaacttcttctacgtatcttcttcaagcattcacactgtcactatcgaacacagcaagatcggtacgagcttcgttagagataccttcccaaatnnnnnnnnnnnnnnnnnnnnnnnnnnnnnnnnnnnnnnnnnnnnnnnnttttaacgcctgtagacacgaggacgtccatctggacctcttagggctattctgctctcgtctgagaacactatgttcttagtatagctctacggtgttgggggagcagctgtgtggcgcgctctgaagggaaaaaccctcaaatttctttctgctagtcttcttctaattgtacgttcactcgcactatcatttctcacctcaaaaagacgcgtacgagcttcaggagcggtgcaaaagcgatttctcagcacgttgctgacaatgaagcggctatctcgatttttagtccatagatgtcggccttgatctggcctgcgg

SEQ ID NO: 6919 - DNA, 462 bp, Diabrotica virgifera
cataagtgtatggtgcagctgttgagggtgcatctgtctatggtgcagctgttgagggtgcatttgtgtatggtgcagctgttgttggggcgtcggtggagccgccgttgcaccagtccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttctaggctgtctttgactataccacatactggcccagttttagaatcgcacgcaactaccaaacaaccgctaaagaacttttccttacccagcactacacaaggaacccaccacataaccatgattaaacgacaatggactggaagaatccgcgcaccaaaaatccccacctgtttaacaccttaagcccattg

SEQ ID NO: 6920 - DNA, 651 bp, Diabrotica virgifera
gtcctggtatgaaaactacacacttggctgctgtcctaaataatcaaggtactgtgtatgctacagaaagaaatccaagacgttttgaagttctcaataatattgttgatgcatctggagcgacatgtataaaaacttttaataaggatgtgctggattgtacaaaagctgattttcctgacgttgaatacattttagtagatcctagttgttctggaacaggaatgacagatcgtgcgcaagaaaacgaaatcacgccctcgaggttggcaagcctgactggttttcaagtaaaaattcttcgacatgcccttactaaatttccaagtgcaaaaagagttgtttattctacatgttcaataatggctgaagaaaacgaagatgttgtgcgccaagtattagaaacaaattacaattttaagctaatttcagctagtcaatttgtaagtgaaacatggcataatttcggttcctccgattatggaaatataagaaaattctgtctctatgcaaagcctgactctgattataccaatggatttttcgtaacgatctttgagagggtacaggaagctgtaaaaaatccatttttcaacaccagaatctttaattttaaaaaacatgtgcaagaaaacgaaaaatgggagttaa

SEQ ID NO: 6921 - DNA, 462 bp, Diabrotica virgifera
  misc_feature (11)..(55): n is a, c, g, or t
  misc_feature (331)..(355): n is a, c, g, or t
  misc_feature (391)..(424): n is a, c, g, or t
tttgcggccgnnnnnnnnnnnnnnnnnnnnnnnnnnnnnnnnnnnnnnnnnnnnnaagttgttgaaccaatctttttggttataagaataaatggacctaaaggatgaaagtgtttttttcttagagagtacaggataataacaaatattgctgaagagtagtggggatcaaagtgtagaataggtggatctgataagttataaaacaagaacgaatatgaacaaagtagaggaaccacttataaatggaggagagatcgaccggaccctcatctggtgtttcacggtaccagtaacaacaagcaaggagatattctgactgatatttttnnnnnnnnnnnnnnnnnnnnnnnnnacaccaaatactacaggcttgttaagagaagtccannnnnnnnnnnnnnnnnnnnnnnnnnnnnnnnnntatacgatatttttataagaatggggaagttaaacacc

SEQ ID NO: 6922 - DNA, 551 bp, Diabrotica virgifera
ccaagcatccgatgataagcccatgtgaaactcccctgatttttcactgccaccttgacaacaacattattctctgattataactgtgtccagaatcttcctggataccttcgctatatttgggtatcaaactgctatcttcgctgatatatgatctcaagtaaattaagaagaagttaatatggcattccgacaggattatgaattagagtcgaaccatcatcagtccatcatccacctatataagtcagctgagtcaatgtcacgaaaatattatactatacttaaagcaataccactttcaaagaagatcgattgaagatggaatacatatgtcatgacatcttcatgtaatacagagaaagtacatgtatgcaacgtgcattgattgcacactcgcgtagccgacggttgttcatgttttctgaatgctccgtgtcacccttgacgaatgcttgggggacgccagagtcgcctttggaacgctttgctaacctctgcctgacatcctcatgacatcctttaccggtcattttaccctcatttttcaa

SEQ ID NO: 6923 - DNA, 443 bp, Diabrotica virgifera
  misc_feature (2)..(113): n is a, c, g, or t
  misc_feature (115)..(186): n is a, c, g, or t
  misc_feature (188)..(205): n is a, c, g, or t
  misc_feature (248)..(265): n is a, c, g, or t
  misc_feature (329)..(347): n is a, c, g, or t
  misc_feature (381)..(430): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnngnnnnnnnnnnnnnnnnnncccttaggggataacagggtaatttttattggagaagtcaaannnnnnnnnnnnnnnnnngacctccaatggtgaattaaaggttaataattgggggaccagctattttttttaagttgggttnnnnnnnnnnnnnnnnnnnctggatctgaagttttaaaccgggggggaggccnnnnnnnnnnnnnnnnnnnnnnnnnnnnnnnnnnnnnnnnnnnnnnnnnngaaaaggggcccc

SEQ ID NO: 6924 - DNA, 194 bp, Diabrotica virgifera
  misc_feature (69)..(95): n is a, c, g, or t
aggttaaaaaccattggggggccccaagggggttaattccaaattggatctcaacaaggggaaaaaccnnnnnnnnnnnnnnnnnnnnnnnnnnncttttccaaaggagaaacccttttaaagtccttgtttgtggggggcggtaattatcccccaaatgacgccccgggaaacaaaaaacttcgccgcccccg

SEQ ID NO: 6925 - DNA, 69 bp, Diabrotica virgifera
  misc_feature (32)..(63): n is a, c, g, or t
tgagtttaaaccggtgtgagccaggttggttnnnnnnnnnnnnnnnnnnnnnnnnnnnnnnnngaaagg

SEQ ID NO: 6926 - DNA, 947 bp, Diabrotica virgifera
  misc_feature (36)..(64): n is a, c, g, or t
  misc_feature (104)..(847): n is a, c, g, or t
accttcttgtgacctcctctgctactaaggtcccannnnnnnnnnnnnnnnnnnnnnnnnnnnncctgaaaaccagatatattaagcatcaaaaatggcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgttgttttttgggaaagggtaaaaagtgaacgatcaattcattatttggtaatatttaaaataaaacctttaccactttggctttttattggtta

SEQ ID NO: 6927 - DNA, 1163 bp, Diabrotica virgifera
  misc_feature (139)..(160): n is a, c, g, or t
  misc_feature (388)..(451): n is a, c, g, or t
  misc_feature (453)..(614): n is a, c, g, or t
  misc_feature (617)..(634): n is a, c, g, or t
  misc_feature (636)..(782): n is a, c, g, or t
  misc_feature (784)..(843): n is a, c, g, or t
  misc_feature (848)..(938): n is a, c, g, or t
  misc_feature (1061)..(1080): n is a, c, g, or t
  misc_feature (1127)..(1153): n is a, c, g, or t
ggatcgcgtcataatattttacctgaatatcaacactagtcatgttgctgtgacgtgtctttcaggagatactgaattaataaccatatatacttcattgccaaattgtcaacagctaacaactaactatattcagagnnnnnnnnnnnnnnnnnnnnnnctctttgtaacgaactgctactcgattttacatataactactaatgtataaagtaaaatcaatttattcagtgccaatatacttatgattagatattcttatcttattaatagaaaatatgcttaagggatgagattacaagtaatattctactaaaactgactgtgtagataaatagtaggattcatcattgtcatatagtatcataagtgattattaatttcaagnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnngggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttagggataacaccgcaattttattggaaagtcaaatcgataataaagattgcggccctccatggtggaataaagtttataattgggggaaccagctaaaatattaaaacctggttccannnnnnnnnnnnnnnnnnnngacctgaattttaaaccggggggggagcacggttgggtttcttttcnnnnnnnnnnnnnnnnnnnnnnnnnnnccaaagggac

SEQ ID NO: 6928 - DNA, 922 bp, Diabrotica virgifera
aacacgaccgaaatcagtcgctttgcaaaccttttcatacagcataaacgtatattggaatctgagccagatagagcagaagaaaatattcgagattgggaagctaaattgatggaagatgaattaaaagaaaatcagcatgatcatgttgttcctcaaaatgtcgcattgcccattctttctcgaagcatgtcaaacgagtcaattgtatacaaaaagccagcaaagccacttcattttacatgtatcacgattggtacaataggtgatgctcaaccttatatcgctttatgtaagggattgatgaaagatggacatcgctgcaggatagcaacgcatgatgaatttaaagactggatagaagaacataacatagaatttagaactgtcggtggggatcctggagagcttatgagaatatgtgtagaaaataattttttcagtgtcaattttgtaagagaaggacttcgcttgctccaaggttggattgatgaactacttgaaaagactggaaagcggcttcaggcactgatattattatcgaaagtccaagtgctatgcttggcattcctatggctgacgcccttttgtaagaagaatgataaaaaataagtttgcgacttagctggcttgctttattttatccccctttactatactccgtaaggcgtcccttatttttcagcattttcctatgcccccggcccccaccccccatcatttcccttcatccttttgcaccccccatccctcccaaaggaaaccggataatgaatgcctttggcctattttatcattcctccggaagacccaaacagctcccccacccctttacaacacccccattaaaaaatccccccccagccttgtcaactcaaaatatggaaaaaccccctttcccccatcttcctctcccccccat

SEQ ID NO: 6929 - DNA, 163 bp, Diabrotica virgifera
cccccccgctacatcggagtttataaaatgaatcataaacgacgtcctttcacctatgtgtaatgaattacatgaagccgaagaagatagagggggagagactggaaattactcctctcctctttgttgctacaacaaaggtatgaagagaacggggagaaaa

SEQ ID NO: 6930 - DNA, 858 bp, Diabrotica virgifera
  misc_feature (107)..(130): n is a, c, g, or t
ccaatttttaatatgtgtaatatttacgacagatattaaccgaaaaacaatcggaatcataggatgcatatacagagtcagtgaataatattttacaataaaagtgnnnnnnnnnnnnnnnnnnnnnnnngttatgtgactgtttcttttttcgaataaagtttactgtggctgtgatagtaaaaaaacccgaaattcgtttcgaaaatatgtgataatgactacgctaggaggaagtagaagaggatctcttagtgcaaatgctggtcatgtttccaattggttttcttctttgaaaaggaccaaaaaaacgaaacataaacctgaaagaacatccaagagtgcttgggatttgacgacattgtctcatgggatcaaaagactgcaactcaaagatgacctctgtgaagttgtgtctgaaatggagtccctcgactcaggcgaggagggcaaaaatagcaacaagaccaaaatgatgtcaataggtcgaaagaagttcaacatggatcccaagaagggtattgaatatttgatagagaaaggtctgttacagaatacagcggaaagcgttgcccagtttctacataagggcgaagggctgaataagactgctattggtgattatttaggagaaaaaaacgattttaacgagcaagttttacaagcatttgttgaattacacgattttaccgatttaattttagtgcaggctttaagacaatttttgtggagttttcgtctaccaggtgaagctcaaaagatcgaccggatgatggaatgtttcgctaaacgttactgtgaatgtcagggcgaaaataactttttcgaaaattcagatacctgttacgtcctttcatt

SEQ ID NO: 6931 - DNA, 102 bp, Diabrotica virgifera
  misc_feature (4)..(21): n is a, c, g, or t
  misc_feature (67)..(80): n is a, c, g, or t
  misc_feature (83)..(95): n is a, c, g, or t
gctnnnnnnnnnnnnnnnnnngaaaatagttgggggcccaaagggggtaaatccaaatggatttccnnnnnnnnnnnnnntcnnnnnnnnnnnnnccccccc

SEQ ID NO: 6932 - DNA, 461 bp, Diabrotica virgifera
  misc_feature (109)..(130): n is a, c, g, or t
  misc_feature (421)..(441): n is a, c, g, or t
ccattttctattaccaatatcgtagattgatccaaactttttactcttttttgttctcttattttgcaacttctaacctattattatacttcagatactattttaaagnnnnnnnnnnnnnnnnnnnnnngttcgaaaaattggtgttcttactttgcctcctacaaaagacatgtatgactttgatttttcctttgcctatttggatataacaaagcctctttggctttaatttctctaccatttggcgattgttgtcactattatcgattatcctcctccctctattcatgattccctcaccaacatcgctctccgacttccttgtatgttttattttcctactttgttttgattctctctcttaactttattcattacctttttccataatctctccgctcatactaataccccccgnnnnnnnnnnnnnnnnnnnnnccgtatggcacttttgcccc

SEQ ID NO: 6933 - DNA, 163 bp, Diabrotica virgifera
  misc_feature (114)..(135): n is a, c, g, or t
ttgttttggggggggggaattaccccggattttaccccggagaaaaaaaaaccgggccccccctaatacatatttttcacaaaaggttttgttgtgtagatatcaccccccacnnnnnnnnnnnnnnnnnnnnnnttttggggaggggggggggtatcaactg

SEQ ID NO: 6934 - DNA, 469 bp, Diabrotica virgifera
  misc_feature (3)..(61): n is a, c, g, or t
  misc_feature (63)..(80): n is a, c, g, or t
  misc_feature (82)..(123): n is a, c, g, or t
  misc_feature (125)..(179): n is a, c, g, or t
  misc_feature (181)..(288): n is a, c, g, or t
  misc_feature (292)..(330): n is a, c, g, or t
  misc_feature (342)..(374): n is a, c, g, or t
ccnnnnnnnnnnnnnnnnnnnnnnnnnnnnnnnnnnnnnnnnnnnnnnnnnnnnnnnnnnncnnnnnnnnnnnnnnnnnngnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttnnnnnnnnnnnnnnnnnnnnnnnnnnnnnnnnnnnnnnnctatattattcnnnnnnnnnnnnnnnnnnnnnnnnnnnnnnnnncacaatttcattaaaaatctatttttcacaccaaaatttaggattaaaactcctccctaccctaaaaaatggtattatttatctttatatatcat

SEQ ID NO: 6935 - DNA, 967 bp, Diabrotica virgifera
  misc_feature (815)..(848): n is a, c, g, or t
  misc_feature (932)..(956): n is a, c, g, or t
gctaatatcccattccagaacccttctatggactatcgaaaagccacatcagagaggaactccggacctggaaactcgatcaactacaactatattcgtctaacacaccaggacaaaggcacataaaaaggctcataaaattgtcgcctactgcaacaaaccaccttctcgaaatgagtaagaaatgatatagaaatggtcactttccttctcactggtcactaccctctgagatatcatctgaaaaaatgggcaaatcagatattgagaactgtcgtttctgtgacaacgaaaaagaaacgtcagaacacatactatgtaactgcatagcactgttctgtaaacgactaaaattcctagaggaggtcagtatagcgccctctgacaggaaaaagtcacctagaaggctaatcaactttatcagtttatcagaagtaattagctcaaagaagaatttggagacttttaatattttctgaccgaattactgtatcgtccacgtatctaattacattaatcaactttatcagtttatcagaagtaattagctcaaagaagaatttggagacttttaatattttctgaccgaattactgtatcgtccacgtatctaattacattaagtagttcctcgttgatttttattccatatggttgtttctcaagataatttttaaataactgggccgagtaaacattgaacaatgttaggaacagaatgcaaccttgtctgaatcctcattgtatggagatttcctcgatgtagatatctcccatttttacgatagataacagtttgattccagtaggtaccnnnnnnnnnnnnnnnnnnnnnnnnnnnnnnnnnnaattttgcaatctgttgagtgccaaaaataaacaaaagaattgactttgactaaggacaagaaagattttaccccctgggaaannnnnnnnnnnnnnnnnnnnnnnnngtggggaaaaa

SEQ ID NO: 6936 - DNA, 970 bp, Diabrotica virgifera
ccacgtttcgcatccatatgttgatataggtctgactatggatttatagattttgatctttgaacttcttgttagatcttgtaagaatagacagcgatttgccgattggattctgtcttttatttcttcagtaacatcgttgtcagctgtgttacggcccccagatatttaaaaagttgtactcttttgaaattgaaggtgttgaccgtcttattttatcctatcctgtctcttcgtctctttctatttatacacatatatttcgtcttctcttcattaatcttcagccctacttcacttgttgctccttccatcttgttgaaaatgtcttttatggatagaatggagtctccaacgagatcaatgtcatctgcatatgctagtaatggcttgggaccttgaatttataacaattctgtttttatttcggccgacctcatggctttctctaatacaaggttaaaaagtactatggtgataacgcatcattctgtttgagtccactgttaatttcaaagctgtcagaagtttattatttacacgtactttagatattccatcctccataccttgtaatattatgtaatgtggttaaataaattaattcattcatacagactttggtcatccgaatgagtttctttggtattgagaactccgccatggcattccatacttggcttctttctacgctatcatatgcctgtcgaaagtctattaagagattgtgtatgggtctgttatactcccccatccccctttttctagaagctgtctcagcgtgaatagttgatctatttttgacctgttttgtccctcaaccggcttgatattcctcttaggaaatttttcagcataaggggttagtctactaagattgatgcttgagaggattttatatgcccgggtttacgaggggaaatcccctctaataatttcaaagatttttggtttttggtcccattttttg

SEQ ID NO: 6937 - DNA, 198 bp, Diabrotica virgifera
cccttcccgtccgctcgactagttccatttctttttatctcccccccttcgcacgcctcccgtcttttgtgctcttctgtgcgctatcgaaagactaatggtagtataaaaatgcattaccaaatacgaacacatatagcctccagattgttgactgaccagatggatgacgaaattcccgaattaacttctaaccca

SEQ ID NO: 6938 - DNA, 1116 bp, Diabrotica virgifera
  misc_feature (353)..(399): n is a, c, g, or t
taggccgaaatcctgcgaaaatccttgagacaggacagaggcaggaagacaggaagtgagagatgaaatcaatgcgtcacgctgattaagaaattgttaaagaaacataataagtgtctattcgctatgagccgatgagtagaaggtatttgacagctttcgccagcgctgttagtggcagttttgtgtattgaatttgaacaattttatcagaaaagtataaggttcaaaccgcgagagagcgctaccgacgaaatccacagccaataaaaacagaggtaacctctaaatttcacataaacttcttctttttctaaatggcctcttgcgtaagcagtcatccagtcgcacgnnnnnnnnnnnnnnnnnnnnnnnnnnnnnnnnnnnnnnnnnnnnnnnaattacttttactattaattctgtgtattcgttcagtaatcaggttacaataatatttcagttcataatttgtgtttttatagataaatatctgtttttctcgttttgtgtatttcacatataccaatgttatcagaaaaatacaagtttcaaaccgtgaggagcgctaccgtcgaaactcacagccaattgactcggcacaatgtatagtagagggaatttgatacctcattcgtacttttggtctgtatatcttctaaaatctttaaagaaaccatatattcagtatgcacgaacttgctcaattcaccaatgtcttaattagccactattatcctgtaacgatttaaactgactacgtgttttctcatatgcagtcgaccttacaatttataggcaatcgattcaaactacagctataatttgttgctttcgtatttttttggaacgaatacatgaagtatctggctacaaaacctgagatcaaaagacatagggggggggtttgcctttgccctggcgttttgcaaccaactcttatccctctctatcaaagaatgtttgaagaggttattggtttggacgaaaaaaagcatattttttattaaagggggggggcaaaaaaaggcaaccatttttttgaacccaacataaagggggaatttgggaaaaggtatttaaaaccgctcccaaaaaaacacacccctttttgtgttt

SEQ ID NO: 6939 - DNA, 231 bp, Diabrotica virgifera
  misc_feature (4)..(23): n is a, c, g, or t
cgcnnnnnnnnnnnnnnnnnnnnttaacaccccggccgccaagacaagaccaaactcagtcgacccgcctttacgtacaggcggaagattgcagagggaaaccgatattggaagacatagatgaaaataggaaaggcgtgaagcgacaaggatgcataccacgtaacacgtaattggtcgaagatgacgaattggaagccgatccctgcggaaactcctggcaccgtaggt

SEQ ID NO: 6940 - DNA, 892 bp, Diabrotica virgifera
  misc_feature (307)..(337): n is a, c, g, or t
  misc_feature (393)..(427): n is a, c, g, or t
  misc_feature (788)..(825): n is a, c, g, or t
  misc_feature (830)..(861): n is a, c, g, or t
ctctgtcagtctaaatggtctggctttgttagtaattcttcccttttctgtagtgtggtggaactgtttaatatttttttctattattaaatgacaaatttcttatttgtccctttggccaccatttttcttagaaagtataaagcattttggcatttatcatactagtgacatcatcgatctgggtgtgatgaggtaataagtgatttttttaaatcagaatagggggtcgtgtgctagcttatttgaaaggttattcaatcctctattcagtaatacaaacatgaacataattatttatacaggnnnnnnnnnnnnnnnnnnnnnnnnnnnnnnnacggtaacatgaatgtatgtactttatttaattcaaaatacattttgctgcagtcnnnnnnnnnnnnnnnnnnnnnnnnnnnnnnnnnnncattgttcttctcttgtttatgtggtgttcagattgtatattagtttgtgacaagtttttacagtagaatctatggcgtaaatgtagaagcctgtttctattttgctaaaaataaactcaacattatgttaatcactaatgtcactgaaaatttaagggtaggtactcatggaccagcttcttttaacggattttacaaaatttgcatcttattttatataaaaaacatgcatacaaaatttcaaacatggaaataagagtccaggtattattttctgttataaaagttctttacctttaaatatttcaaatttcccataataacatgaaaaaaaccctaatttcataataattcaaaccnnnnnnnnnnnnnnnnnnnnnnnnnnnnnnnnnnnnnngaacnnnnnnnnnnnnnnnnnnnnnnnnnnnnnnnngctttatggcaaattttttcaatggcattcc

SEQ ID NO: 6941 - DNA, 651 bp, Diabrotica virgifera
taccctcactacgagactacgcatacttaggcatttgtgttcgagagcgcgagggagatgaaggacggaagacaaagaagtactgtcgggcaccactcacgggaaaagcctgatctcttttggtgagggagtacacctcaataccccatcgacgatgctcctgcactgctttcgtggccccgccagaccaaaccactgacatagctattgaggacagtcttgaacacaagcgcgttgaaagggagcaccaacagccacgaccaggaggtatcttttcctgctgaaggtggtctcgacattgaggacttggaaaacaacctcgaaggaacttctagactcacacgaaacagaaggtggaagagggggtctggagaccttttctttaggcctacgaactgctgtcgctgctttcggccaaatgttgaaggaaacggtgaacatcctggcaagaacacggtaactaacctgggtaaagccgccttccgatattggactggaggcggacttcacaggttcaactcctagaactccccggcgccccgttgagcctaatgcctgtgagtcttttgacatccccgcccatcccaacccaccggtttttggaagtatcaacaaagccaccactgaacaagcattttttaagccggcggg

SEQ ID NO: 6942 - DNA, 88 bp, Diabrotica virgifera
ccccccttacgacggccgacagagccagccagccggcgttgcacgaatgggcctcaccggacacacgatgccatgcaacgaggaggca

SEQ ID NO: 6943 - DNA, 1030 bp, Diabrotica virgifera
  misc_feature (15)..(793): n is a, c, g, or t
  misc_feature (796)..(947): n is a, c, g, or t
  misc_feature (950)..(1012): n is a, c, g, or t
  misc_feature (1014)..(1029): n is a, c, g, or t
cttaaagatagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnannnnnnnnnnnnnnnnt

SEQ ID NO: 6944 - DNA, 801 bp, Diabrotica virgifera
caggagatacaaaaacaaaactgtttgacaacagtctatcaaagcaaggttttcttaatttttggttgtgataatcaagaaactatagcagtataatagaaactatgacacctctaacatttggcatactgactgtcagcgacacttgtcacagagattctaaaaaagacacatctggcccaagtttgaaagaagaagttctaaaaaattactcatcagttcaagtcattcaacaaatcgttccagatgaaatagaagacatcaaatcggttctattaaactggagcgatgagaagaaatgtaacgttattttgacaactggaggtactggattcgccaatagagacgttactccagaggcaactcgacaagttatagaaaaagatgctcccggtcttagctatgctatgatttcgaatagtttagccatcacgaatatggctatgctttctagggcggtttgtggtattagaggtaaaacagtgattataaatttgccaggaagcaaaaaaggggcaaccgaatgctttggtttcgtcaaaagctgtataccacatgctgtagcgctattgaccgatcaaaaagatcttgttgttttgctgcatcaaagcatacaaaccaaaggtggaggcgatggtttaggatttaccccaagcaaggtaaaaatcgataaagttgcatcaagaagtcgcaaatctccttatcccctcatagaagtaccagaagcaactcaaatagtgctaactcaatgtacccctaccgacgaaacaaaagtcgttgctttcgatcgatcagttgata

SEQ ID NO: 6945 - DNA, 427 bp, Diabrotica virgifera
  misc_feature (382)..(406): n is a, c, g, or t
cggattgtggaagtggtttgcaacaaagaaatcttcgatttcaggaaggggaggctcctgcctcccgatcatttctgactattcggtccaacaaattctttcttgtcatttgtagttgacaactcactggtagtttacccgatttttcttgctagggattttcaaaatatggcttctgtagggtgcgtggcttcaaatggtgcagatacagtcgttgtggaggagcttgaaactccgataaattagtgtctacttatacggggggacgcggaatcgagaacaaacgggctcgcgatttgttctacgtaacaggactccacattgatcgaaagaagatgaaataagcactatcacgtggccccgcaccagccccccccccagnnnnnnnnnnnnnnnnnnnnnnnnnataagggggggtgcctttgtt

SEQ ID NO: 6946 - DNA, 942 bp, Diabrotica virgifera
  misc_feature (673)..(692): n is a, c, g, or t
attttaaaatcagaacaatagacttagatgggaaaaaaattaaattacagatatgggacacagcaggtcaagaaagatttcgaaccatcacaaccgcttactaccgtggggctatgggtattatgttggtttatgatataacgaatgaaaaaagtttcgaaaatatcaaaaattggattagaaacatcgaagaaaatgcatcggccgatgtggaaaaaatgttattaggtaacaaatgtgaattaaaagacaaaaggcaagtatcgaaggagaaaggagaacagcttgccgtagaatatggtattaaatttattgaaactagtgcgaaagcgagtattcgagtagaagaagcatttttcacattagctagggatataaaaactaaaatggaaaagaagctggaagccagcaacccaccacgaggacatcaactcaaagcaacagaaccaccgaaaaaacccaccagctggctatccagatgcaccatactctgaccacttcccggagttgcttaaaaactcaaacaccgcttatcgtcataagcctacccaacaacttaccactatgcaacttcaggtgggggtgtgtttaaaactttttggacatgcctgataagagtatacttactatttttacgaccatttctcagaataaacgtcagtattgtaaatcnnnnnnnnnnnnnnnnnnnnaatacatcataaatttttttcattacaacggaatcccagcaacaaacgaacttatagtttgtatccactatcaaatttgtgtattttgcattatttgaatttttgattatttggaattttgtcgtaaataattgatcaaatgactaccatttattcattaatccttggtttttttgttaatgtggaagttaatacccaaggttttggttaaagttggaataaaattggcaaagtattttataaccccaag

SEQ ID NO: 6947 - DNA, 759 bp, Diabrotica virgifera
  misc_feature (248)..(282): n is a, c, g, or t
attaccttaaagaaatgaaacagtcggaagacttttctaatttaatgaatatgattacggaaaagttgagtgattttaatgccgaagtactgagttatgtatttttgtacttacataagttaggatttcataccgaagattttccgatggtacaaatagctgagaagataagaagggatctaattgaagaatttaatttatcaaactgcagcaaatggattaaagttatatttttagaaagtggaagnnnnnnnnnnnnnnnnnnnnnnnnnnnnnnnnnnnaaatatttaacgcaatagatgaatgtgattcagcggaacaattggcagatatttctacatgcttgactaaattgcagaacatggttactcctcaaatagtttctaagtatgcagataaagagcagaacttcatagaacataaaaaactaaccagtactgatcacaatgctattctaaaggctattacatttttaagctgtccaggatggcgaaatgagaatactattttgttgtgtaagtgtatgttgctggtgaagaatcaaattaataggttagatgctgcaagacttttggttctttatgaggtatttttccaaaacccaagagcctggcgatctgctaaacgaaaattcaaagatgtgcagcaaaatactggcagcaacacgacaaaaagcaatacctttacataacaaccccgccctacaactatttccccttctctaaatattattttcaactctccattgcatcgaatac

SEQ ID NO: 6948 - DNA, 170 bp, Diabrotica virgifera
gcatttaaaaagctttggcccaaaattttgggcctacggtcttaaaacagtgcaaaacatttaaatcgcgatagatacgttaaatataagttgtattttatacatagctttgttacagtgttatttatttttgcaacagtgtaaattcaattcaataaaaaattatatat

SEQ ID NO: 6949 - DNA, 590 bp, Diabrotica virgifera
  misc_feature (25)..(45): n is a, c, g, or t
  misc_feature (49)..(68): n is a, c, g, or t
accatttctagatctcgaccggatnnnnnnnnnnnnnnnnnnnnncttnnnnnnnnnnnnnnnnnnnntgaacaatcaatttattttttaaacgcaatacttgccgccccatatataactatcaacgcaattttctatgcatgggctgatatagagacttggacccctcctgcgtatctaaagactcaactacattaactatccctctgtcagattgaatacccctcatatttctacccaacttcttcattttcttttccagcttttccacattcggaggtagcccctttactttacctgcaccatctacagatccctgcactttaccaccatgcaagcccacaagcaatttgatgtctgtgatctctaaaccggataccaacccttcctcctaaactgcaactccaagagcatacaaactgatttcggaagcttcaacttatcccacatatgcaatacatacctcacttcctccaacagacccacagccttgtgatacaatgaaatgaatggccgtccctcttacacaacactgcatgtagaacacatagtgcagccctcatactctctaactgtatatcccgcgcgta

SEQ ID NO: 6950 - DNA, 149 bp, Diabrotica virgifera
  misc_feature (96)..(117): n is a, c, g, or t
aaaagaagaagatttcaaattttccggggcccccctttattccctttttttggggaaatttgtctttcctgggttttgccccccccaaaaacattnnnnnnnnnnnnnnnnnnnnnntaaaaaaaacggtggggggggcgcgggggggt

SEQ ID NO: 6951 - DNA, 1423 bp, Diabrotica virgifera
  misc_feature (93)..(111): n is a, c, g, or t
  misc_feature (142)..(159): n is a, c, g, or t
  misc_feature (174)..(199): n is a, c, g, or t
  misc_feature (203)..(220): n is a, c, g, or t
  misc_feature (222)..(238): n is a, c, g, or t
  misc_feature (248)..(308): n is a, c, g, or t
  misc_feature (323)..(344): n is a, c, g, or t
  misc_feature (385)..(408): n is a, c, g, or t
  misc_feature (757)..(813): n is a, c, g, or t
  misc_feature (816)..(847): n is a, c, g, or t
  misc_feature (849)..(865): n is a, c, g, or t
  misc_feature (870)..(898): n is a, c, g, or t
  misc_feature (904)..(931): n is a, c, g, or t
  misc_feature (978)..(978): n is a, c, g, or t
  misc_feature (1185)..(1213): n is a, c, g, or t
gcccccccccccaaaccacctccctcatagggaacagctggtcccgccctgcaggcaccggccccggacttcccgggcccccccttcgcgccnnnnnnnnnnnnnnnnnnncacaataaaatatctttttagcaaaagtacnnnnnnnnnnnnnnnnnngatagtcaattagcnnnnnnnnnnnnnnnnnnnnnnnnnnaacnnnnnnnnnnnnnnnnnncnnnnnnnnnnnnnnnnnctattaatcnnnnnnnnnnnnnnnnnnnnnnnnnnnnnnnnnnnnnnnnnnnnnnnnnnnnnnnnnnnnnaacataaatatcttnnnnnnnnnnnnnnnnnnnnnncgttactccgctttcacacatctccaattccttaagacacnnnnnnnnnnnnnnnnnnnnnnnnctatttataaccccccatcttcatattatcaatatcaactattttcagggatcacccttaccaataccattttattatcatctccccctcaaataaaacacaggatctcccactctcctactttataatcctgccatcattccctcctcaacaccattacctctactccccacccccctctccttcccacatcctcttaaaccccttcacactccgccaaccgccacacatcccactaccccaccacccgccgtctcaccacccccacctaacgctaaccaccccacccccgcccacccccccgccccccccgggcctcgcgacccccccccgtccctccccccctgannnnnnnnnnnnnnnnnnnnnnnnnnnnnnnnnnnnnnnnnnnnnnnnnnnnnnnnntannnnnnnnnnnnnnnnnnnnnnnnnnnnnnnntnnnnnnnnnnnnnnnnntcctnnnnnnnnnnnnnnnnnnnnnnnnnnnnntctctnnnnnnnnnnnnnnnnnnnnnnnnnnnntcagcgcccaacatccccccacaacttgaaccacccttcccctctcnaccctcgcctccataccacactctctgcccagcctctgcctttcctcccccctccccccacctcccccctccccctcacctcccgtcgcggcgaccgccctcccccccccctcctctgcccatcatccctcccctccccgctctcctcctctccccccctccccctcccctactcccccccccctcccaccgcccccacccaccatnnnnnnnnnnnnnnnnnnnnnnnnnnnnntcccgctccctccgtcccctctccccgctggcccactcccgcaccatccccccccccccttccccccatcgccccccccccttcccccccctctccccctctccccctccgccgctccagtccccccgcacccccccgcccctccccaccgcccatccatccatgcccacccactcacctatcttcacccccccccccgttcccactcct

SEQ ID NO: 6952 - DNA, 590 bp, Diabrotica virgifera
  misc_feature (16)..(28): n is a, c, g, or t
  misc_feature (30)..(89): n is a, c, g, or t
  misc_feature (91)..(125): n is a, c, g, or t
  misc_feature (134)..(154): n is a, c, g, or t
  misc_feature (169)..(236): n is a, c, g, or t
  misc_feature (242)..(298): n is a, c, g, or t
  misc_feature (308)..(335): n is a, c, g, or t
  misc_feature (445)..(463): n is a, c, g, or t
  misc_feature (495)..(535): n is a, c, g, or t
  misc_feature (549)..(578): n is a, c, g, or t
cgcggtatttttgacnnnnnnnnnnnnnannnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnngtaaaaaannnnnnnnnnnnnnnnnnnnnaagaaaaccctatannnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnccaatttttnnnnnnnnnnnnnnnnnnnnnnnnnnnnaacacccgattttttttggaaggtcaaatcgataataaaaaatgtggccccccagggtggttaaaagtttataattgggggaaccaccttatattttaatcctggttccnnnnnnnnnnnnnnnnnnnggcttgggtttaaaacgcggggggggccgggnnnnnnnnnnnnnnnnnnnnnnnnnnnnnnnnnnnnnnnnnccaagggccccacnnnnnnnnnnnnnnnnnnnnnnnnnnnnnnaatatttattat

SEQ ID NO: 6953 - DNA, 1126 bp, Diabrotica virgifera
  misc_feature (565)..(582): n is a, c, g, or t
  misc_feature (618)..(742): n is a, c, g, or t
  misc_feature (745)..(784): n is a, c, g, or t
  misc_feature (796)..(818): n is a, c, g, or t
  misc_feature (968)..(991): n is a, c, g, or t
  misc_feature (1055)..(1079): n is a, c, g, or t
gagtttatcggggatatcggaaattaacatcacaaaatgagttcagctgctaccgaaccaaaagtttgccacaagtgcaaagagcaggtcaaaggaggaaaatgcgttcaagcgatgggagtcaactggcacgaagaccatttcttgtgcgaagactgcaaaaccaaattaattggacaacaattcatggacgtcgcaggacttcctcgttgccagaaatgctacattgccaaacatgcagataagtgtaaaggttgtggcaaaccaatccctgataaggctatcgtagctttggatgctaaatggcatcaaatgtgcttcagatgttcaaaatgctcgaaacctatcatgaaggaccagtcattccaagtagatagcggcaggccccactgcgtcaagtgttaatttcagcagctatttatttcattggttatgttctagctaatgtatgatctatcgaacatggcctgtattttctacacaaacaatacaacacactctcgcaaaacgtattaaatttacacattgacaagttattattatacaaatattctatgtattatgnnnnnnnnnnnnnnnnnngagctttttatcatgttaaaaataaagttttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnggggggtgtggnnnnnnnnnnnnnnnnnnnnnnnggccccaaaaaatttatttctggggggcgctttttttaaagagggggggagggagaaaacaccggggggaactccaacttttaatccccttgtgcccaccactcccccctttctcccccggggggagaaaaagagaaaaaaagggcccgnnnnnnnnnnnnnnnnnnnnnnnnaccttcgccgcccctgaaaagggaaaagaagggcgcaccccccgcgtgggcgggtattattaannnnnnnnnnnnnnnnnnnnnnnnncttccgccagtgcaatatttttatttgtggcggaccccacacccccc

SEQ ID NO: 6954 - DNA, 153 bp, Diabrotica virgifera
  misc_feature (58)..(86): n is a, c, g, or t
caaaggacccgcctccaagagaaaaaaacccctgaataaaaggcttccaaaataattnnnnnnnnnnnnnnnnnnnnnnnnnnnnncatttccgggtgcacccttattccctctgtttggggtattttttgctttcggtgtgttggcccaccc

SEQ ID NO: 6955 - DNA, 542 bp, Diabrotica virgifera
  misc_feature (401)..(515): n is a, c, g, or t
ataatttttaagatgagtactgttattaaaatcgttttaaaatggaacggaaaagaatttaatttagaatcatcggaagatgacactgtatctgatttaaagaaaaccatagaaaatgtaacctcagtaaaatgtggaagacaaaagttgttaaatttaaaatacaaagggaaaacgcctgaagatgattgtactcttggtcttttgaaacttaaacccaactttaaactcatgatgatgggttcacttgaagaagacatagcagaagcaaatactgcacctgaaaaccttcctgatgttgtcaatgatttagatatagaggaagaggaagttgccattgaaaatcaggatgtatatctttgcaaaaaaggggggaaaaaaaaacgctttttttcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtggggtggatttcgataagggtg

SEQ ID NO: 6956 - DNA, 277 bp, Diabrotica virgifera
  misc_feature (2)..(67): n is a, c, g, or t
  misc_feature (70)..(87): n is a, c, g, or t
  misc_feature (118)..(131): n is a, c, g, or t
  misc_feature (134)..(167): n is a, c, g, or t
  misc_feature (173)..(222): n is a, c, g, or t
gnnnnnnnnnnnnnnnnnnnnnnnnnnnnnnnnnnnnnnnnnnnnnnnnnnnnnnnnnnnnnnnnnncgnnnnnnnnnnnnnnnnnngagaagaccctaaagagtttacacaattatnnnnnnnnnnnnnnagnnnnnnnnnnnnnnnnnnnnnnnnnnnnnnnnnngggggnnnnnnnnnnnnnnnnnnnnnnnnnnnnnnnnnnnnnnnnnnnnnnnnnngctttctggaccccctttttttcgataccaagaaaaaaactacccctaggggaaa

SEQ ID NO: 6957 - DNA, 112 bp, Diabrotica virgifera
  misc_feature (99)..(99): n is a, c, g, or t
catggtcgtgccatcccgcatccgtgttgacgtgttgacagattttgacacctttccgcaaaagcaaaataaactctaattttagaatttagaaattanatcgcggtttttg

SEQ ID NO: 6958 - DNA, 227 bp, Diabrotica virgifera
  misc_feature (2)..(23): n is a, c, g, or t
  misc_feature (25)..(189): n is a, c, g, or t
  misc_feature (192)..(222): n is a, c, g, or t
gnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnntgggg

SEQ ID NO: 6959 - DNA, 167 bp, Diabrotica virgifera
  misc_feature (99)..(112): n is a, c, g, or t
  misc_feature (115)..(134): n is a, c, g, or t
acgttgggggaaagataaaaaaaggcgaaagaaccagttgggggggcaccaagggggttaaaattcaaactgggttctccaccaggggggaaaaatccnnnnnnnnnnnnnncgnnnnnnnnnnnnnnnnnnnncccaagggatgaaccactttttaaaagttcttg

SEQ ID NO: 6960 - DNA, 511 bp, Diabrotica virgifera
  misc_feature (2)..(31): n is a, c, g, or t
  misc_feature (35)..(76): n is a, c, g, or t
  misc_feature (82)..(108): n is a, c, g, or t
  misc_feature (110)..(124): n is a, c, g, or t
  misc_feature (144)..(164): n is a, c, g, or t
  misc_feature (166)..(239): n is a, c, g, or t
  misc_feature (241)..(269): n is a, c, g, or t
  misc_feature (280)..(311): n is a, c, g, or t
  misc_feature (313)..(349): n is a, c, g, or t
  misc_feature (357)..(422): n is a, c, g, or t
  misc_feature (425)..(461): n is a, c, g, or t
gnnnnnnnnnnnnnnnnnnnnnnnnnnnnnncacnnnnnnnnnnnnnnnnnnnnnnnnnnnnnnnnnnnnnnnnnngcctcnnnnnnnnnnnnnnnnnnnnnnnnnnngnnnnnnnnnnnnnnncgtgctaagtaacataatcnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnncccccatagannnnnnnnnnnnnnnnnnnnnnnnnnnnnnnngnnnnnnnnnnnnnnnnnnnnnnnnnnnnnnnnnnnnngggggtgnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnncttcagggggaaaaaccgccggcaattttttttttggggaaaggctcaaa

SEQ ID NO: 6961 - DNA, 861 bp, Diabrotica virgifera
  misc_feature (17)..(93): n is a, c, g, or t
  misc_feature (111)..(123): n is a, c, g, or t
  misc_feature (126)..(242): n is a, c, g, or t
  misc_feature (261)..(393): n is a, c, g, or t
  misc_feature (398)..(433): n is a, c, g, or t
  misc_feature (451)..(471): n is a, c, g, or t
  misc_feature (490)..(556): n is a, c, g, or t
  misc_feature (578)..(652): n is a, c, g, or t
  misc_feature (673)..(772): n is a, c, g, or t
  misc_feature (783)..(828): n is a, c, g, or t
  misc_feature (830)..(857): n is a, c, g, or t
cccccccctctaacacnnnnnnnnnnnnnnnnnnnnnnnnnnnnnnnnnnnnnnnnnnnnnnnnnnnnnnnnnnnnnnnnnnnnnnnnnnnnnagcccccccccgggggtnnnnnnnnnnnnncannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattcccccccaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnacccccgcgcgcgccctnnnnnnnnnnnnnnnnnnnnnaggaaaattgggctccttnnnnnnnnnnnnnnnnnnnnnnnnnnnnnnnnnnnnnnnnnnnnnnnnnnnnnnnnnnnnnnnnnnngggggggagggagaaaacaaannnnnnnnnnnnnnnnnnnnnnnnnnnnnnnnnnnnnnnnnnnnnnnnnnnnnnnnnnnnnnnnnnnnnnnnnnnggtgggggggggaaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctgattgnnnnnnnnnnnnnnnnnnnnnnnnnnnnnnnnnnnnnnnnnnnnnnannnnnnnnnnnnnnnnnnnnnnnnnnnngtgt

SEQ ID NO: 6962 - DNA, 180 bp, Diabrotica virgifera
ataaagggaaattttcccgatttttcgggcctattggggtaaaaaaaaagggaggttggtttttaacaaacaattttaaacgcgcccaatttttaaaccaaaaatatttataccgctttaaaaattttagggggggcaactttttctccgggagaaaagggtggccgcgcggaacccccc

SEQ ID NO: 6963 - DNA, 305 bp, Diabrotica virgifera
ttcgcgtccgaaaaaaaatgattggaaagagcaatttgctagtaagacaaatggtcagaaacgccattgtcagagcttcccacgatcacggtggtgtacctggagttaaccttccctttgatattaacaacagattcaagctaacagctatgatgattgctttctttggttcaggatttggtgcaccattccttattgttagacaccaactcacaaaagcttaaattatgagtggtatgtgttagtcaagttgtatttaatttttatatgtaaataagtatttcaacaataaataaagataattt

SEQ ID NO: 6964 - DNA, 637 bp, Diabrotica virgifera
  misc_feature (7)..(38): n is a, c, g, or t
  misc_feature (45)..(62): n is a, c, g, or t
  misc_feature (187)..(206): n is a, c, g, or t
  misc_feature (402)..(424): n is a, c, g, or t
cccccgnnnnnnnnnnnnnnnnnnnnnnnnnnnnnnnnggaaggnnnnnnnnnnnnnnnnnngttagggggaaacccggggggatattttttgcaaccatttagccccggggacatgggaaaaatcaaaatgggcttttccacaatgggaagggggggtaacgaaggggttccattgatcggaaacnnnnnnnnnnnnnnnnnnnnttttaattacgaggggcttagctacctcgcccaacccaaaaacaacatcgagaacgcggggggggggggtataatcggggccaccccaaccgttaattttatccggggctctttggggatctaccggaacatcagaaggggcttctatcaaaggggggaaaaatttgaccaaagaaaaaaaatcctccccccgggnnnnnnnnnnnnnnnnnnnnnnntccatggggacggcagcagcagcatcattaggggcgattagggaattagccagtttttttccgggggcggggggattttcggaccaagcccggaatttatctttccctaattcaaaaagggcatcataaaccctacttggaatatccaccccccgccccccaaaggcaaaccaaagggcttttatttcatcaattaatgggggaggtggtttc

SEQ ID NO: 6965 - DNA, 259 bp, Diabrotica virgifera
  misc_feature (7)..(51): n is a, c, g, or t
ttggcannnnnnnnnnnnnnnnnnnnnnnnnnnnnnnnnnnnnnnnnnnnnttttgcttgttcagtttcatcgggaaattctcgcgaaatcaggcggcggcgcgcagtggacgggccacggcaacaccgtcagcgtcgaacagatggcattgggtcgggtccaggtacagctgcaaggtttccccatactggctggccatgtcgccacggacccgcaggtccaacggctcctttgctggcggtgatgacatggcaaaaa

SEQ ID NO: 6966 - DNA, 845 bp, Diabrotica virgifera
  misc_feature (14)..(14): n is a, c, g, or t
  misc_feature (161)..(184): n is a, c, g, or t
cgcccagtattatnttggagcgacaatgccacaaatttccatggggcaaaaaatgaaatgcgcgaattctatgattttttcttaaatcaaaataattcggaacagattaaggaattctgtactcaaaactccataactttcaagatgggtgttccccgcannnnnnnnnnnnnnnnnnnnnnnnaggtaggaataaagagtgtgaagtatcacctctatcgaattataggaaattcccacttcacctttgaagtgtttaacacagtattatgccaaatcgaggctattctaaattcgagacccatcactaggatgtcgtctgacgccaatgacttcgctttcctatctccagctcacttcttagttcaaagaagtttaaccgcgccccctgaaccaagtgtttcagagatacctgaaaataggttgaatctttttcagcgtattagtaaaattcaacagcaattttggaaattgtggaaaaaagactatctttgcctcctgcagcaaagaaataaatggaccgaccctactgaccctgtcaagatcggggatttggttctgttgaaggaggatggtactcctccactcttatggccaactgccagggtaatagatgtattgcctggtaaggatggtctagttcgtactgtcaagattcacactacctcacggtgattttcttcgtggtattacgaaaatcgctgtgattcccctggaagattaaaatctatccctagggggaaacttatcgttttcctccattttatcgttgttaccccttgggtatataaactctaatttcttcaaaatttcttatcgttggcacatcttttgccaatcccctc

SEQ ID NO: 6967 - DNA, 781 bp, Diabrotica virgifera
  misc_feature (3)..(323): n is a, c, g, or t
  misc_feature (325)..(494): n is a, c, g, or t
  misc_feature (496)..(578): n is a, c, g, or t
  misc_feature (604)..(642): n is a, c, g, or t
  misc_feature (645)..(707): n is a, c, g, or t
  misc_feature (710)..(722): n is a, c, g, or t
  misc_feature (724)..(744): n is a, c, g, or t
cgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnaaagaccctataaagttttttgagcnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnngannnnnnnnnnnnngnnnnnnnnnnnnnnnnnnnnnccttaaggggataacacccgtaaatttttatttggga

SEQ ID NO: 6968 - DNA, 194 bp, Diabrotica virgifera
  misc_feature (2)..(50): n is a, c, g, or t
  misc_feature (103)..(120): n is a, c, g, or t
  misc_feature (132)..(149): n is a, c, g, or t
cnnnnnnnnnnnnnnnnnnnnnnnnnnnnnnnnnnnnnnnnnnnnnnnnntattgatcatattttttgtttggggggggaagggggaggaaagaataaaaagnnnnnnnnnnnnnnnnnnttccgcgtggtnnnnnnnnnnnnnnnnnngggggagcgagggccgggaggggagaggtaaaaacacacagaagt

SEQ ID NO: 6969 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 6970 - DNA, 661 bp, Diabrotica virgifera
  misc_feature (603)..(625): n is a, c, g, or t
cgtattcctaatggatgaccgaccacgatgcatgcttaagatgacccaacaatatatcatagtatacgacttacatattagtgatacctacacactatgataatcgcacatttcatctgtattgcgtatcacaatgcttaatagctattatcatttcaatattacctctcgagaagtactatcttataattgcctcacactggatagaaataccgcatgaatacaaaaagtatggcgacaccgatcgcggaaaatgtgatctttttgtggaggtatgacgcctgatcacccaaaatgatgctccacgatgtatcctgctatggacaaaccttccctctgagagatgcattgacgacatacttgttgaaagcttgcataaagagagaaacaacaggtaccactcctaggcctcatctctctggtgactgtggtctcatttttgtatacttgtagaactgcatctgctgaactactatactgaaaggacacagaaatggaaactaacatgtctgaaaaactttatcgtcttatacacgaacactgctgtcactgttatgagtatacaatgatctgggaagtaatgaagatctggataagatcacnnnnnnnnnnnnnnnnnnnnnnncgttctatatagatgtgtgacttccttcgcctgtgc

SEQ ID NO: 6971 - DNA, 94 bp, Diabrotica virgifera
  misc_feature (8)..(86): n is a, c, g, or t
cgagaaannnnnnnnnnnnnnnnnnnnnnnnnnnnnnnnnnnnnnnnnnnnnnnnnnnnnnnnnnnnnnnnnnnnnnnnnnnnnnnggtggatt

SEQ ID NO: 6972 - DNA, 694 bp, Diabrotica virgifera
  misc_feature (75)..(100): n is a, c, g, or t
caaagaggagacgaccgactacaggcaatagctcgactcggtgtaacttaacttttaaattcgcatcttatatcnnnnnnnnnnnnnnnnnnnnnnnnnntgtctgaacaagaagcagtccccaacaacgccgtagaagaaccaaaaactgagaaagccgaaaatgcggtcgaagaaacaaaagaagtgaaggagaatgggaccggggatgtcgaacctgttgcagaggctgaaaaagaggcccccaaggagatgcgagccgtggttttaactggattcggtggtttgaagtctgtgaagattctcaagaaacccgagccttctgtgaacgagggcgaagttctgattcgagtcaaagcatgcggtttgaatttccaagatttaatggtacgccaaggagccatcgactctcctcccaaatgtccctttatcttaggtttcgaatgtgcaggagaaatcgaacaagttggtgaaggagtggaagattttgcaattggtgaccaagttgtagctttaccggaatacagggcatgggccgaattagtatcggtccccgcaaaatacgtgtacaaactacctaaggatgtgtcccacttggatgctgttaccattacaatgaactatacggtggcctatattctattgttcgagctttctggtctaactcagggaaaatccatcctaattcactctg

SEQ ID NO: 6973 - DNA, 789 bp, Diabrotica virgifera
atctgaaataatatcggtaaaagcagggaagcgtcgtccgactagatctaaccagtcaaatgctgttaacgccccggctatagaaatagagaacagacgtcataaacgtgctcttgaataccgtctgacacaaagacgatatcatactgatagatcagctctggctcatgctgtccttgacgacaagccgctctgggagaaagatgttcaccctaagatcaagacgatagagaaggaataccgcaaaatcttctccgctaggtcgccagaagatgatgaaccgatttctgatcaaaaggatcccacgaccgtgagttacgcggtcacggaagcggaaatccttggagccttacgaaccacgaaatctcaagcagccggtcctgacttttttaagatcaaacagctgcgtagggttccagtgcagaaattggttctcatctataataccatgctccagtttggtgctaccccagaggtgttgaaggagtgcaggaccactttgataccaaagggtggtgatccgctggaggtaggtaattggagacctatcacaatatcatcgatcttgatccgggtgtttcatcggatcctaggtaagcgccttgccgtgttgggctaccatgataaccagagaggatttaggcagttagatggcgttctgttgaacaacctgacacttcagacggttattcaagaaagacgtaaagcccttcgtccatacaacatattagcgatagatctaacgtaaaggcatttgacacgggcctctccacgatcccattgaacgag

SEQ ID NO: 6974 - DNA, 815 bp, Diabrotica virgifera
aatgaaatagactcaatctttgatttattaaaggaaagacgatctttaagagaatgtgtcaatacgggtaaggttccgactacagattttcatagggattatcaaccgagtttaaaaaatttattcagaagattggaagctaacggtttgaatgaaacgatggaagaatatttcttgaaaatgtcccaccacctaaaaaagatcaacaaatataagttacatcttgacgggcgacaaaatagacctgccgaaggaagacttgaaactagctcgataaacagttcagttaagagtcatatttataatttgggagatgcacaaaaaggcgattacatggccaacagactacacagaactaacacctcaggatcgatagacactaacattaactcagactggaattatagctcagaagtgttgacaagacaatcggagagtacgaattctggtggacctccttctagatccacgtccagcagaccttcatctccaccgccagatggcaacaatcactttaatagtaccgatccatcgtcgaatgtcagtttacatgaaaggtcttatattcaatatcgaaaatccaattgttatatagaattggctaatctgaaagctagacaacaagatcattattttgaagctctgaggaacaaagagtgggcggaacaagcaacctggcgtccacaattgcctcctcccggttggagattaaggggcgttttggtagctcacttacatgaacacaaaggtgcggtgaataaactatgcgtactaccagatacgccatacttttgcagctcttcttccgatggttc

SEQ ID NO: 6975 - DNA, 879 bp, Diabrotica virgifera
  misc_feature (756)..(756): n is a, c, g, or t
  misc_feature (762)..(762): n is a, c, g, or t
  misc_feature (774)..(795): n is a, c, g, or t
gttggttttaatattcaaattccaggctcatttgcatgtgtgtggaattttatctgttattgtgacagttaatagttatagaaaccaataaaagtgttgtaagattcacatggaccacagatctaattaagtctaataaaacagtttcgattatctaaataatttttttaggttcagaggtggactgggaatgaataaacacttgtatggtgatttattgaaattatagacagtatcagttgtgtaacttgtggagtaccggtgttggttagatatgtttcaatgcccttgaaattctttacgtcaaaaattactgtgtcattaaatcgtcttaatttccttataatttttctaaaacataaaatattgttgggacgctgtttatctatgccatatcctactataaaattactaccagaaagactagatatatacctaacatccaattatctctatgctaccataatttactctaacatgcttctattggattgacaacttagtaacgtaagcataaaaaaatcaaataaaatcatatgatagaggcggaagcacctgctccactgacaatgtatttcagaagaagaaatcctgccaacaaacgtttttgacaaaaaatgcatatccattgtcatgtgtaagcaagaaattccacaagattgaagaaaggaaacaacaaaacactacaagcaatccagaaacccttacaagaagggacttaagggaccctcacaagaaaaatgagaataatactanatgtanagagtttatcannnnnnnnnnnnnnnnnnnnnnaccctgtgaatgcaacaatttctacgtggcagacatcacaagaccgctaagtgtcaggagaaaaaatgaacaagaaacatacac

SEQ ID NO: 6976 - DNA, 1099 bp, Diabrotica virgifera
  misc_feature (992)..(1036): n is a, c, g, or t
  misc_feature (1048)..(1072): n is a, c, g, or t
ctttgatccagaagctgaagcccggagaagatctcacaggaatgcatatgatgaagatgatgacatgcatgggcaaggtcaaagagtacaatgtgctacaaattaaatacaattttaaactactttccaaattagagatatgttaacaaagggggacaatatatttttagaataatcagtcagcaaatacagatttttactaatataaaaccaaaaaatgtttgggagtaatattcaaggttggcattattgttaagaaattgttattagtttgtttaaatttctaaacatattgtaaagcagtattaattgtttaattcacttcgtttattgcaggctcaatccatcaagatgaattaatgtaatattgcaataagaagttttatcatagctctcaaatgacaatcatatttgtgaatatgtactgtgttgtaatattttcagtctaatctttttaatttcgttattaatctcgatttaatttgttccaattgaaatatatttgaatttatcttgaatacttatttaccagctatgcctgatatgcactattgattgaactttttattaaaaaagataaatttttcttatatttcttatctttctccaatgtaatgttgtaaaggggttacagctttttagttaaattttcaggtgttttcttatttagacttttttgtggtacaatatcttctagaatattcctataaattgtgccaaaaatttagaaatgtgacatatgaagaagtatcttgagctctgcagtctataattaaacaaaaatgcgttattgtgcctttttttcctgattggtataatttttaataaccaagggataaacttaattcccataataacgattgattctaaactaaataatgaaatcttgattctaaacccaattccctatattagtttcataataagtccatataatctggtaaatttgagggttactttaccttcaataaacttattaaaatttcaaagannnnnnnnnnnnnnnnnnnnnnnnnnnnnnnnnnnnnnnnnnnnngtaaaattaccnnnnnnnnnnnnnnnnnnnnnnnnngccccccttaatttttttggggtttac

SEQ ID NO: 6977 - DNA, 1227 bp, Diabrotica virgifera
  misc_feature (201)..(231): n is a, c, g, or t
  misc_feature (234)..(246): n is a, c, g, or t
  misc_feature (386)..(420): n is a, c, g, or t
  misc_feature (523)..(544): n is a, c, g, or t
  misc_feature (752)..(772): n is a, c, g, or t
  misc_feature (989)..(1020): n is a, c, g, or t
  misc_feature (1043)..(1066): n is a, c, g, or t
  misc_feature (1076)..(1095): n is a, c, g, or t
  misc_feature (1097)..(1122): n is a, c, g, or t
  misc_feature (1159)..(1182): n is a, c, g, or t
attggttttagtttcgttataatcttacattttagtatttgttgtttccagtggtgcacaatatacgccacgattatagtaatatacgtagtaatataagtacatcttttaattaacttgttttgatgggaaataagccacagttttaccaaaaaaatgattttattaacgtttcgatgcccaaattgggtgtcgttatcnnnnnnnnnnnnnnnnnnnnnnnnnnnnnnnctnnnnnnnnnnnnnttcccatcaaaacaagttaattgcaaaaatgccacaagaaaatagcttcagaacaacatcttttaattgtttttaagtcattatggcacaaaatatatttttctttataaacaatactttttctcatgtaaaaaatcacnnnnnnnnnnnnnnnnnnnnnnnnnnnnnnnnnnncatggaattagattccagttataaatcccaattggcttgctgagaaggaactccaagtattcgctgatgccgaataaggtttgtaacgaacaactaagtgcannnnnnnnnnnnnnnnnnnnnntctgctgttcttttagtgtattttcttgcggcgtataaagtacaccacatgtgtagttatgttataacttgatgcgcgggtagttaaaggttaattaagacatatcttttcgctccacttattgaagtattttgaaggttgccagattacagttttctggggaaagagataatgtataatgtaattcattggtgaaataaacacaagnnnnnnnnnnnnnnnnnnnnnaaacatttcaattaacggtaagagatgttatttaattcagtttggcaaaaagggaaggaatggaaatatattattgtggtttgctatgtttgatattagattacttatgtactgatttaggtttttgattgttttcttaaaaagggatggaaataattatcttttcacactcccaacaaaaattggcttattaggattatttgggggacaaatatannnnnnnnnnnnnnnnnnnnnnnnnnnnnnnnggtaacctaccggcttttttgtnnnnnnnnnnnnnnnnnnnnnnnncaaaaacttnnnnnnnnnnnnnnnnnnnngnnnnnnnnnnnnnnnnnnnnnnnnnnggtattaattattcttttttccgcgggggtaataagnnnnnnnnnnnnnnnnnnnnnnnncttgatttacaaaacaaaataaatcgatagaaaaaaacaatatct

SEQ ID NO: 6978 - DNA, 127 bp, Diabrotica virgifera
  misc_feature (96)..(108): n is a, c, g, or t
  misc_feature (111)..(123): n is a, c, g, or t
tccccccaaaaaacccctgggcggaaaagaaaaaaatgggttgaaagaaacagttggggggccaaacggggtttaattcaaatcggatcctaaacnnnnnnnnnnnnnccnnnnnnnnnnnnncccc

SEQ ID NO: 6979 - DNA, 925 bp, Diabrotica virgifera
  misc_feature (586)..(610): n is a, c, g, or t
cgcgattttctgtaagttttttttcgactttttgattggacgagatggccacgtacgctacatacagacacatcgagctcgacaaagttggatatggaaagaaaagggtttccaaccaaagcagtgaaatcttcaatgtgctatgtacccctccaagtaacaaaacaaacggccatattacaccaagaagatctctacaaagtaacgattccttcaacaaattatttggctcacccgaaaacaagagacctcaccccagaagaggatccttgactaaacaagaacgcaatccagtaaccggagaaacctacacaatcgtctcacccgctactacccccaccaaacccatgacaaacggattcacaaacggcacatccaccccttcgctgaacggaaattcgactcccttgacgaacggaaatgcacactctctgatcaacggaaatggaatccatacacctaacggaaacgtgtaaattcgaaaaatccttcttaaaaaaacaaggaatcctttagtattcatttccgatggaaacttgagtattctttgctttaatttctccacggcatgtactgaaaagtatcnnnnnnnnnnnnnnnnnnnnnnnnncagggtttataatttagttcagatttaaaaaagacgattaaatataatagaaactgttttgagtaatgttagttttaaaatacttctgatcgatagttttcttgacagaaaacatttgaaagaaagatgttgttataaaggagctagattacaactaaactctcaacataaagaacgattacattcaaaactccttttttgtctatgtggaatattgtgactgaatagataataaagaattatttataaaaagaacaacaaaaacgtgaatagaacttcttaaacaacaaataaatctatatgccaacacatatg

SEQ ID NO: 6980 - DNA, 1073 bp, Diabrotica virgifera
  misc_feature (903)..(922): n is a, c, g, or t
  misc_feature (1007)..(1024): n is a, c, g, or t
  misc_feature (1041)..(1065): n is a, c, g, or t
aatgaaggttaaaccagaactagaggaatgtaaatttgaaagcaataatatggaagtgcctatattaaaccagtctttggtggaggacattaaattagaaagccagatattaaaacatgaaactattgatccagtctatcttagtagtactatgcaagatattaaagttgaaataaaggaagaaacagaggaacttgatgtaccaatagaccataatgatgaaaaaaaaattatggaaaatgaaccaggacctccaaaaaaggtaaaatgtgattcagaaaaacaccataaactaacagaagctgaattattagctgccttggatgaatcggacgaggagatagaccccttttatgatcccagcgatcctctttatgatagtgatagcgatattgagtctgaagaagactctacagtttcctcagacatggggaatattgcaccaaatgattggagttttactgaaattccaaatcaaagtttgccgtttactaagacagcaggttttttggttgatgtaaattctgcagaaccttttgattacttccaacttctagcgacagatgatttttttaacatgttgtgtgagaaggctaacaaatatcccatcgatgtaattgcccaggactcaggaagtaaatcaagaataacgtcatggtatgatgtcaacgtaacggaaatgaaaatatttctaggtttgctttttcatatggggagtataagaatggacagaatgaatgactattgggaaataaataacctagtgtggtttccatcttttatcagctgggttccatcttttatgagctgcaatcgggttcttaatgattttccgaaagcttacagtttgaaggacactggacctagaattacgtgacttttggaaaaaattatgcccattgnnnnnnnnnnnnnnnnnnnngaatgatgcaaatatactatccccacggggaactctgtatcaacaaatccatggcctttggggaaaggccggggaaaaatttccnnnnnnnnnnnnnnnnnnggctccaattttgggcnnnnnnnnnnnnnnnnnnnnnnnnngggggggg

SEQ ID NO: 6981 - DNA, 919 bp, Diabrotica virgifera
  misc_feature (761)..(761): n is a, c, g, or t
tgcaaccgcaagtactgttttatttaaagtcgctgaaattgtacaagcaatatattattctacgcgtcttagcaagacgaaaattgccacaaaagtacattataaagtgcgatcgtagcggtggcgtttcatgttcccaaagttatacagaaaactttgaactatgcagattttggaaataaggagtacaatagtttcattactacaactaaatgccccagaccaaaggcgaaccagaagaaagttaaggctgttacaagcctcttcagattcttaaatgaagattatgtaaacttcaatgaaatgttgaatggatagtttaataattgtaaaaattgtttaaattgtattatgtaatgtattataaaagtatttaattctataatgcttcttgttcttcacatgcaaattaattgtaatcaaaattcccctgttctatgtaaaaagggcttataacagctttttctgtttcctaatttttaaacataagcttcatttttattgatttcatattttagaaaattactttctagaacaatatttttaatctataatgagcattctcaatttgtaaacaacaaactagtatctatagcaacaagttaaaatttcaaagtggtttttctcaaaacccatttttgtcgtatgtgcccttctcacgtagacagcctcaattggtcttttaatttgattattaagattattcttattgaattgaaatacttattgaattatcaaagatattaactaatattcacggncaaaaaactgaagaatcgatagaagatagaagtgggtaatcaatcgttcgaatttgtctatgttttttaacttgtctttctttatttataaaagtagcacagattattggaacaaagtttagagacagcaccttgaatcatctaattaaacactttct

SEQ ID NO: 6982 - DNA, 515 bp, Diabrotica virgifera
atccaaagcagctccagcacatccacagatatgagcacccagggatggacaagtcgacagaattgttggtttagatccagctggttctctcttctctgaatagaggacagacaaccgtattgacgctagtgatgcagagaatgtccaaattattcacacgaatggaggaaagatgggatatttggctccatgcggagactctgacttctatccaaatggaggaaaatcacaaccaggttgtggatttgatttaggtggcggttgtgctactctaggtcatacgcaatatatgccgaatcattgactagcacaggatttgttggacagcagtgcaatagttatgaggaatatcagaagggtaaatgtaccggaccaaaagctagcatgggaatgttccatattgataaaatggcctctggttcctactaccttaaaacacacagcaaatctccattccataaaggataaagatgtttattgtactacatagttaaataaacaataaaatctaacgt

SEQ ID NO: 6983 - DNA, 929 bp, Diabrotica virgifera
aatgaaggccctcttcgtaatgtgactgttaatacattttacctcgataaatatgaagtgtcgaaccaacaattttatgattttgttaaaaaaacagggtataaaacagaggctgaagtttttggagatagttttttatttgaaatgtgccttcctgaaaaagaacgaaaaaaatatgaagatatcagagctgctcaagccccatggtggataaaaatgagtggagtgtcttggaaacatcctgaaggaccagattctacaatagaaggtaaaatgaatcatccagtgattcatgtctcctggaatgatgctgttaagtattgtgaatatttgggaaaaaggttgcctacggaagctgaatgggaactggcctgtagagggggattgaaacaaaaattgtatccttggggaaacaaactgcatccaaaaggacagcattgggccaacatttggcaaggagagtttcctcatactaatactgctgaagatggttttgtatttaccagccccgtggattcgtttcctgcaaacaaatatgggctttataatatggctggaaatgtttgggaatggacacaggataattggaaaaatgaccctgatacaaaggtgaagaaaggaggatcgtatttatgccatgagtcctattgttggcggtacagatgtgccgcccgttcatctaatacaaaagatagttctgcctcgaatttaggatttcgttgtgcggctgacaaaatatagatcaattattaccgttcgtatctacttaaaattgtattaagtgtttaaaaaaatcacaaaatagtgcagaatagaagaaaagaccagattataaatctttaatggtcttatattcggattttacatatcgaacagtttcgactatgtatactggaccatatgaacaggcgatagaacccatacaccac

SEQ ID NO: 6984 - DNA, 771 bp, Diabrotica virgifera
  misc_feature (31)..(50): n is a, c, g, or t
gttaattttaaaccgccatttagcatttagnnnnnnnnnnnnnnnnnnnntgctacaaaatatacacctacaccaagaaaattaagaagagaaaaaaccacagtctctacatccagctcagattcagaaaaagatcctgttcatgtatattgtagactgcgcccccttagagactccgatacaaatacttgtatgaatctgttgtctccacaagaaatttgtgtgtccagtgaatctaaaggtgttagaagagatatatcctacaaatttagacatatttttactgcctattcttcacaaaaagaagtttttgaccatgtagcttatcctttactggacgaccttttgaaagggaaaaatgggatattgtttacctatggagtgacgggctctggaaaaacgtatactttaacgggtgatcacaataacccaggaataatgcccagatgcatcaacaccatatttaactccgttggtgaatttcaaacaccaaaattcattataaaatcagacagaatgaatggttttgaaatacaaactgaagaagatgccacgcaagacagattatcagaaaatcgatttaattctaagactcctaaaagtgctaggaaagtcaatggtgataaaggatttaccaatgatggcaacagaatccctgttttaaacgagatgaatgcctatgcagtatttatttcttatgtagaaatatacaataacaatgtttgtgatctactggatgattctactagtgggaaaacttttccaaacaaa

SEQ ID NO: 6985 - DNA, 663 bp, Diabrotica virgifera
aacctatcatattcgtttattgaactaatgaagctcactggaccattgtggtgtaacatggctaccaatgctgataggtctgcctgatccctctttgacagaccacaagagatggcctgcatgccccaaggacatgacaaagctgtattttacgtatctcttcaatatatcaccgagcaccaccaaagtgatgaaaatcagactgtgtctctattagaaaaataagctgaagacaggtgcaagtccggcgaaccctatttcccttcctccattgatgtgatatattaggagttaagatagagtacgaggaatttgtctcttttctctgccaattctcagaaaaattgctgctactactgattaccatttacataatcttgcgccaccatatatgatcttcatcgtctctgctgaatatacgatacaccgatgtgaatccttacttgatacactatgctcttatcggagcattgtgcatagaactgatacccacaacgtcaacttgacatccttcattaggtcatgccccgacctgtatatccatcgtaaataattcctacagggtagggatcaaatgaacctagggtctaccacttcacggacacccattgaaataccaagacatttcactgcctcctacctgtaaccagaacataaattatg

SEQ ID NO: 6986 - DNA, 528 bp, Diabrotica virgifera
  misc_feature (267)..(285): n is a, c, g, or t
gggcacgcgtggggggaccggcgcggaattcgcggcccccccctcgcccccggggcctcataggtacataggacggacaaccccacaacgagttttaaggtgagtgcgtataggatggatcctggccttacaaaagtatgtaaaaggatacacgatcttattgaattttgagatccttcgtgcttgtctcgaggaatacgtacgacaaggtcatacaaaggccactaggattgcaatacattagaactaaatccaccttatggagcnnnnnnnnnnnnnnnnnnntaaaactctatttttggatatgagatagctagctcgagacttttgacaatgacatctgaagatatatattagacgggatacttaaagtagaatgctatacgccagaaacttagccttgtgttaaatcagttgttcctgtcagcagtttttctcggagtgcttttttgcttcggtgttctgcgaagtctgtctatctggactatatcgatactccgttaaactaggtgtccggtcacagcgcta

SEQ ID NO: 6987 - DNA, 61 bp, Diabrotica virgifera
  misc_feature (21)..(40): n is a, c, g, or t
ccccccccccctgataatcgnnnnnnnnnnnnnnnnnnnncaatttaagtgtttatgaccc

SEQ ID NO: 6988 - DNA, 424 bp, Diabrotica virgifera
cctttttcacacgatagtaagaagtgtctgagcgagaatacattatgtattgtactttttaaatatgcgacttttgtaacatcaatttcattgtaaaatatcatcatcattgtttttatggacctacgtgacagtaggattcgagacacctgacaagacttctcttcctgctgtgtatacgcacctttacaaacatcctgctggcctaattgtagtcctgtaagggacatcctttgttgggcatggagtttgtttgtgggaattgtattgactactattatatacctacttttattattaaggcatttgaaatcgtaaactaaaattggttgtttatattttatatgagtatttttagtagtagataagatttcaattgcaaaactacctatgtatgtattcattagaaataaattcttattcc

SEQ ID NO: 6989 - DNA, 767 bp, Diabrotica virgifera
  misc_feature (3)..(16): n is a, c, g, or t
  misc_feature (21)..(568): n is a, c, g, or t
  misc_feature (575)..(612): n is a, c, g, or t
  misc_feature (632)..(645): n is a, c, g, or t
  misc_feature (648)..(670): n is a, c, g, or t
  misc_feature (678)..(700): n is a, c, g, or t
  misc_feature (735)..(761): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatnnnnnnnnnnnnnnnnnnnnnnnnnnngaaagg

SEQ ID NO: 6990 - DNA, 1149 bp, Diabrotica virgifera
  misc_feature (58)..(80): n is a, c, g, or t
  misc_feature (125)..(143): n is a, c, g, or t
  misc_feature (168)..(183): n is a, c, g, or t
  misc_feature (185)..(209): n is a, c, g, or t
  misc_feature (225)..(245): n is a, c, g, or t
  misc_feature (296)..(317): n is a, c, g, or t
  misc_feature (634)..(672): n is a, c, g, or t
  misc_feature (757)..(771): n is a, c, g, or t
  misc_feature (773)..(794): n is a, c, g, or t
  misc_feature (796)..(839): n is a, c, g, or t
  misc_feature (865)..(907): n is a, c, g, or t
  misc_feature (977)..(1004): n is a, c, g, or t
  misc_feature (1013)..(1051): n is a, c, g, or t
  misc_feature (1063)..(1113): n is a, c, g, or t
ttaaacccttatttaatcccttttatatggggggttatggcccgagaaaaaataaccnnnnnnnnnnnnnnnnnnnnnnnccgcggttccacccccaaaaattacaatttttggaggacaaaagnnnnnnnnnnnnnnnnnnntttttgatttcaggtcttttccctnnnnnnnnnnnnnnnncnnnnnnnnnnnnnnnnnnnnnnnnnttcctttcccactttnnnnnnnnnnnnnnnnnnnnngggaatatactggggcggaagaaaaacggttttaatattacatggccatcnnnnnnnnnnnnnnnnnnnnnngggcagcaccttttggccttttgagaaaaactggttaaaattttaaaaccatattaccccctccgggccccccccactttcataaataatggccttattgaaaccctttggggatcccggtggaccccttggggaaatattttaggtattaaccaaatttctataaaccccccccccgctggcgcccccctcggtggtgaaacctttatttaaaaccccccccttttccccccccggaataaccttgtcataaatggttggtttttccccaaatttccccccattttggtttttttcccggggaatcccctttgggnnnnnnnnnnnnnnnnnnnnnnnnnnnnnnnnnnnnnnnaggggggaaaaaaggattagaagaaccccgcactgttcaaaaaaaccccatcttaccatttttgtggaatggaaattttcttgtnnnnnnnnnnnnnnncnnnnnnnnnnnnnnnnnnnnnntnnnnnnnnnnnnnnnnnnnnnnnnnnnnnnnnnnnnnnnnnnnngggcgcaaatacaacccccccccgcnnnnnnnnnnnnnnnnnnnnnnnnnnnnnnnnnnnnnnnnnnnggagaaattttttttaatatgtttgggtgtcttccacatgacaaacatatatattgaccccttagagacnnnnnnnnnnnnnnnnnnnnnnnnnnnncaaaacacnnnnnnnnnnnnnnnnnnnnnnnnnnnnnnnnnnnnnnntgggaaaatagnnnnnnnnnnnnnnnnnnnnnnnnnnnnnnnnnnnnnnnnnnnnnnnnnnngtccaccccacttttctctgggaaattttttttttt

SEQ ID NO: 6991 - DNA, 730 bp, Diabrotica virgifera
  misc_feature (11)..(143): n is a, c, g, or t
  misc_feature (145)..(349): n is a, c, g, or t
  misc_feature (351)..(373): n is a, c, g, or t
  misc_feature (375)..(394): n is a, c, g, or t
  misc_feature (403)..(462): n is a, c, g, or t
  misc_feature (469)..(497): n is a, c, g, or t
  misc_feature (512)..(536): n is a, c, g, or t
  misc_feature (540)..(594): n is a, c, g, or t
  misc_feature (646)..(662): n is a, c, g, or t
  misc_feature (664)..(697): n is a, c, g, or t
atgttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnncnnnnnnnnnnnnnnnnnnnncatctcccnnnnnnnnnnnnnnnnnnnnnnnnnnnnnnnnnnnnnnnnnnnnnnnnnnnnnnnnnnnnctaatcnnnnnnnnnnnnnnnnnnnnnnnnnnnnncgggttggatgaacnnnnnnnnnnnnnnnnnnnnnnnnncccnnnnnnnnnnnnnnnnnnnnnnnnnnnnnnnnnnnnnnnnnnnnnnnnnnnnnnnctcgcgctttctaaaattattaatcagtttttttagcattacctttatttcnnnnnnnnnnnnnnnnncnnnnnnnnnnnnnnnnnnnnnnnnnnnnnnnnnntatcttattatattaattacaccttttttgatc

SEQ ID NO: 6992 - DNA, 922 bp, Diabrotica virgifera
ctcgtttgcgtgcgtggaggccgagttgcgatcggtaaggcttcgaaaggtgcttattttgcaatttgcgatttgcattgtgcactggttttacaatatcttgagttctgattgtcggatttaagtttggtaaacggttgtttcctcgttttttattagggaacaaattttgtttgaaacattcttttttgtctcttttagtttatgagccggagccttataaacaatttatagcaattaaattgtttataacaattttttgaccactcggatcgaaatcccccctcgaaattcgtaatcagcagcccaaagtccataagaagccgttgagtttgtccatcagagttggggatgacacggtgacctctatttggcgcctagactattactcgtagcacaagtagtacatttcatacaccagtcctttacatcgttggaattattcatccaataaaaccgttcccgaattctctgaaggattttctttacaccaagatgccctcctaatggactgtcgtgtaactgacgaagtacttcggctattctgctcttttgaatcaccaattgttctctccgcttaagcgtcatcattttccaatactcgttaagcaagctgtcctccatgataatagagtccctcttggcccactacggcttgatatttcttgccaagatggtcgacgattttcttttgtccttttcgaattttctgaatctaaaattggcccattcgccattttaattacttatgacactaaaacaccaaaaaacagctgaccctagttcatgtcttcaatggtttataaataaacccagtccgggccaatagtccaagatggccgggcgtttttctttttgcccttttccaattttttggatcaaaattggcccccttcgccattttattaacttacaaccttaa

SEQ ID NO: 6993 - DNA, 279 bp, Diabrotica virgifera
cgcgggcccgttaggaggagacgaccagaatactgtggtggttttttagaaacaatggatgctccaattaatcacggacatgctctcgttaggcacgaaaaatataggaggccctgtgtctatacgattcgactcatttgcgcttttgtcgaggatatgttgcgcgtagtccctagacgccctggccatatagctagaagtaccaagaagaagaattttctccgactttagcgtgatgagtgcggggattcgaagacctgtctaacttcaaaccctcgg

SEQ ID NO: 6994 - DNA, 972 bp, Diabrotica virgifera
  misc_feature (330)..(357): n is a, c, g, or t
  misc_feature (373)..(394): n is a, c, g, or t
  misc_feature (764)..(764): n is a, c, g, or t
ggaaataagcaaaaaagtgctctatttgtgacactgacccagccaggcaaactgcatttgttttgagtagttatagatgtctataacaagagtctatatttcttgaagtcgatttttggacgtaattcacttcattcattcattaagcgttataatggggcttatcaacgcttctcatttgtttcgagcttcagtcatatgtcgtatcaaatactattgactgtaatacatccaactcccacagaaatctggaagcacgttgccactagcgccactgtcggcttgagttgaactgcgttttgacaacgtaaaatttgacgtaaacattcnnnnnnnnnnnnnnnnnnnnnnnnnnnncgagctaatttttctnnnnnnnnnnnnnnnnnnnnnngtttaaacacttatacaaaaacaataataaagcaattttataaatgtaaggttagattgctctgggtatcctactcataccgctaggtggcgcaattttttgcttcctcaaaattaatgggaaatgtcaagagttgtatgtctatagtatttggtcgtataatccgtaaataatattaatatacgacatgtgacaaaagctcgaaacaaatgagaagcgttgaaaagtcctatccctaggaattatagctaacgtcatggctttcaaaatcttattcttgggtgaggtagattattcctctgtcatttatagcttgctgtgtgtatttgctactgtcgtgaatcttttccatttcttcctctacatctgngccatagtggtgtccagttagttgtccttctcagcatatctgagtgtggtcgtctctgcatattatgttctatccattctaggcgaagatattttatgtatctgactatatttcctctctttaattctctttcatttcggcttttgttttcattcttctttctcctttctttattacattgggggcccagtatcattctcattatttt

SEQ ID NO: 6995 - DNA, 929 bp, Diabrotica virgifera
  misc_feature (30)..(69): n is a, c, g, or t
  misc_feature (170)..(193): n is a, c, g, or t
  misc_feature (409)..(432): n is a, c, g, or t
  misc_feature (445)..(462): n is a, c, g, or t
  misc_feature (496)..(518): n is a, c, g, or t
  misc_feature (744)..(764): n is a, c, g, or t
  misc_feature (782)..(782): n is a, c, g, or t
  misc_feature (831)..(831): n is a, c, g, or t
  misc_feature (843)..(862): n is a, c, g, or t
ctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggngtagttttagcaaactcctcaattgatattgtacttcatgatacctatntatgtgttgcannnnnnnnnnnnnnnnnnnntataggagctgtatttgcttatatagcgggatttatccaatgatttccttatttacaggtataactt

SEQ ID NO: 6996 - DNA, 354 bp, Diabrotica virgifera
atcagttttagattctacagaaacagataacggagtatctggaggtattggaagcatcttcgtatctggaggtattgggagtatctagattcgaagatgcttccaatctagatctggattcgttgaaggcagatcagaagaaaccgcttcagtagaaccacaacccgctgcaccagctgcggaagttagcgcaactaacgaaccagctaacgaagtcgaacacaattctgctgaagttaaagaagaatcaactgtgccttctgcaacaaccgatattgtttaaattgtgccattttaagtatctcagttatttgagataatttgttgtaatatagtgtgtatatgctttcgaag

SEQ ID NO: 6997 - DNA, 960 bp, Diabrotica virgifera
  misc_feature (134)..(204): n is a, c, g, or t
  misc_feature (805)..(826): n is a, c, g, or t
  misc_feature (878)..(878): n is a, c, g, or t
  misc_feature (885)..(885): n is a, c, g, or t
  misc_feature (904)..(904): n is a, c, g, or t
gaaaagaagagtggaatgagcacataagcaggatgtctgaatcaaggatagtaagaatagccagggacaagtcaccgttaggcaggagaagtataggacgcccaaggtaaagatggaatgacaacttaggtgcnnnnnnnnnnnnnnnnnnnnnnnnnnnnnnnnnnnnnnnnnnnnnnnnnnnnnnnnnnnnnnnnnnnnnnncctcagtattccggtaccttatgagttgactttattggtcagcgtaacatcagccagtgcatgatgtattatatttttctattattaaccattctatgtaagctgttgagaaaaactaagaatattctagtggtcaagaaaaaatggcaaataagctacacggaatattaatatatacaaatttgtaaaactaaatcactacagcgtatttcaaacatgcgatgcaatgtacaaggatagccccatgcaaatgaaatgataattttcttgacaacgttgccgctcttcacggtagcggcagtgaaaggtagtattaggcagatacttgtagaggattatcgctattaactgctgtggaatactaaaggagcatgcatttataattcacagaatggcaaacactcttgcaatatacaaccatactgattctaacgtttgaaatggaccgtaggtaaatatagatagtgctacctcagtgccggtttaacctaacttcggtccctgggcgctggaggtttaggggccccctttattgctattcgttgtcagttttttaacaagaaaacacatgcattaactataaaggtttcttgtaaaatcnnnnnnnnnnnnnnnnnnnnnngcaagaagaatagcaaatgtagaaaataatccaaaaatacatttaaaaacantaataanaaatagaaacaacacatgnacagcaaaaaacatattctaaaaatacataaaagacaaaattagatcacttttttt

SEQ ID NO: 6998 - DNA, 439 bp, Diabrotica virgifera
ccacagacgtccgttgtctgtgaaacaatattgtatccatgcgtttatatgcaactcaaaaaccatacagccactgttacaaaaatgaattacctacaaggatccttatggtgaaggtaaacaaaacagttccataaaaccattcctctgtcagtaaaaatatgatcgaattagaggcacacccacccaaattgcacgtctaattgtaacgccggaatgacccctatgccaaacgacaattacaaaatttacgcaaaccccccttacgaggaaacaacaaaaatatgtattatcaaagatgtatagggggggggtgctacaaggtgttgacaaaaacaccaacttccgcgctcgactttggggcctccctttataccacaaccatatttattactacaatgggctcggagggctagacaatgacttttttttgcccccc

SEQ ID NO: 6999 - DNA, 854 bp, Diabrotica virgifera
  misc_feature (289)..(308): n is a, c, g, or t
  misc_feature (465)..(482): n is a, c, g, or t
  misc_feature (509)..(528): n is a, c, g, or t
  misc_feature (735)..(752): n is a, c, g, or t
cccatctctattcttcactgtatcattttgctgttttctttttcttctttattcttatggtctctgttactgcatttaatacttttctttaattttgtcccaatcaatatccagattatccgtatttatcagtgtttgaaataaatacactcaccggcacaaatttccgccactaaaaatgtttgtttaagtttgacaatttataacttgattatttttactccgatttgcaagattattggatcaatttgtaggtacatgtattgacatcgtttgttattattccggnnnnnnnnnnnnnnnnnnnngttggcgttatacggggacgaatgaaaacattgtattttctcccaactttaaaaaaaaagaatgtgtgtgtactatgtacgcacgtaagaagatattcttctattatataataggtaatttaaacgaagtaaatatacttaaaaggttatttgtacnnnnnnnnnnnnnnnnnnaaactaactttcttatctaccactttnnnnnnnnnnnnnnnnnnnnaaccaaaaataaaacaaaatatgaatcgctcgggaattgaacccgcaaccttccaatctcagtgctaccgcatttctaactactccatcgaggcactagaaataaacatgtaagtttcggatataattacacaacacggcgacatatagtgtaaaaaacatttaatgttatgcttacataatattttattaatccaaaaacacaagnnnnnnnnnnnnnnnnnnattttctaaaaccaataatacattcttttaatgacttatttgcacggttacagatacatacctacctatcttgaaaagataagaatgaactacatactgtca

SEQ ID NO: 7000 - DNA, 186 bp, Diabrotica virgifera
accggcttcgagatggcataccgagcacgagccatgcgagagagcaccgaagaatatgcagtggagacgacaacattggaaacatacggagtatgagaccgctttctctgtttcggagacatagaaagtagatacttacgctgttacctcctagaactacgaccttagtgtagtctcggagcgaag

SEQ ID NO: 7001 - DNA, 589 bp, Diabrotica virgifera
cgcccgaggtggaatggtcgcattcaatggtaaaagcttgactactgttctgtaactgacttgttaaaggagtggtgcttcaaccactcatttggtcatgacacctgataacacttacaaactacaatggaagttgttgaagttctttacagcatacaagtttcattcacttgctagtggcatgtgaaaatttgaccccctgacttctagcctactgcggataacattggaattatattctgacctaacgctgtagtgcttggtgtactccggccgcttaacacttagctttttattttactagaagacgtactagctagtgttgtgtttgcacatcccctttctttcgtcgactcaagattgacagtcctccttcatagaattttacgttcgaacgtactttttcaccccccccaccagaagcagaaactactagaactattacccaagaggcgctctattacaacgctcacaccagagacattgcattatacgaggagccactggagtgtgatccgaagacaactccttcctatttgcaacgtatatcctgaatgccaagagacttaatggtatcgctcaccatcca

SEQ ID NO: 7002 - DNA, 744 bp, Diabrotica virgifera
  misc_feature (336)..(354): n is a, c, g, or t
gtcggggctttttgacggggctgttttgaccgggctattttgacgggtcacgaaattaccattagattgtttgatctttctaccaattttgcaaaatcgtttatctaatgcacacaccttcctattttatgtgaatctttgtacagggtggtaccttaatgaaaaatacatttggaattttacattggaatacacttttagctcttcgactaaagacaataaatttatttgtcattaaaaaaatctagatcactcacctagaaaaaaaataccttccttattaatatatgtacatacatattcacaaaataaaactgtttgaaatgattgggctgnnnnnnnnnnnnnnnnnnnggtccaccctgtatagacactaaatatttatatacctattattagttagacggctatttgataaaaataacctatattttgatatatagaattaattggtttaacttaaattaaaaagcagctatttttactaatccgatcaatcttttttcttcttgcgaatggtacagatagttgatactgtgctcattattaaaagagtaacgggtaattcactctcaaagatttcgccgaaaaaacatttttttcgtactgttctataaaactcatgcggatcacttatttattcctcccattttccgtgattgacaagtgcgactcatgtgtatgtttcacgtgcatgtgcctgtgacatgctttggccactgaccgcttcgccccacgttgggc

SEQ ID NO: 7003 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattc

SEQ ID NO: 7004 - DNA, 772 bp, Diabrotica virgifera
gtattttagccagaataaaagatagtaaatatttctcaaaacttgatacttcttctggattttatcagattcgtttagacccagagtctcaatcccttaccacattcataactcccttcggtaggtatctattcactcgagttcccttcggtatcacttgtgcccccgaatatttttctatattgttaaacaaaatattagctggtttggacggtgtaattagtcacatagatgatatcttaatccatgctccaacactagaagaacacaacaaaattctggatgaagtattatccagaatacaagctgaaggtatagctctaaataaagataaatgtgtgattgctgttcaaaaactccagtatttaggtcacgaaatctcaaatgaaggagtgtcaattgcacctgaaaggatttcagcatttgttaactttccagaaccgactaataaaacagaattactacagtttttaggtatgataaatttttcatgtagatttatacctaatcgctctgaaatcctagagccccttacgtcgttactgaaaaagagtgtcacatttatctgggacagtccgcagaaacaagcctttgtaagaggtaaggaattactacaaaaaagtccatgtttagcttactttgaccctaccaaacagatagcagtttcagcggatgcctcatcatttggattgggagcatgtttgattcagtttaatgagggtaaaaaggaaaattgtgcctatgcttctcgtttgctttcctccactgaaaa

SEQ ID NO: 7005 - DNA, 63 bp, Diabrotica virgifera
cttaaaaaagggctttacgcagcataagtgaatggtgcagctgtagagggtgcatctgaaaat

SEQ ID NO: 7006 - DNA, 729 bp, Diabrotica virgifera
  misc_feature (300)..(317): n is a, c, g, or t
  misc_feature (442)..(609): n is a, c, g, or t
aaaatgatattgaagaaaattagaaagaattacttaaaaaatataacaaagatgtcttaaatggtagaggatagtgtaaggtttagtaattagtgataaaatagatggatacaacacagtagacttcaaattttgaacgtatgttgccaaatttatgccaattaggaaaatacaaatgccactattgggaatagtaacaacagtattgtagtgccctttcaggacactttattaatagattaataccataagaagcatcacattcgagcaattgaagtgatgtagacgttgcatagcatnnnnnnnnnnnnnnnnnngcgttctctattttttctaatcaaactattttggaaatttactatattataattacgttatgatttgtagtggtgaatttggattctacagaaaaagtattttttatagaacactgaaagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtttaaaaggatccaattttactaacggggggtgggaacgtattattttttttatggggcccctaaaattaatttccggggccgggtttttaaacggcggggatgggaaaacccgggg

SEQ ID NO: 7007 - DNA, 383 bp, Diabrotica virgifera
  misc_feature (162)..(193): n is a, c, g, or t
aggggttaactggttttaaaaaaggaaattgcttcctttcaaaattatctttacaattaaacgtatccgcaaataattgcgagttctttgccatatttctgattctaaggggtgctggaatggattccttgttataaaaatctcctatgaagactgcgagannnnnnnnnnnnnnnnnnnnnnnnnnnnnnnnccttagaaatgatattactgttcttgattcaaaagaagataccactttatgaggatttatagctaatagaagcatacgaaatatgctagagaacaagacatcgttctcaatctgaaaagtgttgcggatcttcgaagtattctcccagcagatctcgattaactgattacggacgaaggacatcttctca

SEQ ID NO: 7008 - DNA, 114 bp, Diabrotica virgifera
cgccgtccggccacctggtggtgtacctcatgatgcaaaaattaatgacgtcaaagatgggttgaatgctgtccatttattacccagataatgaagactgctacccccctccgt

SEQ ID NO: 7009 - DNA, 958 bp, Diabrotica virgifera
  misc_feature (37)..(54): n is a, c, g, or t
  misc_feature (219)..(234): n is a, c, g, or t
  misc_feature (292)..(307): n is a, c, g, or t
  misc_feature (805)..(805): n is a, c, g, or t
  misc_feature (860)..(860): n is a, c, g, or t
ctataattaaatttcatcctgttttatgtttttgtcnnnnnnnnnnnnnnnnnncacaaaacagctcttttaaacaaccagcatggggaaagtatcaaaagataaacgtgatatatattatcgaaaagcgaaagaacaaggctggcgagctagaagtgcttttaaactactccagattgatgaaaaatacaatatttttgatggtgtaactagagctgnnnnnnnnnnnnnnnnccccggaagttggagccaagttttatcaagaaagttatacctaggagaatccattgannnnnnnnnnnnnnnntatttgttttacagtgatatagaactacagagtaagttagaggaactcgaacctagtgaatcctcctctaaaaacgataatgttaaaatcgtggctgttgatttacagccgatgtccccacttccaggtgttattcagcttcaaggagacatcaccaaatattcaactgcacagcaaattattggacattttgaaggtgatcatgcggatttagtggtgtgtgatggagcgccagacgtaacaggactacatagtatggatatttatattcaggcacagttattattaggtgcattacacatttgttgcaatgtgttaaaaccaggtggtacttttgttgcaaaaatattccggggtaaagataacgatttgcttacaaatcaattattgacgttgtttaaagaagttgatattgctaagcccagtagttccagaaattctagtatagaatcgtttgttgtttgtagaaattatagccctccggagggttttgatccnaaacttatgacaccttatttagatatatctcatcgtgatttaattcactcactgnggtgaatagggttatatttccttttgtcgtttgtggtgatgtaagtgcatttgattcagatactacatattcattgcagttgcaagggagagaaacct

SEQ ID NO: 7010 - DNA, 106 bp, Diabrotica virgifera
  misc_feature (3)..(20): n is a, c, g, or t
  misc_feature (27)..(99): n is a, c, g, or t
agnnnnnnnnnnnnnnnnnngagaaannnnnnnnnnnnnnnnnnnnnnnnnnnnnnnnnnnnnnnnnnnnnnnnnnnnnnnnnnnnnnnnnnnnnnnnnggggggg

SEQ ID NO: 7011 - DNA, 1313 bp, Diabrotica virgifera
  misc_feature (817)..(834): n is a, c, g, or t
  misc_feature (941)..(958): n is a, c, g, or t
  misc_feature (1102)..(1132): n is a, c, g, or t
  misc_feature (1141)..(1189): n is a, c, g, or t
  misc_feature (1215)..(1243): n is a, c, g, or t
  misc_feature (1263)..(1305): n is a, c, g, or t
catcatttatggctaaagttttatcacttgactttgcgttatacgcttcttgagctgctacgtgatgcttattctgctctaaaattaagttttccttttcagtttcttctgcgtatgatattttaattgctaaactatcgcatttagaacacgtatctttttggggcttttcagttccataagttccatattttttcgcctaagtcccatattttttatggcttatggcgtcataaacatctagttgacgatggcgtgagaaaagaatgacaaagaataacatttataacatgggtaaaatgcctactatagaagttacaagtgaacccagtccgataaatcgcgtggtgaataagcaaataactgtacttatcggctggtttccaattcgcaaaaatttattgaaaccgtgtaagactagttatttcgttacgtttcataattttcgagatgtttgaatattcacattctcataattctccaaatttaaaaatattggacttatttgtttgtgcataggccggggaattacattttaacgttaagtacataatatctcagttttgataatttgttgacttatgtgcttattcacacgagccagagatatactgacattgtaataaaccttaaacaatatcgaatttttaaaatacataatattttggttatataaagtcgttttgattaagtcaaacggtttgcattttctcaaccttcaaagtgtccagaaggcaagttttcaaacgacgacagttcaaggacaattgaaattactttttaagacaaaaaaatgtaattatagatagggaaatcnnnnnnnnnnnnnnnnnnattaaaaacggtttttatgtacccagtagttttcgctttttttggctaataaaaatactgacacttatttcatttctttcccataatcgaggaaaaatgtaggtcgnnnnnnnnnnnnnnnnnnaccaaaaaatattctaataaatttttgaaagggattcccaatgctggggaaagcattgggccctgaataaaaaataaatgggttgtccattgggaagggatcaagcccggggattccaaaaacccaaaaaatttaggtttcagnnnnnnnnnnnnnnnnnnnnnnnnnnnnnnnaaaactggnnnnnnnnnnnnnnnnnnnnnnnnnnnnnnnnnnnnnnnnnnnnnnnnnccaccaaaaaaagtgggggaaggttnnnnnnnnnnnnnnnnnnnnnnnnnnnnngggagaaaaacaaaccccgnnnnnnnnnnnnnnnnnnnnnnnnnnnnnnnnnnnnnnnnnnnaccacccc

SEQ ID NO: 7012 - DNA, 112 bp, Diabrotica virgifera
  misc_feature (56)..(89): n is a, c, g, or t
gggaggttttctttctccactgaggcgcacaaaccccctaaaaaaaaagaataaannnnnnnnnnnnnnnnnnnnnnnnnnnnnnnnnncgcgtgaaattcgtgttggtttt

SEQ ID NO: 7013 - DNA, 913 bp, Diabrotica virgifera
  misc_feature (154)..(178): n is a, c, g, or t
  misc_feature (759)..(776): n is a, c, g, or t
attccaccagactccaatttagagcagattgcggacgtagcacaaagcagattaaccgacttcaaggagatgtcttccttgggtcttcagtatgcggtggaaaagcgacctctggtagatctaaatgtagatcttcaggcacccattttgttgnnnnnnnnnnnnnnnnnnnnnnnnngcaacgagaacattttgttggtgaatctgggaagagtgaaagtgttttcttatggcagaagatgtacagctactgaagtgaaacggctcaacgaagaaggcaaaacccaagccgaaatctttgccttcatgaaggagcatagctacgataactttaagctcgaattgacaaacgttcaaattctagcagccgaacgtggcgaaaactggtcggaagctttaacaacaggaaagtccaaaatgcatattctgaatcctgtgagtttgtcgataacattttccacgtgccttataaccgacgatcctagattgccccttaataaggtggctggggttataccgtcaattgatctggttatttcagatgctaggttgttgttggtcattggcctatttactagtattaagttcccaggagatgaaatccctgaagcacaacctttgagaaaagcagcttccagtactctacttttgaaatataaagagatgcaagctacagggcaaaaatactaaacagctaatagttattctttggagaagcagaaaccagcgtccagttcactacttttatctgctgaattnnnnnnnnnnnnnnnnnnctgtagttataaaacaacaagggaaccaccgctgaatccgcacattcgcttagctaagttcagagttgacccgataaaatgcccacccgaaacacacaaccaacactcacaaaattccccgttgatcccgggggggg

SEQ ID NO: 7014 - DNA, 781 bp, Diabrotica virgifera
gtttgcagcatgcggctctgtttgctctattcagttgatcttccacttctgtttcgagctttccgtagctacacactgtgatgcctagatatttaaactcaatcactttttctatcatctgattcttcagctatcaattctaaaatatgaaaaccatatggttttcttattgggattactttgttatatccgatatacctactataagaatatccaggttgcaagccaggttgcaaatggattttttgggtactgtatacctagtgcattgtaaatacaaaaattcccgtcgcagttcggacgagaaacttagttgttggcaaataagggtgaaaaatggcagttttttcgtttgaatcgctacaggtaaaagcggggtaattgagtgtcttatttataatatacttctttttgtggatgagccaaggtttaaaatttcactttttgaattttggtcaggaaagtgcaaaataagactaaaatttcaaaaatgggaagtgtgctgtaacttttgcgaaaatggccttgggacttaacttttcgtgcagtatgaaggtcctaaattcattttcgcaaaggttatagcaaattttttattttcgaagttttagttttatttttgcaataatccgaagcaacaaataatcggaacaaaaatttcaaaaaacgttatttttgaaccttggctcatctactaaaagagaaatattatagatgagacgtttaattaccctgttttttactttgtagcgattcaaaagagggaactcctctttttggc

SEQ ID NO: 7015 - DNA, 882 bp, Diabrotica virgifera
catgaactaaatattggaaatgggaacaaaatagttttgccacttggattactgtagtaaaagtcatctaaagtctaaagcaagtgacaacgcatgtagttctggctaattgtgtttccgatgacttttattgtatctatgcacatgaaaagccgtttctcaccttgtccaatatttacttcaagtataggtttgaatttttatgaattggggctttttttatcctacaaactatgtcaagccaaagccgccatctgttggctagtttttgtacttgaaataacatctcacatatcttaacactattttaaacatgataaatgcaacgcttttctcaagtattgttaagaatcttcaaaattggccatttttgataatgatttgatatgataaatacatcaacaattatgagcagtctaagaattcatattatgtgatcttaatttcaaggttgtatcgagtatctgtgaattgtaaaaaagggaaattttgactgcattggaataattgataaagtaagctctgatggaaaaatctcaatattattgcaagcggtgccaatgtcagaaacacttgttttctgacatcctcctcaaaactaaacaatatatggactctagtaccagtaatttattcttttatgggcaagggttgcaaaacattcattttttttgtgttgcaatattcataaaaaattatcgatattgtctatttgtgattacccactctctataatgccatcgaatggtatcttattcttatcccattgcgtgccacgtcgctcatttacgagagacacagatattttgccctgagactattctcccgattaaagcgtgacacgcaatgtgttagatcttgaaaagatcccttttgatgttt

SEQ ID NO: 7016 - DNA, 134 bp, Diabrotica virgifera
aattatcttatatttgtttattactgtatttaacattgtgcggacttcaattaggtttgttgctttcgaaattctccacgactaaaactggactatccgaggcagacatggtgacgcatagctccccaaaaacc

SEQ ID NO: 7017 - DNA, 623 bp, Diabrotica virgifera
atcggcgggttggcgtgggtggtgagatcacgtacaagaaaattcagtcaacgcagattatgggttcgattcaattgggcattcagcatgctgtgggcggattggcatcgaaacctgaaagagacctcttgatgcaagattttatgacggtggaaacgacaaattttcctagcgaaggatcaaatcacacgccagctcatcattattcggagtttaagttcaaaaattacgcacccatagctttcaggtacttccgagatctattgatgcaagattttatgacggtggaaacgacaaattttcctagcgaaggatcaaatcacacgccagttcatcattattcggagtttaagttcaaaaattacgcccccatagctttcaggtacttccgagaactatttggaatccaacccgatgacttttttgatgtcactggggaacaacgagattaacagaattatcgaaatcccggtgctagcggttccatcttttatgtcacttttccaacgaatgattttatcattaagacgggtccaaataaaaaaagggagagtttttacaaaagattgttagcaggattattatatgaatcccctccaaaccccaggggcgtttttttgccg

SEQ ID NO: 7018 - DNA, 1157 bp, Diabrotica virgifera
  misc_feature (449)..(467): n is a, c, g, or t
  misc_feature (948)..(976): n is a, c, g, or t
  misc_feature (1004)..(1023): n is a, c, g, or t
  misc_feature (1075)..(1095): n is a, c, g, or t
ccccgtcgtgccgaccccccgcgtcccggggatttataaaatcacatctcggcaactctgacctcatatattatcatcgacatgacatacaatagaaaagggggccataaatacggaatatgcagctctttgtgtactacaattttacggccaatttttcaatacaatcaagatgatagttcctcttgttggggttttataatgcattttgatgttccaatatactctaaaccggtactttttagaatgtatgatcggtaaactagcatcttgaaaaacacctccattcataaaaacctaaatgtttattatgttttcatactaccagtttgtacctacggcttggaggcactacaaaataaaaatagaaattcttggaatgtcactgagagacaagattagaaacaccgaggtaatacgtagaacgaagatcagggataaatcatggnnnnnnnnnnnnnnnnnnnatgactctgagccagtcacatagccagatataatgataacaggcgagcacaaagaatcctagaatagagaccaaggaggactagaagaagcatgggaagaccttcgaagagaagggtaaatgacataacagcagaagccagctaacagtggattattgaaagatggatgcaattgggagatatacctatgtacattcagaagtggagggaaaatgggtgacgaagagagagaactggtgtgagcaacggatctttaggtaatctaattcctcgaccaaatgttaaccaaaaataattgcaaatccgaaacgattgtatattatttactttaaagggaggtttacttaagcttggctatactcttaattttagtatcgccacattaaaaaaaagtatttggcattggaaaagttggggggggattaagggaatccgcatttttgtacccattcctttggttccccatttaagccaaatttgnnnnnnnnnnnnnnnnnnnnnnnnnnnnntatttgttaaaggttggtgggcggacgnnnnnnnnnnnnnnnnnnnntggcaccaacacttgtaaaaaacaaaaaatcctttctgggggaaaaaggagnnnnnnnnnnnnnnnnnnnnnccccccataaaacgggcgcacactatataaaaaaacggaaagcagtttttccctccttaaaa

SEQ ID NO: 7019 - DNA, 179 bp, Diabrotica virgifera
  misc_feature (37)..(37): n is a, c, g, or t
  misc_feature (151)..(168): n is a, c, g, or t
gctcgccttttaggagtgccgagagccaacctccggncgcaggggggggcccttttaccttgtcttttgatctaggcagtaacaaaaaaatagcgccaggatggacgcgagcgagaagaaaatgtttttgatgaagcttgaaaaataatcnnnnnnnnnnnnnnnnnntgacaagagat

SEQ ID NO: 7020 - DNA, 1148 bp, Diabrotica virgifera
  misc_feature (528)..(546): n is a, c, g, or t
  misc_feature (890)..(904): n is a, c, g, or t
  misc_feature (906)..(927): n is a, c, g, or t
  misc_feature (1011)..(1030): n is a, c, g, or t
  misc_feature (1047)..(1059): n is a, c, g, or t
  misc_feature (1062)..(1076): n is a, c, g, or t
  misc_feature (1112)..(1132): n is a, c, g, or t
aatgaagctaatatttaaatttcatgttttaaagaaattaattttcccctccattactaattgccactctcattgacatgacagcgcaaagtatgaggagatggacaaccatgttccgtattaaaagacagatatctagagagtgaggatatatggagtacgttcagtatgatgacttagatgttagatgaaaagagagttccttatagaacggcgccaaacaggttttaacggaaaaacaagttaaaacgaatacaaaaaataattactatgatttacagaaggaactatttcgttccttgagtatagttgagcatattggtacttgttatttttcacgtggactagattttatgtttttctaactttcactgtgttaaaatgattcacatttcaaaggcctccaatttatttacggttggtgttttaagggtccacgtctcaactgcacagagaagagtcgacctgacgtgttaatttgataaacatagtgtaatttcgagttttattcgaaaatcacatagcagnnnnnnnnnnnnnnnnnnncattttgctggtctgtcctattctcgatcttatttctagatcaggatttagactgctatcgatttaacgtctcaggtacttaaatctattgacctgttctaaaatttgcccgtttattgtacgaggttggggtacattttggttttttccgattgacatcgctttggttttcttaatgtttattttcataccaaattgctcacaggtcgagttggccttgtccatggagtcgttgtagacccagtcgggaatccgcaatcaacaccatatcatcggtgaatggggatgctattgatattttacaccattcaccttgactcaatccttgaaatcctccagggccnnnnnnnnnnnnnnncnnnnnnnnnnnnnnnnnnnnnngggggaaaaaaccccaccttgggaaactccattaaattttaattagaaaggaatattttgggggataacggaatttgaatcccnnnnnnnnnnnnnnnnnnnncaattttatatttgggnnnnnnnnnnnnngcnnnnnnnnnnnnnnnccacaactcttggttataaaaattgtcacacccccnnnnnnnnnnnnnnnnnnnnncccgttttcatttttc

SEQ ID NO: 7021 - DNA, 917 bp, Diabrotica virgifera
  misc_feature (5)..(838): n is a, c, g, or t
  misc_feature (845)..(882): n is a, c, g, or t
  misc_feature (902)..(915): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnngg

SEQ ID NO: 7022 - DNA, 386 bp, Diabrotica virgifera
gccgacgccaaccatcccggcacgctcagcggctggcacagccagggcctggatggccagggccacagccaatggctgttcgacgacaccgccggccaggtgcgcacgcgcctgtccagttccatcgccgcgtcgcaactggggctgggctacctggtcaagcagggcgccgacgaagcctcgcgcggccaatggcgcggcacgggcttcgaattgcgttccgacgcctggaccgtggtgcgatccggccaaggcatgctgctgtcggccaacgcccgcgaaagcgccgcctcgacccaggctgacacgcgggaagcgctggccctgatgcgcggcgcgaagaacgccgcgcaacgcatcagcgacgccgccacccaacgtcaggc

SEQ ID NO: 7023 - DNA, 810 bp, Diabrotica virgifera
  misc_feature (2)..(15): n is a, c, g, or t
  misc_feature (20)..(38): n is a, c, g, or t
  misc_feature (693)..(714): n is a, c, g, or t
cnnnnnnnnnnnnnnttacnnnnnnnnnnnnnnnnnnnggaaattattcagatctgaccagaaacgtcatgtctagactgaatgaaaaagaagtgagttttgagcttctggaagctcttttagactacatcaaaacacaatctatacctggagctgtattagttttccttcctggctggaatttaatcttcgctatgatgaaacatcttcaaaatcaccccgtttatggaggaagtcagtacagtattttacccttacattcccaaatccctagagaagatcagaaaagggtctttcaacctgttcctgaccacgtaacaaaagtcattcttgcaacaaatatcgccgaaacttccatcaccataaacgacgtagtgtttgtgattgacagttgcaaagcaaaaatgaagatgtttacttctcacaacaatatgactagttatgctacggtttgggcttccaggacaaacttggaacagagaaaaggtcgagctggtcgtgttaggccaggtatttgtttccatttgtgttccaaggccagattcgacaaacttgacgaacatatgacaccagagatgtttagaactcccttacacgagctggctttgagcataaagctgttacgtttgggctcgataggtcatttcctgtcaaaggctattgaacctccaccattagatgccgtcatcgaannnnnnnnnnnnnnnnnnnnnntgaaatgtctggatcaaaacgatgagttgactcctctgggtagaatcatcgccaagcttcccattgaaccgagattggggaaaatgatggttttgg

SEQ ID NO: 7024 - DNA, 223 bp, Diabrotica virgifera
tttataacgtcttgtggaattaccggtaattgtaaagagaagtgactctgtgagtcgcccagccccgaacggcacatccataacagacatgaattccatagaggatgcgaggagccgagaacctagattcgagagcactaccgaccgagtggctagtggaagaccagcgcgtttacctcatacctagaggatgaggaaccgtttcatgaccttcttgagaggt

SEQ ID NO: 7025 - DNA, 261 bp, Diabrotica virgifera
ccttcagaaatatactatccgcatttcatcgcgcgaaaactcgttgcttttaattacagtgataacaatatgactaagggagcagtaagtttggtaactggtggagcctctggattgcgaacggcgacggtagaaacattggctctacaaggatgtacagtaccactttgtgactcaccagcttccaaaggaaaagaaccagcaagcactataggcgcacataaagtactatttgcaccacgcaaaccgttatttacagac

SEQ ID NO: 7026 - DNA, 988 bp, Diabrotica virgifera
  misc_feature (537)..(626): n is a, c, g, or t
caaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgccctgatactgtgtgcatggaataatggaataggacctcggttctattttgtgggtttcggacccccaaggaatgattaaaagaacggaggggggcattctattgcgacgtaaaagggaaaattttggaatctcccaagaacgaaaaaaacgaaagcattttccaaaaaaccttttct

SEQ ID NO: 7027 - DNA, 802 bp, Diabrotica virgifera
  misc_feature (32)..(55): n is a, c, g, or t
  misc_feature (126)..(144): n is a, c, g, or t
  misc_feature (457)..(510): n is a, c, g, or t
atttcagactcggctgaatgacaatacgtccnnnnnnnnnnnnnnnnnnnnnnnnctacaggaactaaattacgttgtacctatttaattgtagtggtgatcgtattcaagactgaccgcataaannnnnnnnnnnnnnnnnnntgtgtgttatagtgttaggaagaattaatattaattggagcttacccacagatgacaaaaagaaggcctattatagatctctaccaagaataaatttttcccaagctgatgctaaaaatactgatgtaatatacaccctatttacaaactcctcccctacagaaggacagattgtaaataaagacacatctaactccataatcacggaaaaaaacataccaacctgtactaataatgcacggatggactacagatgatacgcccaccatggtacagacccactaagggatgaatatttttaacacggcccccnnnnnnnnnnnnnnnnnnnnnnnnnnnnnnnnnnnnnnnnnnnnnnnnnnnnnntccagtgcccaattgcaaaccttgagaaaatttcttcgccccaatttctattgcttcaaagttaattttgagcaaatcgcttcaataagtccttcctttgtatcccattatcatgtattaattgtcaatttgaaaagaagttaacggcagaaggtaagaaaatcaccgacttaatcccccagccccatggtgtggatcacgtcttgcccgaaaaacaaagaccctaccgtcccaatgcttgttttgtcgctgtatccccctaattatctttctcccgcgccccccccctacc

SEQ ID NO: 7028 - DNA, 844 bp, Diabrotica virgifera
ctagatcaggagctgtccatgcccgaagatagttttgtgttgaaatatttcaagtacctgaatgaatatttaagtatgggacccccagtatactttgtagtaaaaggaggacttaactacagtgacgtcaaagctcagaacctgatatgtactggtagatactgcaagagtaattccgtggttgctcaaatatatgccgctagtaaagatccagaagatacatacattgccaaaccttcttctagttggatagacgactactttgactgggcagaaaatgataaatgctgcaaaaaatatgccaacgatagcagcttttgtccgcataatactaaaggctttgtgtgcaaaatgtgcaacatcaaattccaaggggtggaaaaccgaccggtgccagaagattttcaacgctacgtgtcgttcttcttaagggacaatccagatgaaaattgccctaaaggaggtcacgccgcttacggtcaaggagtaaactataagaccaatgctaccaccaagctatctaccgttggagcttcctatttcatgacttaccatacaattttgaagtcttcggaggattattacgaaagcatgagatcatcgagaaagatagcagccaatctcacagataccattggcgttgaagtgtttccctactcagtgttttatgtgttctacgagcagtatttgacgatgtggtcggacactcttttcagtgttggtataagtttgctggccatattcgtcgtgacattcttcctgatgggtttcgacatattttccagcatcgtagtaataattacaattacgatgatcctagtgaacctgggagggctcatgtact

SEQ ID NO: 7029 - DNA, 799 bp, Diabrotica virgifera
  misc_feature (126)..(143): n is a, c, g, or t
attgtatcctaaactcagaataataaattgatattgtgtgtgcggttttaaatcgggataatattttagtatgaaggacgttatcgatgtaatggaactgcaacgtgagaagtcccggaagaacgnnnnnnnnnnnnnnnnnncgcttgagttcaataatggatacacggctgccaggtttatattcgaatgtggcattaagttaaatggacaaccacttacagtggccactgctgccatcattatgcaccgattctttaaagaagttgatcctaccaattatgatccgtttttgatagcttcttccgcactatacctggcaggaaaagtcaaagatgatcccctgaaaattagagatattatcaacgtagctcacaatacactgcatagaggaagcagtctactggaaattggcgacgaatattggagtatgagagacgccattgttcaagccgaattgttaataatgagaatattgaagttcgaagtcagtacaactcatccccaccaagttcatgttacattatctgaggtccatggaagggtggttgggtaaagaacagttggaaaagcgtcccagtagcaagagcagcagcaactttccttcaggactaccaccacgatcccagtatccttgactatgaccctcgacacgtcgctatcgcttgtatatctttatctcttcaatgctatggaatacaattacccccttatagaagacacccgacgatgaggcctggtacaatatatttgttaaagatcttcccaaagagaagcattgtgaaataatggagaaaaa

SEQ ID NO: 7030 - DNA, 758 bp, Diabrotica virgifera
ccgtgaagaacttgacaccctggcggaacataatgaggtaaaactcatttgggtgcctggacattaagggatcgctggtaatgagaaagctgacgaacttgctagacgaggatcagcaacaagatacttcggtccagaaccggcactgggagtgcccagaagcacaatcagagaccgaataagaggctggatacgaagacagtacaaagaatactgggaagaaattaccacgcaaaagcatgcgaagagatttatacctcagacatgcgcaaaaagagctgaagaactgttcaaaatgaacaggaatcagcttaaaatcactacaggtttcttaactggacactttccagtaaaaggacacctacacacgatacgactatataacggagatctcagctgcagactatgcaatagagagaccgagacagtcagacatttattgtgcgattgcgaggctctggaccgtaagagacaagcaatatatggggactgcagaccaagtccgacagtatatggttaacccaatggacctttacaggctagtgaagagcactactatattggattgggtgtcatgagaacaaatggaagaaagcacaataagctgaaaagcagcagtgccaccggggtgcatgcacacagggcttccaggaaaaaaaacctgatttttatggggattgataaatgatgccatttggatagtttagccattttttgaaatgcagatcttgctttctgtattcatactttatttctac

SEQ ID NO: 7031 - DNA, 869 bp, Diabrotica virgifera
  misc_feature (148)..(174): n is a, c, g, or t
  misc_feature (420)..(420): n is a, c, g, or t
  misc_feature (761)..(779): n is a, c, g, or t
aaagatagtggaacttgatagctttatttttgtcctttcagcacgagtgaggggaactccattaacaattcttactacgaatacaattaagaaagtccgcatcttgaattggagatgaccaaatttatgatgacattgacacagatcnnnnnnnnnnnnnnnnnnnnnnnnnnnatatacctattatatatgccgcatctggaaattgatcttgcacccgtattatcttgctgctcccttatatagcattccactccaacatctaatataaaatctggagtgcttcccccgtctcttttattagtattatcatcagggatactacaatggggggttgttaccgcgatgaactgtttacccgcctctgtcatcaagtatcgcccctgaaggtccatcaggtagattctagctacttttagnattacattatagcgtggtatttcgtgcaatctttatggagctattaattttattacaacagtcattagtataccaccaagaggaataacctttgatcgaataccccgattagtctgaggtgccgtaagtacagccctccgtcttctattatctttaccagtcttacctggagctattacgatattattaacagatcgaaatttaaatacatcattttttgatccagctgtaggaggggatcgaattctctatcaacatttattctgattttttggtcctactgaaccctatattctaatttgaccaggattcgcattaatttctcgtattggtaggcaagnnnnnnnnnnnnnnnnnnntttttggtactttagggacaatttatgctataatagccaattggcttattatagtttattgcttgagctcatcatatatttacagttgga

SEQ ID NO: 7032 - DNA, 935 bp, Diabrotica virgifera
  misc_feature (195)..(217): n is a, c, g, or t
  misc_feature (785)..(785): n is a, c, g, or t
  misc_feature (848)..(848): n is a, c, g, or t
cccacgcgtccgattaatcatgacaacttatgttacagaaacaagaggtattcattgttttcagtgtagatacacctctcaagtgctctaaacaattcaatactgtctcggtagttctctacaaggtcacaatacacctctaagggctctacacaattcgtttgtttgtacgcacattaaaaaacgtatttctgnnnnnnnnnnnnnnnnnnnnnnntcaaagagtaaaggcttttgttgccggtgttgaggaggtttttgtcctatccaattgcaccttttcaaatctgttatggtcctctatctctagattagatgctatagtctgatcctgtttaaaaggtctaataactttgaggctcaacattgtaggtgccggtggcttttattcgcctaatgcaaagaaccgcgcattttccaggctgtcacactgacataaaacatggactctcatggacaactgaaacatggactctaaaaaaatcgatagaagatcgaagcctttcaaatgccgggagagaacacagaaccaacctgtcaattctggaagagtttcctataagagacaggctatgtttgtttactagcaggtattgaacgaaacaagtaataaaataaaacacaagcaataaacactaattacaacacctgcttataaagtttatcccttctgatggccaatattgagagaaagcggaatttctccataagcgcaatacaataataatacacaaattcaaattggtttgttgctaaatatttcaaaaaacaataaaggataatanaggcaataaaatttaggttaagcttaccccgtctggctggagacacaactaccgaaaaacaancgaacgaatttcgatgtacatgtctgtacacattcgggttttgaaggcatctcgtcccttatctcttagggaaagaatttttggatt

SEQ ID NO: 7033 - DNA, 95 bp, Diabrotica virgifera
  misc_feature (62)..(62): n is a, c, g, or t
cggccttttgagaggaccaagccaacgcacgcgagcacgcgacgaccttttgcgcccacagngccacccaaacagagcacacaggccggcgaaaa

SEQ ID NO: 7034 - DNA, 814 bp, Diabrotica virgifera
cgctgatgtagccccaaaatcgtcagtagcttcaggagaaacgtggttaaaagagttgcaggccaaacaagcagctttgagaaacaaaaagacccattcagatcaaccaagtgaaggcatagatgttgtgaatacaatacgatatgctccaggtgaaaataagcaatcagttaaagatttagcttcaagatttgaatctagtaaactagatccagtgaagaatgataataacggggtactatccatgaagaaaagagatgaaatggaatccatagcacccgaacaaattgctgaggaactaagagaagttgagatgctaaatgctgtggtacagaaaacgctaaatcagcaatctgattccgggctaaatgaagataatcgtaggagattatcaaagaagaaaagcgtatctttttgtgatcaagtcatacttgtagccactgccgatgaacaggaagatgacaggtttattccaaatccaattttggaaagggttctaagaacagctatgaataaacccgagactgcagccatacgccaagaaattatatccctttaggaaaacgaacttaagaaagaagaagcttcagcgcagaatctggctgtttacgatagaagaccgttaaatgatgttccccaaccagtacctgaaggatatcgacgatctcctcaaccaatgttgaatcaacaacctcaaaatactcacatgccacagcacactggacaaaattcaccgcagcttcaaagggaggaatcccccaaacgaaatggccgccacacattcaaacaaaattttcccaaacccttccccagc

SEQ ID NO: 7035 - DNA, 119 bp, Diabrotica virgifera
gcctctttttcgggcgagtaggtctagatcgcaagcgctcgcgccctttttcgcggatcacgtccgaatgcatgcagacgaatagcacaactatagtgtaccgaaatacagttacgctg

SEQ ID NO: 7036 - DNA, 281 bp, Diabrotica virgifera
cgcggacctttttctattagagtagcggcgacatgtggttgatctaatccacaaattgtcaaattgaaattaaatttttcagttaacaatttattgctaatgtaaaactataatctcgtatttcattcgaaagacaggttctagatatatttctctgttaaatgaactgaagatgcttgaaaagtctgtattgatctctaaaaattactctatgctaaaatatattaaccggctattgaccttagccagtccagatgatacgaaggcaagaacattattta

SEQ ID NO: 7037 - DNA, 688 bp, Diabrotica virgifera
  misc_feature (75)..(145): n is a, c, g, or t
gtaaaaacaaatgttgatgtatttgccacaattatatcaagcatgtttacaccaaattacacatatcaaagaagnnnnnnnnnnnnnnnnnnnnnnnnnnnnnnnnnnnnnnnnnnnnnnnnnnnnnnnnnnnnnnnnnnnnnnntgggtcattgcttgacgatggaactactttcaattgttaggagcatagaacacaatctgctgggaggattattattggtaggtaaatcactccgtggtgtactacctctccgcgttgtatcacttgcactaatagattgtccctactgccttgttgcgaacccaattgttggagaacagcccgatctatagctgctgctctcatatatcaaatgtctagaacctatgataagagatatacggattgttataagtctcctgtggaggaccgcttttgacatcatggctgatgattctttaggaacatgagagttcatgtgggataacctctccttggtgaatcgatactctggatatgttgactgacaagggaatgttgatacaatgcttgctcggatacaaatgttggatccgttcgataataatattatgttgtaaaaatccatctttgaaggcgaatgataccgacttcagttacgttttcggctatggcgagtcatgaatagctgatggtggcatctacgttcaattacctcatcgaact

SEQ ID NO: 7038 - DNA, 607 bp, Diabrotica virgifera
  misc_feature (23)..(40): n is a, c, g, or t
atcacagtataatttaaaaaccnnnnnnnnnnnnnnnnnntaagttgattaactttcttgtgtagtgacattctacaatgaactttttaaaacaactcattcctaaagtgccagtacgtcaaacactggtttcaatcgcgaaaagtgttgttgaaaagaaaagtctaacagatttttccacactactttcaactcaattttcagctcttcagattcaagaaagatgcgcatcttctttataccaaatgcacaggaaaggacctcacataaaacagagaaaatctcgtaatccttttgatggaagaccctttatgaaaggcgtcgttttaaaaaccttgatcagaaaaccgaagaaaccaaattccgccaatagaaaatgtgtgctagttaggttatccaatggaaaagaaatgatagcctatataccaggaattggacacaatttacaggaacacaatatagtactttgcagagtaggaagactacaggattgtcccggtgtgaaaatcaaatgtgtccgaggaaaatatgacttatctcacgtggttattaatagaaaataatgtttgtgaaagcaaatagtgtaaatataatttaatgttcccct

SEQ ID NO: 7039 - DNA, 489 bp, Diabrotica virgifera
  misc_feature (18)..(18): n is a, c, g, or t
  misc_feature (22)..(22): n is a, c, g, or t
  misc_feature (39)..(39): n is a, c, g, or t
  misc_feature (59)..(60): n is a, c, g, or t
  misc_feature (77)..(77): n is a, c, g, or t
  misc_feature (80)..(80): n is a, c, g, or t
  misc_feature (133)..(133): n is a, c, g, or t
  misc_feature (176)..(176): n is a, c, g, or t
  misc_feature (179)..(179): n is a, c, g, or t
  misc_feature (182)..(182): n is a, c, g, or t
  misc_feature (225)..(226): n is a, c, g, or t
  misc_feature (291)..(291): n is a, c, g, or t
  misc_feature (304)..(304): n is a, c, g, or t
  misc_feature (329)..(329): n is a, c, g, or t
  misc_feature (369)..(369): n is a, c, g, or t
tcaacggccggggaaaanaaanaggagagagagggaaancacattcaaggaggggggcnncagggaaagggcacccncanggagaagacgaagcagagcaccacgacacagcaccacccgcaccagaggaganccacaaccagcacgggccgcgcggggagcagcacgaagacaancanggnccagaacacgaaccaccaccacagcgagcagaggcagcgggannacgggaccgaaagaaagggacaaaccggggcagccacaaccaccagcaaccagaccacaacgcgncaccgccggacancagcccccaccaagcagcgccaagngccgggacgagaagggggaaagaacagacagcagccgcancacgcgagccgcacaaacccgacgaaagcgggaagcggccacccgcagaacacgacacacacgagagcaaccaggcggaggggagaccaaaggaaaaggagaaggagggcagacaagcag

SEQ ID NO: 7040 - DNA, 455 bp, Diabrotica virgifera
actgatatttttcgccacaattaaggacctcatgacgactgctacttttatggtcttctcttcattattcgaaatgattctcgagttactatgtacagaactgaagttatactatctgtatactccacaggaccacaggattgagaggagctttcgaatggtggtggaggagtacagagcttcgctgacagcatctccttacggagtattattgacggaaactggggcaacacctatggtttgagtcctcatttcttggaatccctgaaaaattgaccctcccactcgttaacagagttttccttgctaatctttaaataaaatgttgaagagagaaaagttgcagagatgccttttaattcggcacgaaaaataggaaaatattgatcttcctcttgaaaaatatgttcgaaattaaaggtttttgctgtcattgaatattatccccctgtaaa

SEQ ID NO: 7041 - DNA, 771 bp, Diabrotica virgifera
agagtgctcaaaatgaaaggactattgattgtttgcttggccgtattggccttaaccagcgctgctgataaggaagataaaaagggcaagaagaggagtttcccagcctactcaggatattcctcaggatattctggtgccgtaccagctgtccaatataactccgcttctcaattgttcggacaatcctcttccgtctatggaggtggtttggactcatcttcccaacttttgggtagtggatatggcagtggatatggcagtggatacggcagtggatttggcagtggcagtggggttgaaaatctcaatgttcagacttattctcaaggtctccaaggattgcaaggattgcaatcatcccaagtactaggagaaggccaaagtttccaatctggtcaagcctttgaacagggctattcccaaggattagaaggattgcaaggagtacaaggattccaaggagtacaaggattacaatcatcccaagtactaggagaagtccaaggtttccaatctgctcatgctcaattgccacttgcacagacctattctcaagtccaactgccagttggttcaactcaatcagttcaagcccaattgccagctgtacaaagttatactcatgaacaacacgtacatcccactcacagctacaactacatcaacaaggctgtacctgtatatgtacccaaaccagtcccctatgaagtaaccaagaccgtacaagtaccaactccttacaaagtaacagtaccaaaaccatacgct

SEQ ID NO: 7042 - DNA, 946 bp, Diabrotica virgifera
  misc_feature (734)..(751): n is a, c, g, or t
  misc_feature (891)..(891): n is a, c, g, or t
  misc_feature (924)..(924): n is a, c, g, or t
acggaactgaatattgggcagtgaaaaagaaataagaacaacgaatgcatgtggcggaaattaagatgcttacatggacaattggagtgacaaagaaaattaaagtaagaatgacagataaaattaagtaagaatgaggggcagtataaggattggaccaattaataccaaaatgagagagcctaggttaagttggtatggttatgctcaactcgagatgttaatcacccaatataaagaatagttcatctacttctgggaggagttggggaggaagactaaagaggaactggagaaaatgtttaggcaatataagtctgtaaaggggattaatattagtatagcccaagtataagtcatctaggaggaagatttcgttttggagaatattttaggacataaggagaaaaaatgaactatttaatttgacgtgaggaaaaaattttttctgcaataaacgcctcataaacaatatttcttaggtgaagatgcaacattaagttaaatgatatttagcataaggcttctgttttgccgaaattgtttgacacagaaataaaaaacatattatattaattctacaatttttatttatattacataagaaaggttaaaaattttcataaactaaagaatacatcagtcagattatcaataaaaatctaagcattgtagtctctgaccttccatggtaccctaagaagaagataagataacaataaacttaagtcacnnnnnnnnnnnnnnnnnncctatacgactacaggctggtaaacttgttcggtaatcaaaggagcatttgtcttagtagctctaggcgatgcaaaaccactactgatgaggaatatatttttccattttgtcacatccttttgctcatattcgtgattngttattttactgcagcgcaaattaccacaccancatagaatatcataaatatcac

SEQ ID NO: 7043 - DNA, 231 bp, Diabrotica virgifera
  misc_feature (134)..(166): n is a, c, g, or t
  misc_feature (195)..(221): n is a, c, g, or t
agaataaattacccttagggaaaacagcgtaatttttttggagaggtccaatcaataataaaaattgcgacccccatgttggaattaaagtttattatttggggaaccaagtttatttattaaatctgtttcannnnnnnnnnnnnnnnnnnnnnnnnnnnnnnnnccggggggaaccaggttgggtttcttttnnnnnnnnnnnnnnnnnnnnnnnnnnncaaaagggac

SEQ ID NO: 7044 - DNA, 321 bp, Diabrotica virgifera
  misc_feature (178)..(316): n is a, c, g, or t
ctttttctatttttttcatttatttatgtgtttttgatcctatattatggataataagattaagttaccttagggataacagcgttattttcttaaagagttcttatcgataagaaagtttgcgacctcgatgttggattaaaataagtgataggagcagaatattatttactaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttt

SEQ ID NO: 7045 - DNA, 1144 bp, Diabrotica virgifera
  misc_feature (805)..(895): n is a, c, g, or t
  misc_feature (959)..(987): n is a, c, g, or t
  misc_feature (990)..(1013): n is a, c, g, or t
  misc_feature (1103)..(1123): n is a, c, g, or t
gccatattacagtgtaaaaatggaaactaaacaggatagtcacgacattgaagcacagacagtaaaaggttttgaattcaatgacacttcaatacgaagaggattcattcgaaaggtttatgccatactttcactccaagtagcaataacaactggagtcatcagctggtttatattccacgaaccaaccaaactatatgttcaacgccatcctgtacttctattgattgctttggtactgattctagttacgatcattgctttggcatgttgtggacaactgaggagacagtacccggccaatcttatattcttatttatatttacaatagctgaaagcttcctcttgggtacaatttcttcatattatgacatcgatgtagtggccatagctgcaggtgcaaccgtcatcatatgccttggacttactgtgtttgcctttcaatctagaatagattttagtgtttgctctggaattctcgtggctctatctctggtgattctcagtttcggcatcaccgccatcttctatcaaaatgacaaattccggttactgatagcagcgttcattgttattttcttttcaatatacttggtagttgatacgcaactgataattggaggagctgggaagatcagtctctctcctgaagagtacatatttgctgcacttaacctatacctggatgttattaacatttttttgtatatcttactcattgttggtcgtgctgcgcgataatattaaggttttgtatcagttagatataagttagtgtaagctatcaaataaatttagataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcataaatagggaggagaagtctttggggggggccctcaaaatactttctttggaaccggnnnnnnnnnnnnnnnnnnnnnnnnnnnnncannnnnnnnnnnnnnnnnnnnnnnngtggggtttattaaccctttgatcagggtgaaaattttggggggtcgccctataaagccctcctctccccccctccccttaaccacaaannnnnnnnnnnnnnnnnnnnnaccaatatagcctctgggcga

SEQ ID NO: 7046 - DNA, 881 bp, Diabrotica virgifera
  misc_feature (849)..(878): n is a, c, g, or t
ctgaaaacaaacaagctgaagttgaaacaaccgttctcaaatttgccggaacgataccaacaaaagaaacaactttgggacatctaaaaactagacctttaccaatttcagaagatttgaaaagtgatataaagaaacatactgttaatttaactgacaaactaagattacaacataaagaagcttcgaagaatagtcggtataaaattgtaaatctacatagacccaatttagatagttctgacaaagagactgatgataagtttaccattcttgatgtagaaacagatattaacgaaaatagctctcaggcagtgaataaaaatgatacagaagagcagaaatacgtttatgacttatattacacaaattcagataaattatgcgaaagagaaatcgaagaatatgttagtatttaccccttaaacgattcgttgctcatgggatcagctcgagacaatggtttggatgaatctgatagcgaagacagtgaagattcaaatgccgaaagcaactggagaaatgaatatcccgatgaagacgatatggaatcaataaatgaagatgatatggttgaggctatgaaaaacgtggacttagatgacctctccagcgatagtgaagatcatatttacagtgcaggcagtgatgatgaataccatgatgctgttgacgatgcagatgttaatatgtatgggaaaaggtatgctgcattcaaagcaaaacataaacatggggtttgtagagactactagttttagcaataatgatctatattatgggggatattgatgaaaatgaatattattactaattagtggagtttagtaggatagaattatatgtttnnnnnnnnnnnnnnnnnnnnnnnnnnnnnnccc

SEQ ID NO: 7047 - DNA, 1125 bp, Diabrotica virgifera
  misc_feature (2)..(588): n is a, c, g, or t
  misc_feature (596)..(629): n is a, c, g, or t
  misc_feature (631)..(726): n is a, c, g, or t
  misc_feature (732)..(800): n is a, c, g, or t
  misc_feature (803)..(892): n is a, c, g, or t
  misc_feature (911)..(928): n is a, c, g, or t
  misc_feature (934)..(953): n is a, c, g, or t
  misc_feature (1024)..(1041): n is a, c, g, or t
  misc_feature (1078)..(1120): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacataatnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttagggataacggcnnnnnnnnnnnnnnnnnnggtccnnnnnnnnnnnnnnnnnnnncgaccccccaaggttgggtttaaaatttttaattggggggagaacctattttttttaaagtctgtcccacnnnnnnnnnnnnnnnnnnggtattgtggtttaaaaccggggggggggcccggggnnnnnnnnnnnnnnnnnnnnnnnnnnnnnnnnnnnnnnnnnnnggggc

SEQ ID NO: 7048 - DNA, 761 bp, Diabrotica virgifera
ctgcagatgaagctctagacttactgtaaactactgttctggctcatgtacccgtagaagaatataattttagactcaaagctatctatctacgactgatgatacacaaggatatcgaagcacaaaaccacagccaactactggacgacaggaactattatgggaacaaaagattgaaattgaatgggtctcttatttctctaatgttcgaatacgtgattcaaaagagatcaactgtggaactcacggccatcttcataaaagaccagttcccgagattacggctacacagtttgacgtcatcaaatacatgagatctgatttgataacaagttgtttgcttgtttgctatatccacgctaaattggaccatacaacgtttcagaatggaacggttgggagttactcgagctctttcgaggatgagctacatttctgcgttatgtatgatcgactagagagaactcacagcttgaaaaaaccaggaaagtgtcatcacccacgtgtcttcactctacccagagatgaatgctgtgtccgagtgatacacctgaaggagagagttgtggattatgaactaatatggcatggatgactcacattaccacggaatccgaccaattccccctcatcatactgtcccgaaatgctggagtcgatgaccttaataaggatgctagttttgctatccattctccttcaacgtgtatagcatttctagacggtagtatcttgctaatctcgaaccactataggaaact

SEQ ID NO: 7049 - DNA, 272 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (162)..(190): n is a, c, g, or t
  misc_feature (204)..(232): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagcttaaaccggtgtgagccaggttgggtnnnnnnnnnnnnnnnnnnnnnnnnnnnnngaacgaaaggaccnnnnnnnnnnnnnnnnnnnnnnnnnnnnngataatattttacaagacaatcctcaaaaactaaaaatat

SEQ ID NO: 7050 - DNA, 754 bp, Diabrotica virgifera
  misc_feature (440)..(471): n is a, c, g, or t
cgggcaaaaattcgacaaaattcaacagactgacggccacaaaggtaaacaaaccagaaccgtcacaaattgtactcaaaatatgaaaacatccccaaacgtctttttttgtacctatctctttccattgttgactgagtctagagcgttcataaaaataacatgtgtttttacttaataataggcggtagctggtttgtcattagtttcatacgtggaagagaatgatgctagataaaaagtatgtgttttatctcgccaggtattaatgacgcacgggtaaagaattgtggactcaagtgtacgaaagtagttccgaagtttatgaacaatataggtgcgcttttaaaggttcatgaccactttttcggcatttggaaccatagtgtggcgtataaaaagtggagtagaagttgtcaagatctagaatactacaaaannnnnnnnnnnnnnnnnnnnnnnnnnnnnnnngtatacagggtgtccccgaagatggtgcgttcctttgaggtgtggatataatacacaatttggaacaaaaaagtactataacatttttttctaaagttaactgtttctaagaaaaaattacattgttctccatataagtgaatttttattttcataaatttgaatggcatggaaacgtagcctagaaaacttgctgtgactgtggaaatttacctaaaaaccccttggttatttacttttaggtgtgagttttggggtggtgaactcacaagcaactacctcc

SEQ ID NO: 7051 - DNA, 95 bp, Diabrotica virgifera
ttttcggcttctcttttctctgactttgcttgtatcgatcttttgggtgcgtttaacgttatctatttacctccaaaggtggataataccgttat

SEQ ID NO: 7052 - DNA, 985 bp, Diabrotica virgifera
  misc_feature (834)..(835): n is a, c, g, or t
  misc_feature (911)..(911): n is a, c, g, or t
  misc_feature (933)..(933): n is a, c, g, or t
gaatcattaaaattttgccacttttatctcgctttcgataatcataaaaaataatgacaaaaaccacttgcaataaaactgcttagtatttcttggtgaccctcgagatgatgttattaaaaaggtgttgtgttgtactgattattttatcatctactatagatgagagccagagtattattgcttctcgttcgttgagatcaggattcaggcgcacttcactcggtacacatattagttctttaggatctagatctcgctcgagattatctggatcatcctttgtagttagtggatcccgtggtagtttatttcgatccagtggatcacgtggtagtccatttagatctggatcgccaggttcaagttcatctggatcatttaattcttcctttggatctcacgaaacttcatttgcatctggatcaagttcgcaagattcaagttcatcacttgggtcctctggaacttacagatggagcatcactgccaaaccagttacttctagacccgtccatagatttgatcctgtgacaagtagattccagacagtaactaacagaacacaacctgcttcaagccgattccatacagctgcacctgttaaaccagttacttctagacccgcttctagatttgatcctgttacaagtagattccagccagtaaataatagaacacaacctgcttcaagccgattccatacagctacacctactaaaccagttacttctagacccgttcctagatttgatcctgttacaagtagattccagccagtaactaatagaatacaacctgctttaagccgattccatacagctccacctttgnnaaggacttattctaggcaccttgtccttaacccgaattttaatgctgctccaagtaaggatatcatttctcctggnagtcgcaatgccactaccaaancaccagcgttcaattcctcctttacacatctccacagttaaatgcccctaac

SEQ ID NO: 7053 - DNA, 95 bp, Diabrotica virgifera
tttcgtccgccttacaatatttcatataaagtatttatttcctatatgtatttgtgactggacaaagaaattacagacctatactaacagatcaa

SEQ ID NO: 7054 - DNA, 374 bp, Diabrotica virgifera
cgtgttgtctacccacgtagcagagcgaaaacttaagagctaggcgttctttctattttggaatctgtgtttctgaggtttttcttccagtaaaagaaccggaaaagaggggaaagttggaggctttgtaggaaaggggtggctagacgtaatcgcgggagcggacttgattgctacacgggctccgacgagggcgtggaggaggaatgtggcacaaatgcgtgaagctacctcggggggaacgggctgaccatcacgcaaggacacagggtaggcgtgcggtcgagagacacagcgcagggtggcaagaggctcatcctagaaaggggggggggcttgtcgccggaactgtgaagatgggcgccctgcacagg

SEQ ID NO: 7055 - DNA, 668 bp, Diabrotica virgifera
  misc_feature (2)..(65): n is a, c, g, or t
  misc_feature (67)..(89): n is a, c, g, or t
  misc_feature (95)..(112): n is a, c, g, or t
  misc_feature (123)..(150): n is a, c, g, or t
  misc_feature (157)..(237): n is a, c, g, or t
  misc_feature (256)..(320): n is a, c, g, or t
  misc_feature (328)..(384): n is a, c, g, or t
  misc_feature (386)..(419): n is a, c, g, or t
  misc_feature (459)..(477): n is a, c, g, or t
  misc_feature (544)..(562): n is a, c, g, or t
  misc_feature (602)..(651): n is a, c, g, or t
cnnnnnnnnnnnnnnnnnnnnnnnnnnnnnnnnnnnnnnnnnnnnnnnnnnnnnnnnnnnnnnnncnnnnnnnnnnnnnnnnnnnnnnnccgggnnnnnnnnnnnnnnnnnngaacataatcnnnnnnnnnnnnnnnnnnnnnnnnnnnngaggggnnnnnnnnnnnnnnnnnnnnnnnnnnnnnnnnnnnnnnnnnnnnnnnnnnnnnnnnnnnnnnnnnnnnnnnnnnnnnnnnnaaaaaaaccccataaaggnnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnttaggggaacacgggggaatttttttgggggaagttcaannnnnnnnnnnnnnnnnnnacccccgtggtgggattaaattttttaaatggggggtgaaccctttatttttaaaattgtgttctcnnnnnnnnnnnnnnnnnnnctattctggggttttaaacgcgggggggggaccgggggtnnnnnnnnnnnnnnnnnnnnnnnnnnnnnnnnnnnnnnnnnnnnnnnnnngaaaaaggggggcacac

SEQ ID NO: 7056 - DNA, 943 bp, Diabrotica virgifera
  misc_feature (273)..(290): n is a, c, g, or t
  misc_feature (336)..(365): n is a, c, g, or t
  misc_feature (489)..(520): n is a, c, g, or t
  misc_feature (593)..(618): n is a, c, g, or t
ggttgttgctgtgtttggtttgttggtgcattttattattataacaagttcattacaatgggcaaaaagaaggtacaagagagtgaaagtgaagaggagtattctgtagagaaaattattgataggagagttgtagatggaaaagtacaatattatctaaaatggaaaggatattcacaagatgataacacttgggaacctgaggacaatctagattgtcctgaacttatttctgagtttgagaggaatcgtaaaagtaagaaggctgctggnnnnnnnnnnnnnnnnnnaagagataattctacatcttccgtggattcaaacaattcatccacnnnnnnnnnnnnnnnnnnnnnnnnnnnnnnccgttctccatcacccgagtctgaaagtgaacccagctctaaaaaatcaaaaatagatgattcagatgatgacaaaaagagcaaaaagaagtcgtcatcaaaagatgctgattccgatgatgannnnnnnnnnnnnnnnnnnnnnnnnnnnnnnngtgctttagatgatgactctgacgatgagaagtcaaaaaagtcaaaaaaaaaaagattctgattcagaagatnnnnnnnnnnnnnnnnnnnnnnnnnntggtcctaaatctcgtaaagctgccgtttcagatgactcagatgaagatgaagccccaaaaaagaaaactgaaagtcgggcgaaaaaagatgatgaaaaatccaagaaaaaagctgatgattctgatgatgaagatgatccgaagaagagcaaaaaagttgacaacaaggaaataaaggctgctcaacctacagacaaagagaagtctgcatttgacaaaggtttagaagctgataaaatttatagtagcatctgacactagtggtctattgatgttcttgatcgaatgggagggtacagatgatactgactcagtttatgcaag

SEQ ID NO: 7057 - DNA, 945 bp, Diabrotica virgifera
  misc_feature (361)..(383): n is a, c, g, or t
  misc_feature (830)..(865): n is a, c, g, or t
gataattatctattgcagtagtataaattcgtcggcttagtgacacagaaatgtgactacattttgtctcgttttgggatatgtacactactgaacttaccttagtgagttcttttgagtgacacctctttctgaacacctaaaaccccagtgaggagttacgaaaactcctcactacgaaactcactaaggtaagttcagtttcgtagattgaacttcaaaacgtgaaatgtagttacatttgtgtgtctctaagccgacgaattgtaatttgtaaacaactttactattttgctattcaacactgtttttacttaatgtcttctatctagatgaccttgtttataagtattattgtggnnnnnnnnnnnnnnnnnnnnnnnagttaaattagtctcttatcgaatataatgaaacacaaacaacacatcaaacttattctgaaagtatttcttgtcatgttatatttcattagcttttggtgtaataaaccacaacctatcaaattcaatatcaaaattggaaatgattgcgtaactaaaattatttcctcccttcagctaatttttcacccccgttgaaattaaacgtagttttttttatctaaataccaacctgcaatttccaagtaactctttacaatctttaccatctacaaaaatttaagggggattcttagggtggaaaatacaagaatatattgtcgaaatacaaggcaataaatcaaatttcttaactttgtaaaaaagggtaatttaattggctggctattatctttgttatttctattggtgacatttcaatttattgcattttcctttttttgtggnnnnnnnnnnnnnnnnnnnnnnnnnnnnnnnnnnnntttcctttgtgttaaaccttgttaattatgcaaccccgctctttacttttccaaatcccaaaaaatttgttccgcggggg

SEQ ID NO: 7058 - DNA, 709 bp, Diabrotica virgifera
gttgtcaaaatgaatattacttttatttatggtatatactttatatataaataatactagatgcaaaagtttacatctttccatataatatatatgttaatgaatccttttacaagtatagccttaaaaatcagtcatgattgaagaagaactggatgccttatcagacttggcttcaattcatgcagatcctccggtaatgagagatatatgctctaagtgccatcgtccttccacagtttgctattgtaaatggataccagttccacctatgtgcccaaaaagtagtattatactgttacaacatccagcagaagaaaagaggtgccttagaactgccactatgttacaattaggtttagattcttcaaaatgccttgtatttaaagggaaacgcttcccgggaaagtataacattctagaagatatattaactgcttcaaacacactattgctttatccaagcaaaacagctgtagatattagagaagtgcttagggaaaattctcataagttttataatatagtacttatagatggtacttgggcacaagcaaaagcaatatatacaggtagttcgattttacacaacattaaacagattaagattttgcataacgatacaagtgaattacataattagaaatcagcctactgatgggtggttgaaggctatctaaacagcagctttaaacattgactgttttat

SEQ ID NO: 7059 - DNA, 156 bp, Diabrotica virgifera
  misc_feature (4)..(155): n is a, c, g, or t
tttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 7060 - DNA, 699 bp, Diabrotica virgifera
atgtttctctgtctgactgtctttcttcccttgtctttgctttcctctttatttcttcatttgtctctttcaatatttttcaccccatttatctcttctacgttttccactcacctctctttacaacatgagggagaattctgtcacacgcgggaaaagacggaaacaaaaagagaataacttctgcctgtttctcccgttgttccacttacgttttctcactacccttctccttctctatatgggagaatttactccatggacctttctgataatttttgaagaatttccctctgagtgacactgtgttgctttctctctatctctttgacctttttttctccatttatgtctgacacttcctcgatctccaccaccctttgtttcacccgcgcattctcacactcgggccaaatctataactaaaagagagactgcctctttcaccctatatcttgcatcttctctcctaggaagactttatatactttgggggaaatcctctatgtgagacttcctctacaacacgtctctgccagtgtgagaaattacgtcaccttgtgtctaaattaattgtatcattctgtgctatattactatctctcatttccgcttgtatctgctcttgcctctcactgtctatcctagtgagcaacaatgaatacaagaaatcgaatcatctatgaaactaccaaacta

SEQ ID NO: 7061 - DNA, 981 bp, Diabrotica virgifera
  misc_feature (795)..(795): n is a, c, g, or t
  misc_feature (898)..(899): n is a, c, g, or t
  misc_feature (912)..(912): n is a, c, g, or t
  misc_feature (922)..(922): n is a, c, g, or t
ggacaacttgaaccaaacatgattttttgataaataatcaatgtttgttcgaagatgtggttagtagtgcttctttcaatattcggttgtatactcagtattgtagtactttttctatttctgttgtggttatatgtacactttgagtatgttgcttgtactagtgatgtttgtttagtgggaaaaacggcattagttacaggtggaagtaaaggcataggatatgacatagttttacaactcgcctctaggggctgcaaagttatcatagccagcagaacaatagatgaaaagctgaggcaacagattatatgggaaaccaataacccgaatatagtactggaacatgttaacatgagctcctttaaatcagtacgtcaacttgcaagtaggttaaacgagtcggaatcaaaattagatatattaattaataatgctgggattccacaatgtttagacgttcctacagaggacgggttgaatgaaacaatgcaggttaaccattttagcgcgtttctgctaactcatctacttgtggatcttttgaaaaagtcagcaggcgctcgagtaattttcacaggatcatttttgtcttattttcacatgatgtcaagggtatctgtaagagattttaaaattgagaatgctatgtttagaatctttgactaccctaattccaaattctgtaatataataagcgcagacatgtttgcagttaaactcaaacgatggaatattacttgtaacagttaccagcctggaatagtaaaaacagagatatttaatacggctganaaggagttgaagagtttattcgatattttgctattttattccacaatatacctattcgcgaaatttggtgtgaaacaagagtcactcgccagggcgccgttcnnaatagcacatccnaaagagtttngagaatgtaacaggaaaatttttgttggtagatattttaataacgtacgacctagggca

SEQ ID NO: 7062 - DNA, 419 bp, Diabrotica virgifera
  misc_feature (359)..(382): n is a, c, g, or t
aggtagcggcgcggaagtcccggggcgaccctctaggccgcggaacagacatacatcgtggtgacgtccgccttttgttgtagagaaggcttgcgcactaaaaacagatacactacattgtcgaactacctttacgatacttattgttttttccatcttgatcagatatatataactcaagtggtagaaagacttggagaatgcgccaccctattaagacctcgatcccagaccccaagcccattgccgccactgcaatcacatatggcctatccctggacagatgcctgagctcaacggacttgggggcgccacctataccgcctggaagatcccaccatgaatctaggcaaatggtnnnnnnnnnnnnnnnnnnnnnnnnccgacgaatattatggaaggactttcacaggaagatg

SEQ ID NO: 7063 - DNA, 937 bp, Diabrotica virgifera
  misc_feature (854)..(871): n is a, c, g, or t
gtttcaaaatcgtttatttttgaaaacactactgtttcggaaagtacggaatcaagtgtagatgataaactattttcaacgacgatactcgatgaaagtaaaacaacagaaaaacttactactggacaacatgaaaccctggctgatacaagtactgaaatgaaaactgagccagaaagaacaacagaagtatccactgagtcagtacatgaaacaactgttttcgaagcagtgactactgaaaattatgtaaaagtgaaaagtgtgtttacagtgcctacagtgcagactactacaactgtgttgccagagatctcaagcgctagtacgaaatccatttcgactgcttcaactaccagttcacctacgcctccaagtgttttaacagagatctcaagcagcaccagttcaacactattttcaaccgcttctactactagtccaactacaactcaactacaagatcttcaacttccatcacgactgggtcttatacaccaacagccaaatttaggaataactctaatgatttgggtggaaccactgtgaccactttctcctcttgttacttccaggactgaagactacgtttctgatttctcccctgcttctgatggtgaaaggagtggcagggatgataatacggaaaaaatgcaggtattgtgatattaacagtgggagctgaatcgctcatattggttgggtggacttttggatattaaggaggaagagacaaaaccggttccactattaaacaaagatgcagacccgttaagcttggaccatttacaatggggattattgtttccaagtttttaattaacccaaaagaaggaaaggttggaaaaaacagnnnnnnnnnnnnnnnnnngggaaattcctgctttttgaatgattaacggggggggggtttccccctcccctttggatttttccc

SEQ ID NO: 7064 - DNA, 326 bp, Diabrotica virgifera
  misc_feature (9)..(147): n is a, c, g, or t
  misc_feature (247)..(265): n is a, c, g, or t
  misc_feature (285)..(313): n is a, c, g, or t
gaattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaag

SEQ ID NO: 7065 - DNA, 153 bp, Diabrotica virgifera
  misc_feature (10)..(58): n is a, c, g, or t
atctctctannnnnnnnnnnnnnnnnnnnnnnnnnnnnnnnnnnnnnnnnnnnnnnnngtctctcgcttgcgctctctctcgatgactagcgctgggtggatcaggcgtcgtcgaacggtagagagacatcgagttgggccagcacgctgtta

SEQ ID NO: 7066 - DNA, 702 bp, Diabrotica virgifera
  misc_feature (55)..(83): n is a, c, g, or t
  misc_feature (85)..(97): n is a, c, g, or t
  misc_feature (101)..(128): n is a, c, g, or t
acttactacaagtgtaccttttaaagttaaaaacataaatattctcatttgctgnnnnnnnnnnnnnnnnnnnnnnnnnnnnncnnnnnnnnnnnnngtgnnnnnnnnnnnnnnnnnnnnnnnnnnnncaaaaaagagcaggcttgacatttaatgatgcattggttcgatggctctactcgagttgcttgggagcagaaagggaatgaaggaaattgctccattggaagccgagaagatgcattttgttgacgtataccgattttgaactttgagggttgcattttctccaacctggtttttgattggaattttgctatttttggcaattttcacacgtgttatcgatggtttttgttataataatgtatgttgtgaggattttaaggatatgaaggttggtgtggagagggaggacaagggtaaaaaggtgatggtttgaaaattgtgatcctattgtttatatctttgccgtacatttcggtcaactttgaccggttgtgtctcgggagccactcgtcataattgaacgttttttcttttaagagaggcgtcctgccgctgtctttcgaataccgttttcacaattttgatttacattgatattttccgagatattcttatttgtattaaaagtcaaggaattgcttgataattgtgtaatattaattgggggctctttaattagcgaatttttatttc

SEQ ID NO: 7067 - DNA, 866 bp, Diabrotica virgifera
  misc_feature (30)..(50): n is a, c, g, or t
ggaaatggcaacaaaagtaaacattggggnnnnnnnnnnnnnnnnnnnnnatatgtagataacaaatgtgctgaagaaactaatcctttcaaatttttagtgctcgcgtaaaaataaccaaatttaaaatgaaaccagattttttatatttaataccgagtgcgttgactgtagtatatgcgacctatggaagttggttcctgattgctgagatattcacaactttgatacctttaactttaatatttactggaattttagtaggagtagtagttatatttagagttccccctcccgagaaagacacagttgaagctatattgggtaaagaaattgatgatcccacaggagataatggatttgttattaagacaatagctcacagaggagctggcctggacgctccagagaatactatagaagcctttaaaaaatgccacgaaaaaggatgtgatgtgatagagatagatgtggtcctcacatctgatggtgtaccagttgttttccatgactccaacttagaaagaatggctgacttaaatattgcaataaaggatatgaagtatgaagacttggccaaaatagacatttcagtaaaacatgcttacagagattcatttcctaattctcatgtaccaacattagagcaggctgtagaacaaatgcttgggatgggacaaagaattttcattgatattaaagaaaataacaataagatggtccctgtaatactgaaattatttgaaaagtttcccgaactcaaacagaaagctgtaatcacatcatttttccccaatataatttatttgattagaagaaacaagccagaaatagtaggattgttggcatggcaaccctgcattttc

SEQ ID NO: 7068 - DNA, 790 bp, Diabrotica virgifera
  misc_feature (231)..(253): n is a, c, g, or t
  misc_feature (382)..(406): n is a, c, g, or t
  misc_feature (412)..(434): n is a, c, g, or t
  misc_feature (586)..(603): n is a, c, g, or t
ctcgagtttaccacgtaaactataatcatagttaacgctcatagcggatagactagcatgtcaaaccgaaagccttttgaagttatacttctttaggcgcgattgagagtgaatttttattatcctgggcgcatgcgcacacagagagtatgttgttagttgctaaatcattcaagttatgtctgtatcagcgcaaataaggtttgaaaagaatatgttagtgttttcagnnnnnnnnnnnnnnnnnnnnnnngtgtctttggatttgtcttcctcgggagtaagataataagtgttaaacaaagccctgatggggtattggtagagcattcgactacagatcgcggaggtcccgggttcaaatccggacacggacgattcnnnnnnnnnnnnnnnnnnnnnnnnngtattnnnnnnnnnnnnnnnnnnnnnnngtggtagtatcaaaattagtttaataatgaaataaaatacaaataaactgttttaagtacattttgaagtataacttcttacgtgcgcacaaagtacacacacattctttttttttgtatttgataacctgtagttttttatgacattctgnnnnnnnnnnnnnnnnnntcgctgtaatcaaatttttattgaagaaatgcatgatatattttcaatgttttacgtttatattgggtattaaagtttttttgataaaaaaatagtattacataaaacatttcttatatttgtgtaatctaattcttcacaaatggattgtttatgggttagatacttataatccttcatttctcga

SEQ ID NO: 7069 - DNA, 857 bp, Diabrotica virgifera
  misc_feature (22)..(41): n is a, c, g, or t
  misc_feature (89)..(110): n is a, c, g, or t
  misc_feature (748)..(748): n is a, c, g, or t
agttttactcgaaaaatgtaannnnnnnnnnnnnnnnnnnngtgtgatatttttgtgcctaatattttatgttattatagtaggatgtnnnnnnnnnnnnnnnnnnnnnngctttcagatggcggaccgtgacccgtataagagagaacagcagcggttgattcagctgtatgacgatattacgtcggatgaagagaactcagatgctgcttatgagggagagttcagctcagatgaaaactatgtacccagtgagtcgtctgcctcgcagtcagatgaaagtgaagactctgatttaaacgaactccccgagctctccaatgtagagacgtctaataatactcttcacaatccccagcaatataatctgccagaggaaagtgaagtagaagagcccgacgcattggaccaggattcccagaaaattattcagaaatctcaagacagtatacccctacaagcactgcagaatcaaaattctgattcttcagatgacatagatacagaatgggagtttacaactgcagatataccagatttcaactttgatgaatccactaatcgtctgaaaattaatttaaatgcagaagatagtccaaaagatgtttttgaatacctatttaccgatgacataatgagctatttggtggaatgtaccaacaattatggagaagatttaacaagatctaatagacccaaaacaaggaatgctcgagataatagttttagacctgtgactattgacganatgaagaaatttttggcactgtgtttattgcagggtcaaattacaacttcaacatgcgcaggttgtttcatatggagatgtattgtactttcatccaatttttagttac

SEQ ID NO: 7070 - DNA, 125 bp, Diabrotica virgifera
  misc_feature (10)..(22): n is a, c, g, or t
  misc_feature (24)..(42): n is a, c, g, or t
ctggtttgcnnnnnnnnnnnnnannnnnnnnnnnnnnnnnnnaaaaaaacaatgggggggcccaaggggggtaatttttaatgggtttttaacatcggagaaaatcccccaaattttcccccccc

SEQ ID NO: 7071 - DNA, 351 bp, Diabrotica virgifera
cggatgagagatgggctctggtaggcgtaaggtaagggcacttgtggggaaatgtacacgctgtgtgtgtagagggcacggatccagcgaaggggccgcacgtgctcgtgctttcggtcgaaccggttatcgtctgtgcgtcatccgcagcgggtggagcaggggtggtggttgcgttcgacgtcggggtgtggcggtaagggatggaacactgtgagtgcggtgccgagggaacaagaaatggggtgggggagtggcgaggagaattggacattaatagacgcgacgagtgtcttaccaaaattgaagcgtgcgcctaattccctatgagggcaagctaggactgcagtg

SEQ ID NO: 7072 - DNA, 244 bp, Diabrotica virgifera
tgaggttgatgggagggagagaaaagaggtggaaaagaagagagaaagagaagtaaagaggatgccccgagagggaatggaagaaggtagaggagataggagaagaagagagacagagaggaaatagagagggggagagggaaggagaggagagtggtgggggaaagtataaggtgagagagaagaaggacaggagagagagaggagaacgaagggatgggaggaaatgaaagaaaggtaattg

SEQ ID NO: 7073 - DNA, 932 bp, Diabrotica virgifera
  misc_feature (660)..(676): n is a, c, g, or t
  misc_feature (678)..(694): n is a, c, g, or t
  misc_feature (835)..(835): n is a, c, g, or t
  misc_feature (842)..(842): n is a, c, g, or t
caaatggtaggacaattattccatattgcagaagatcgagaagccttcgcaatgggtgatcgccaaggtcggataattctgatatggcacgtgaagaagaagaagttcttcgaaaatctctggtattatttagtctcttaatacaaccaagcagtttcatagccttgttgcatctttatgaagattgaagatctctatcacacctaaatctctgacattattgatagtctcaatcaaaatatcctctaaattataattaaaaactataggtaccataaggctccagagatcgacaaactatccagagatcgattttgacaactaataattaaagtaaagatgattcaaatttgattacagaacagggccttcactatgtgtttatatgtatgtatttcggctttaacgtggcctcatcggagcaccaggtgccaagaaggtgtaagagaaacaaaatcttcttcgtatgttttattaaaaaaactattccaaaatgtacaaacgtttctaacctaaatataaataccaatcaatttataaaaattgcctataataaattaacacacaatactcctaacggtgaaaatactggctccagttataccaatggactggtttgcataatcaaatatgcgttttcttcttcctccggggccaatnnnnnnnnnnnnnnnnncnnnnnnnnnnnnnnnnngagacagctttagattacattcgattcgaggtcactagcatcagctgaccaaggtttctgcttttcagcgtcttcagagccgcctgtgatgtatcccgaagcgaactgaatacaagctgtcgaagtatgtatattaataanatattanatgcgtacggacgcgttagcgacatctatctagagacagagaaaattctctataagtcggagtgcacatagtaactatctggtacctgag

SEQ ID NO: 7074 - DNA, 838 bp, Diabrotica virgifera
cgctgcactgcagtgaacaaacatccctcaatgaatacttcccggttattctagcattcattcctgtgcactgacaaacattcccgttaagcaatggcttatacgtaaaaattgatattatttcgttacgggaaagctttttttggcgcgtgaaaatttgtgattgtttatgggagtatcaggaaaataacagctgtttatacgaatattactatgactgacgcgcaatttccagtgaacaaagacccgatgattgctttggacttggactacaggagctgactgataatatgagactgaaacgacgaagaagagctcaagtgagtggatggagagtgatgcgaagatgtgttatattttttactgcgatatgtgtaataccagttttattagtactgatggtagcgactgatcgttacttacaaccagtaaggcgacaaacacaatacatgcaccgacaggtaaacgaagttggaaaaatacaaaccggatcgcttctaaacaaaaatatgtcactcatcgctaaacgactcgaaaatcgaaaacgacatatgaaaaacatgtgcaaattattgggcctcgatcgaccaggaaacgattcattgcacaaaccaaattcttgggagtttttagtagacaataagcaccaccttatctggtgcaatgtgtttaaggctgccagcacttcctggatgtataattttaacatattggctggatatagcccaaagtttttaaagaagagcaaattagtacctatgacgttggccagacagaagtatcctcgtccatcacttaaggatcttcgaaaggcttttacacttccatatcgttttta

SEQ ID NO: 7075 - DNA, 877 bp, Diabrotica virgifera
  misc_feature (787)..(787): n is a, c, g, or t
  misc_feature (811)..(811): n is a, c, g, or t
acaacctattgatgaaataaacagaaagaagaggatgaagaaacgggctaagccactttttaaagtatgccatgtaaatcaagacataggattacccaatttagacaaggtaaataaggagattaagggtaagcctataaaaacatttagcacacctactgtactgtcatttgcacccgcgaatcatgcatttaaaccctcaaacaacatgcattcagtgcaatttgccaagccagttgaaaggaatagaaagccaaataactcattgttgtcaagtcaaaaacccgcaaacgctacgaagtcgctgataaaatcagagtctagaattaatgttgcaaaaaatcatccaaggactgaaactagagctaatggaaatgtctctaaagataaatcaattgaaccaagaattactcaaaagaaaccagtaactcaacaacgagaaatcattaaaaaacccacaaatcatacgaaatcatacactgctaagacgaatctttttagccctcaaatgacagcaaataatggacaattggcaaaaccatcacaagccagtaagaatgttggatggaatctacatgacacatttgatatgtcagatgatatatgtgatcaaaaagaacgttcagggaaaaagtataaaaaaactcctataaaaccaaggaatcaaattaataaatcaattgaacaaccaacacctgatgaaatatctcccattgaaaagaagggcagtggcttaaaaaaatcagtgggaaaacatgtaacaccgaacaagaatatatctacatancacaaattaaccaaataaacaccnaaccacactacaaaaaatggaaggttttttaaaacaccagtaaggaaaaagctaaaaactcccaaa

SEQ ID NO: 7076 - DNA, 546 bp, Diabrotica virgifera
  misc_feature (2)..(86): n is a, c, g, or t
  misc_feature (99)..(170): n is a, c, g, or t
  misc_feature (175)..(238): n is a, c, g, or t
  misc_feature (240)..(271): n is a, c, g, or t
  misc_feature (288)..(308): n is a, c, g, or t
  misc_feature (313)..(333): n is a, c, g, or t
  misc_feature (413)..(434): n is a, c, g, or t
  misc_feature (484)..(528): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnaaagaccctatannnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncttagggaaaaacgacnnnnnnnnnnnnnnnnnnnnntttcnnnnnnnnnnnnnnnnnnnnncgaccccccaaggttggggataaaagggttaataaatttggggggaaccaccctaatttttattaaagactttgttcccnnnnnnnnnnnnnnnnnnnnnngggatttcgggagtttaaaaacccggggggggggaccgcaggggtggggnnnnnnnnnnnnnnnnnnnnnnnnnnnnnnnnnnnnnnnnnnnnncagcaaaagggggcgccc

SEQ ID NO: 7077 - DNA, 164 bp, Diabrotica virgifera
ccggggcgcgagccgccaccacgaccccaccggcgcccactagcggacgaaaagacggctaaggccaggccccgcgggagggaaaaagccgaacgacacacggaaagcggagacgaccaacagcccgacgacaggatgcgacgaacgaacacgtccccacggaa

SEQ ID NO: 7078 - DNA, 644 bp, Diabrotica virgifera
  misc_feature (100)..(120): n is a, c, g, or t
  misc_feature (388)..(406): n is a, c, g, or t
ctatggtcattatggatcattaactcattacataacactttaatatgaatccattatacgttatatttttgtccatgatagcaaagacttatattttcgnnnnnnnnnnnnnnnnnnnnnggccttcggtatcttgatgtatagggtatttaccttttttatgtaatggtccacctatattgaaaccgaatttctcccgatccgatgacggagaactatcattgatacatcatgagtatggaaacgatccgccggataaggaaaatcacagatcctatgaaagagcagacaatcataaatgacctacatactaataatcactaattactagattattgacaataaaaatattgaactgactgatctatatgaataactttgcattcannnnnnnnnnnnnnnnnnnaattacgaataatagttttcctatataagaatatgggatcatgaacctagatactatcatactccaaaattagataaaagtaatatctccgaatgtgcagtcatccaacttattattataaatgatgattctgaatattcaagataattcggatatataagcatatcatatgacgtttactattggtctcctgaaagatcaccttcccatggtgattaggatcatgacagtctggatc

SEQ ID NO: 7079 - DNA, 185 bp, Diabrotica virgifera
  misc_feature (130)..(149): n is a, c, g, or t
tcccccccacgaaaaccctgggggaaaagaaaaaaaaagcttgaaaaaacttttggggggcccgaaggggggtaacttcctaaattggcttccccaaaggcggcgaaaaacccttgtaaaggttttccgnnnnnnnnnnnnnnnnnnnncccactggatagaacacactttttaaaaggattttg

SEQ ID NO: 7080 - DNA, 88 bp, Diabrotica virgifera
taatgcctggatgctgaatggtacatggctgacaccatcctgataccaacctcgatcaagcagcatgagcatcgtgactgagatacgt

SEQ ID NO: 7081 - DNA, 415 bp, Diabrotica virgifera
  misc_feature (12)..(26): n is a, c, g, or t
  misc_feature (313)..(337): n is a, c, g, or t
cgaagttaaaannnnnnnnnnnnnnngtcgtaagtttgttattgttctagttctactcctggcactttcgctggaagtagatgctagaagaaaaattttacgaggaagaaaaacagtcaacagaacgtatttgagggcagcggctataccatcatacgttattgtcatattagtggcaattggtcagatgattataggtggattgttctacgttattttgaaactctgcattttggataagcctatttcaccacgatatcaagctgcgccggttcattcacggaatggaccttagtaataataatttgcatcnnnnnnnnnnnnnnnnnnnnnnnnnaccaaaataccttgtacttaaaaaagttaatatcataaaattgttttatatagtataattataaactatattagaatt

SEQ ID NO: 7082 - DNA, 384 bp, Diabrotica virgifera
gaattaattactttggatatcatgtgctaaatattattactttgcgtattttaacagaaaaaaaccaataatgtaaatctatttttaccatagtgaggatatttcattattttaattgaatgggagagattacacttaaccttaatctatctaatacaaattctatgaccaaaatggtgtcctaattatctgcgacctgtgttacaaaatcctcaaagatttgaaagatggaagacgacctggacgacgagatattctaccgaacatacctttcacatatgaaaaccatgtcacgagtatcctggacggtacacttaaaaatctctcgactaacgttctcttcacgaatgtgggggcagctgaaaatctacgacgtcattgcgg

SEQ ID NO: 7083 - DNA, 800 bp, Diabrotica virgifera
  misc_feature (262)..(791): n is a, c, g, or t
gaaaaacaagtgatcgtattttgtccaccttcggtcaaaaaagtgttaaattttcatctgaaaattgaagataatgatgcaaaagtgcgattggacgtaaacattgacgaatttagttgtttttattttgtcttgtcttttttgttgtattcaactggggaatatgtatgttgtgagtggccctctgtagaagtgctgttctcagttttttttcgaatcctttccagaaaatatgaatactggtgttacgggcgaaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggttgta

SEQ ID NO: 7084 - DNA, 464 bp, Diabrotica virgifera
tttcgtccgctgaaagaaagcgcaatagagcttaaaccccattttttattaaaatctaattgattgattagttctaataaagttttattctcaatattcttaatattgcaaagtaaaactttcttccgtttagaaataatattattttcaagtatccccaataaaaataatctttaggatttaaatcggaggaacgaggacgccattccactaataataatctaccaatccaccttggtcactctgtatgtaaaaacgtgtcctttttattaaaatattgtaaaatgagttatctcgaattgaaaccttttcgatctttgaaattatttcgttgtacattgtttctgatgaagatacattgcaattttaatatgtaaataagaaacagtgactatattactactcctgtaccagctccctaatcacttgcatctctagccagataaggaaaaaataaaatatgt

SEQ ID NO: 7085 - DNA, 570 bp, Diabrotica virgifera
atagaagatttatgacctcccatgatcatgtaggaaatagtgtttccccttaatggcgaaaaaccacccacaaattgaagaaaaccagaacgacaccccagaaaaaaaaaatcatccaaaacttcttcagacaaagacagaaagcaacgacaccaggcaaaggacaccggcacacgacacgagacacgcaaacaagaacagagactggcgcagacatgtgagtcttctgactgagaatcaatacatagaggtactacgattgttcgacggactctactgggcttaaagtgatactaacccagccggacatgccaaattgatgcgagctgtagtccactggaatagatattgttaaaaattaatggatgaaaaatgtttctctattacaacataaatactgtacacttccagataatagatccgcgcaactgccgacaaaccgaactagactcgaacacattgaattgttcaactaatttaggtcagatgaccataatgctaaaaatttactaggcagatatcacaactagatcacagactacgtatgaaattaagtaatggtgatactgg

SEQ ID NO: 7086 - DNA, 1305 bp, Diabrotica virgifera
  misc_feature (154)..(178): n is a, c, g, or t
  misc_feature (325)..(343): n is a, c, g, or t
  misc_feature (451)..(468): n is a, c, g, or t
  misc_feature (633)..(660): n is a, c, g, or t
  misc_feature (726)..(749): n is a, c, g, or t
  misc_feature (935)..(955): n is a, c, g, or t
  misc_feature (983)..(1001): n is a, c, g, or t
  misc_feature (1041)..(1061): n is a, c, g, or t
  misc_feature (1076)..(1128): n is a, c, g, or t
  misc_feature (1189)..(1218): n is a, c, g, or t
  misc_feature (1240)..(1289): n is a, c, g, or t
atagggacaaagataaggagagacataggcggaaaagatcgagagatcggtcgcgagacagggaaagaagacgttattccacggaaagggatgatcacaggaagtattcccgttcaagatctagatctcggtgagcatttttgtaaaaatttcnnnnnnnnnnnnnnnnnnnnnnnnnctttcaatttattagccaaaatttacaatttcaagtacatataatataatatacagaaagacacctagatgggaaaagatctgtgtgtgtctatagaaaaatcctaaataaataagataaataaataagattacttataaacaaacnnnnnnnnnnnnnnnnnnnttcgtgaatcaaaattatttggaatttaaacttacaactaagtaaacagcatatctatataatataataatatgtaaaaaatccaaacttatagatattaggaattcnnnnnnnnnnnnnnnnnnctttttttcaggatttacaattcaaattgtgttttgtttccagtaatacaatcaactacctttttattaaacatttttatggatttgatttcttttattttgtttggtagtaaaataatacttgggtgccctaaaaatcacagaatgttggcttattcctcgacnnnnnnnnnnnnnnnnnnnnnnnnnnnncgaaaattgtacatacatatatacagagacacatacatatacgcagagcgaaatattcgtcaacannnnnnnnnnnnnnnnnnnnnnnncagaaatcctgttaaatattagaattcataaaactattaccctgatatgggtaatctggaatagaaattacgcacagttttttatattgagttattgtgttattttttctatggcggggggggaaatttataaataatctctgaaaaaaattttgggacccctttccttggcacagttaatctggnnnnnnnnnnnnnnnnnnnnnctccccattgtgtgaaaatggggaaggnnnnnnnnnnnnnnnnnnntgggggggaaactaaactttttttgatgttaccctcatannnnnnnnnnnnnnnnnnnnnatggtctggtttggnnnnnnnnnnnnnnnnnnnnnnnnnnnnnnnnnnnnnnnnnnnnnnnnnnnnnaaaaaccaacaacaatccccccgtcttttttgggtgaaaaacccccccccaaccaccaccnnnnnnnnnnnnnnnnnnnnnnnnnnnnnngtttgcacaaaaatagccgcgnnnnnnnnnnnnnnnnnnnnnnnnnnnnnnnnnnnnnnnnnnnnnnnnnngcaaagaggggggggg

SEQ ID NO: 7087 - DNA, 634 bp, Diabrotica virgifera
  misc_feature (4)..(23): n is a, c, g, or t
caannnnnnnnnnnnnnnnnnnngggcactatcgaacttatacaacatgtcaagatttacaatttatttcagtcgactcaagtgtatagaccagtaacttcgtacaaaagtgcgctctcactggaacatttatatccaaacagtaccttgaaaataacaacccctcaacctccaagcagtacaaatgaatttactggatatattcctatggaagaattagatattacttatagtagaagcagtggtcccgggggacaaaatgtaaacaaagtaaatactaaagtggacatacgatttcatttgcagtccgctaaatggttgaatgagaaaactaaacaaaaaattgctgaaaagtttagtacccaattaaccaaagaaggatacctaatcttcagatcagatattacaagatctcaacagttaaatttagctgattgtttggaaaaaattaggaaggctgttagaggggcattgatggttccagcagagcctagtgtagagagtcaagagagggctagacgaagattagaacgagcagccaaagaaaggctaatggttaagagagaaaagtcccaagtgaaacattatagaaatgattctaatattgtagtttagtgaataaagtattttacag

SEQ ID NO: 7088 - DNA, 843 bp, Diabrotica virgifera
  misc_feature (59)..(79): n is a, c, g, or t
  misc_feature (302)..(332): n is a, c, g, or t
  misc_feature (437)..(458): n is a, c, g, or t
  misc_feature (534)..(554): n is a, c, g, or t
  misc_feature (568)..(586): n is a, c, g, or t
  misc_feature (721)..(739): n is a, c, g, or t
  misc_feature (748)..(782): n is a, c, g, or t
gcttcgtggaaaggtatcgcgtcttgaaacagtcaaaaattaacgaaacattgaatctnnnnnnnnnnnnnnnnnnnnntatacttttttactaggtttcagtagtaggtaccaaaaaacaacttgagcaatatccttttcttctttcatataataatttcttgttagtcattttaaagttaaataagcatacatagattatctggaagttagaaaactcttctttttttaatgtctactcatcaaattggagaaaagccttccaagcttatccatgaataagaaaagtcgaattttcagcnnnnnnnnnnnnnnnnnnnnnnnnnnnnnnngcttatttatagttacctacatacggactgaaagtctggcaagttcaaaatacagcagagaaaatgcttaagacaaccgaaatggatttttgacgatgatctgcnnnnnnnnnnnnnnnnnnnnnnagtgactaactgaccacataacagagatcaagaaattttaaggggttacattgggtcttgcgggtacaaaaagtgnnnnnnnnnnnnnnnnnnnnnctcgaaaactggannnnnnnnnnnnnnnnnnntggaatatgtgggggtgtagtacttgaggtactctcaaaaaggttttcaggcaactctatagaaatgagtgtttttgggtgaggggtttttttgaaatgccttaagtgctatacctttggcatgttccagctaannnnnnnnnnnnnnnnnnngttttcagnnnnnnnnnnnnnnnnnnnnnnnnnnnnnnnnnnnggcgccttttttttacctgcacaaacctatttaactcccctataaaaataccttcggcaaa

SEQ ID NO: 7089 - DNA, 384 bp, Diabrotica virgifera
  misc_feature (2)..(63): n is a, c, g, or t
  misc_feature (67)..(186): n is a, c, g, or t
  misc_feature (205)..(233): n is a, c, g, or t
  misc_feature (243)..(303): n is a, c, g, or t
  misc_feature (314)..(360): n is a, c, g, or t
cnnnnnnnnnnnnnnnnnnnnnnnnnnnnnnnnnnnnnnnnnnnnnnnnnnnnnnnnnnnnnnacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcgggcggcgggggcnnnnnnnnnnnnnnnnnnnnnnnnnnnnnttttctcttnnnnnnnnnnnnnnnnnnnnnnnnnnnnnnnnnnnnnnnnnnnnnnnnnnnnnnnnnnnnncgttgggcgtnnnnnnnnnnnnnnnnnnnnnnnnnnnnnnnnnnnnnnnnnnnnnnnttcctctatctctttattcttttt

SEQ ID NO: 7090 - DNA, 343 bp, Diabrotica virgifera
ttcggccgcgcgaattttttgggtaatagtcgatccggatgtcgataggattgttataaacaaagagcttggggaattatatagcggcgatttttcgcaacacaaagccttttttttgtatttttctgggtccatctaagcctaaagagatcggagaagtggtatcctctatcacacaacttatgacataagaggcgcacatgcccggaacgaacgaaggcaccgattggtctcccagatgtgggcagtgaatcactcgaaacactacgctttgatgacgaggtagctctagctgcagggagagacgacagggtccatgtagaagagatacactataatgttg

SEQ ID NO: 7091 - DNA, 765 bp, Diabrotica virgifera
  misc_feature (332)..(350): n is a, c, g, or t
  misc_feature (591)..(609): n is a, c, g, or t
taacttaataatataaaacttatctttcaaaaacaatgaaacagccacaacaaaatacagagtattcaaccaatattatacaacctaagagaagataatgatagtgacagcagaaaacgacaacatagtcaatagggatctcttccttagctcgtcttctagtacgccttggtcttactagctagactaggtatttatatcaatgtaatagaataggtgccttgaaaatatgtaatatcgtggacttaacgctaataattaaggagcaaatatttcaaagattaagacatcaatgtaacgatattttatatcggaagtagagtaaaaagtcnnnnnnnnnnnnnnnnnnntcatggtcatgccatcctagtagtattcatgggactctaggcatgaccacttaccaaaatcatcatcaatggcgttacattgtgtgttcactctcaatcttcaatctcacttctcaatcatcatcaactcttcgtgtgtctttgcgtcgtttactatttccttccacgtttgtctgtcctatgtcattacttccccttgtctcactcccattttctccagatcctgcaaaactttttgcannnnnnnnnnnnnnnnnnngtaattttcttatcacaaaatataataatcttgtcttcagttggttgaggtatatttttaaaataagtttttgagaatggataacgacagaacacctagtagaacgcttagcggaactatggtcggacgtcggccagtaggaacaccaaggaagag

SEQ ID NO: 7092 - DNA, 66 bp, Diabrotica virgifera
  misc_feature (9)..(34): n is a, c, g, or t
atattgccnnnnnnnnnnnnnnnnnnnnnnnnnncactttatagtgatagactattattaaatttt

SEQ ID NO: 7093 - DNA, 739 bp, Diabrotica virgifera
gatttttgtagattcgattcatgtttaaaatccgttgagaaatatatttaaactcccaaaaatgtttaatcaaagcgggttaggtacatttggggcagctaccaccccaagcccagcaaaccccatgaaagattttgaagtagtttccccaccggaagattccattagttccatggcattttccccagcaacgttaccccagaattttttgatagctggtagttgggacaacaatgttagatgttgggaaattgaacataatgggacaagtgttccaaaatctatgcaaacttgtggagctcctgtgctagatgtttgctggagtgatgatggatcgaaggtttttatggctgggtgtgacaaacaagcaaagatgtgggatttggccagtaaccaagtcgtgcaggttgccatgcacgatgctccaatcaaaacatgccattggattaaagcttccaattattcttgcttgatgacaggttcctgggataaaacactaaaattttgggatactcgaagtcccaatccgatgatgagtatcaacttgccggaaagatgttactgtgctgatgtggattatcctatggctgtagtgggaacagcaggaagacagatcattgtctatcaattggatagtaagccacaagaatataggaagctagacagtcctttgaaatatcagcatagatgtgtagctatttttaaagataaaaagaagcaaccaacaggctatgctcta

SEQ ID NO: 7094 - DNA, 1035 bp, Diabrotica virgifera
  misc_feature (773)..(790): n is a, c, g, or t
  misc_feature (792)..(804): n is a, c, g, or t
  misc_feature (808)..(835): n is a, c, g, or t
tattaaagcaagagatgtgataaagttaatgtctagaagtgttccctttgagcaagccaaacgtgttttagaagacgatgtaggatgcgatataataaaaataggaaaaataactagaaacaaggaaaagtttgttaaaagacgccaacgcttaataggtccaaatggatgtacattgaaatctattgaaatattaaccaactgctatgttctagttcaaggccaaacagtatctgcactaggtccatacaaagggttacaacaagttagaaaaatagtggaggatacaatgaaaaatattcatcctatttataatataaaagctctgatgataaaaagagaattagcgaaagacccaaagttgaaaaatgagaattgggagagatttctacccaaatttgttaataaaaatattagtaaacgcaagcagcctaagaataaaaaggacaagaaaccttatacaccatttccaccagcacaacaagaaagtaaaattgataaagaacttgccactggtgaatacttccttaacaaaacacagaagaaagctaaaaaacagaaagagaaagatgataaacactctgaagcagcaaagaagagagaagaaaagagaaaaccaagcatttatacccccctgaggaacctactacatctaagacacaatctaaaacaaatacttaaggctgaattaagctttcactaaaggagaaaaataattaaggcccaggaaaggtcctaaaatatttaactcaaaaaaaggattcctgtttggnnnnnnnnnnnnnnnnnncnnnnnnnnnnnnncttnnnnnnnnnnnnnnnnnnnnnnnnnnnnggggggggccgttctaaaagggaaaccaatgctttaaagaagggggtttatggcgacccccttattttttctataatgggctcccaaaatttctttccatcggcccgccgtttttaaaagataaagtgtggggaaaaaactgtggggtaaccctatttaaatccactggaaggacatccccccttctctggccgcggggg

SEQ ID NO: 7095 - DNA, 505 bp, Diabrotica virgifera
  misc_feature (2)..(267): n is a, c, g, or t
  misc_feature (274)..(312): n is a, c, g, or t
  misc_feature (353)..(370): n is a, c, g, or t
  misc_feature (378)..(399): n is a, c, g, or t
  misc_feature (432)..(458): n is a, c, g, or t
  misc_feature (471)..(503): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnntgcgacctcgatgttggattaaagtttataattggggaaannnnnnnnnnnnnnnnnntgttcgannnnnnnnnnnnnnnnnnnnnnaggttaaaccggtgtgagccaggttggtttctnnnnnnnnnnnnnnnnnnnnnnnnnnngtaaggaaacgannnnnnnnnnnnnnnnnnnnnnnnnnnnnnnnngg

SEQ ID NO: 7096 - DNA, 259 bp, Diabrotica virgifera
  misc_feature (2)..(47): n is a, c, g, or t
  misc_feature (58)..(78): n is a, c, g, or t
  misc_feature (88)..(113): n is a, c, g, or t
  misc_feature (125)..(145): n is a, c, g, or t
  misc_feature (147)..(165): n is a, c, g, or t
  misc_feature (173)..(240): n is a, c, g, or t
cnnnnnnnnnnnnnnnnnnnnnnnnnnnnnnnnnnnnnnnnnnnnnngtttaaattcnnnnnnnnnnnnnnnnnnnnncccctatagnnnnnnnnnnnnnnnnnnnnnnnnnngttttttttgcnnnnnnnnnnnnnnnnnnnnncnnnnnnnnnnnnnnnnnnngggggggnnnnnnnnnnnnnnnnnnnnnnnnnnnnnnnnnnnnnnnnnnnnnnnnnnnnnnnnnnnnnnnnnnnnggtgctccacatttttttt

SEQ ID NO: 7097 - DNA, 60 bp, Diabrotica virgifera
gatgcaactaatggttcagactcaactgaaccatttaataaaccatagattgatccgcat

SEQ ID NO: 7098 - DNA, 290 bp, Diabrotica virgifera
tctcgtgcgggctttggtcctatgcatttcttgtgtgggattttcagctggagtttatctacatggctggggaggtgggacagcaaacagaaaccctcagagtgctacttgggaaaaaatcttccaaagcaatacccgatcatcatgtacttcccgtgattaaacatgacaataagctatactacatgggagtaatgtttaaggacagacggaaaaatgttttccaattctgtcaatgacttcttatgagagttccgacaatagattggaatgaccaaaatgaacgaatc

SEQ ID NO: 7099 - DNA, 830 bp, Diabrotica virgifera
gatacattaactaagaacaattattttcttaggtaatgttttctggtaaaaaacctcttagattgacacaatgtacgtatacagaagaaaaatatacgtaacaataaagatgatacgatcacagcataaaattttttcattttacacctccggaaaataattgttccaggtcatccctaaaaacttactaataggaaagaagtaaatacacaaactgaagttatatagatcgagttatacgtttagcatttttttattgtttcatttcgatagtatatgcttcatttcttgcgtttttctgtttagtcaaaaaagttaagttagtaaaagatgttttaaatttctctgtgttaacagttcatatttattttatcggcatatttatatatgtgccgctcctgtaaactaacattgtcagaaagttcagaaatagatatcagggtaaaatattgtgtagccactcttatattttaatcgttatttgtatgaatctctgtatcaataaccgctctatcaatggcaaataaatctattaaacacttccattttaataataatagacgtgaagagttttgatcgccgataaaacgatattataggtaattaaagagttgactttccttgttttccttcttcagagagtggtgtctgtggtttcatttaacatccactattggcagtcagttattctcatctttgaccttgagtggtcattttaacttacgttatttctttttaatatcaatatgcagtaactaaaaaatagaaacatatattttttaaaccttttatcttttcctattaatgtgtaactcattggtcttacacat

SEQ ID NO: 7100 - DNA, 710 bp, Diabrotica virgifera
taaagaccggtctctcgaaaaatatacatttccactcgcacccttaaaaaaggatcttaattttgtgtgtgtgtttatgtgaacatttttggacaatgaagggcacactgcttttcttgttcctgttaatatcatcaactattgcccaacatcgaatagttagagctaagttaggtaatctgggagcacctcaaaccatagatttaccagacttaggcttcgcacaaggttttttaccctcatctttggcaaatgctaaacatgtgaatattaaaataagtaaagcaaaatcttcaggatttggcgcaggtagtggaaacgctgaacatggagaaaatattggatttactgcaagaggtgcattctccgataattctggtgccaatattaatggaattagaggagggtttggtttttcctctaatggaggtagtacagcaagtgcaggcaatacaggatttggagtcaaagcacacttatccgctaacaatgcaggtgttagaggaggatttgatttttcctccaatagaggtaatgccgtaaatgcaggaaatacagcatttggagcaacaggactggacaactccgccaaggattcagctaacttccatcaaaataccggaaaaaattaataatgaaattaaaaggaggcttggttttctcctcacaaggcaagtttatttggaaatactggattcggatttacttcc

SEQ ID NO: 7101 - DNA, 708 bp, Diabrotica virgifera
acccctctgctgtcccgagtgaacaacgtgccccgactattaggaaaatgaagtctcccgataacctaattcgcgttctaatttttggactttgtggccccatagggtccaatttacctcctgtggtgtttataccaggagctggtggagcgcaattggaagccaaaataaacaaaactcgtaagatccattacatatgtgaatcggtatcaaacgatttctttaacatatggctaaacctagaacttctggtgccgttagtcgtagactgctggatagacaatgcgaagttaatatatgacaacaaaactagaaccactccaacaaacgacggagtagatataacagttcctggctggggtggaagtgaggctgtcgaatggctggatcccagtcatgcctctacaggaaaatatttcgcagagataggaaacaccttggttggaatggggtatgtcaggaacgttagtatttaaaggagccccttatgacttcaggacggcaccaaatgagaaccaagacttttttgtgaatctcaaaaccttattagaacatatctacaaagaaaatcaacactcactccagtgctactgtttggctcattccatggggtgggcccatgaaaactgacattttttaaactaaacagactccaatattggaacagataaatatatttaaatgtttgatatctcttgcctgctgttt

SEQ ID NO: 7102 - DNA, 495 bp, Diabrotica virgifera
  misc_feature (25)..(25): n is a, c, g, or t
  misc_feature (29)..(29): n is a, c, g, or t
  misc_feature (113)..(113): n is a, c, g, or t
  misc_feature (132)..(132): n is a, c, g, or t
  misc_feature (145)..(145): n is a, c, g, or t
  misc_feature (407)..(407): n is a, c, g, or t
attcaggccgcgacgaggaaggganaggncagcgggcggcacttttaagcagcgcggcacaaccaacacgacgagggagaaccgcgcggggcaaagaagacggaacaggcacncccaccgacgcgagagganaccaacagggaanccacaagagggggaccgaacccagagaagccgaagcaagacacaggagaccaaacacaagaacccagacgggccaagaaggggaaccacgcagaaccagagaaaccagcgaccgcacacgcgggggagggacagcacaccaaaaccacaaccaaggagacaaccggacggagacggcccggcaggacgaagggacgccggacgacaccaaagacgacagccgcccaaacagaagccaaaagggaggagaagcgggacacaanaaggaaaccaaccacgagagcagcagagacagggaacgcagacaccgcggacaaggaaggagagacaggggccccacccaaggagcaa

SEQ ID NO: 7103 - DNA, 708 bp, Diabrotica virgifera
  misc_feature (155)..(177): n is a, c, g, or t
  misc_feature (179)..(192): n is a, c, g, or t
gggttaaaggtgtccgatttcgcagtttttcaattttcaatcgcttatatgtcaagaactatcatttttggagaagtcactaaggaccttttctgtttggaatgatccaagggatctgaaagaactttgttccatgcaggaaagattattttagnnnnnnnnnnnnnnnnnnnnnnngnnnnnnnnnnnnnngaccaccttttggccctggcaacatgcaggtttgttaaaaggagtcctttttgagtaagattgtgcaaagggtccgaattggaatgtttttcctggcgggtgcgcagtggctttctggactaatattatactgcaaaacgtggttataaaatttagcgctggtgttttctggatgcttctataagtactgacgttgctataatccggatgatattgtgtgtatgagctggaataagaacgataatataatattatcacctgtcaggaaatattagcattagtaaaaccgacaaatgacatacctaaagtgaaacattaactaaattcaccaacacctctatctaggactacaggagtgtcagctgataaatttaccatttctgatcatgctgcatgaactgatccattatcgaaacggtgcattgggcgagatcttcgaaccctttacaagatccagacttgaacgtaaaagagagttgtatccgggcagcaatccattacagcgacacattaata

SEQ ID NO: 7104 - DNA, 967 bp, Diabrotica virgifera
  misc_feature (915)..(934): n is a, c, g, or t
tggtggtccaggaggtcgtggaatgggtagaggtggtccaggtggtttcagaggacgtggaggcccaggaggtggcaggggaggaccaggtggtccaggcggaccaggtgtaccaggacaaaaaagagcaccaggacagtttggtggtcaaggaggaccaccaggtggaattaagagacctaggtttgaaaatggacagggagctaacggattccaaggtggtcagcaatcatactcaaatcagtatggtggtggtggtggtcagtatggaggatacaatcagtatggaggaggacaaggtggttatgaaagtggtggttactcgacacaatattccaatccatcttccaactatggtagtgggggtggtgattattctggatactcacaacaaggagctgatcaatatggtggtggtggttacaacacaggtgcacagggtggttacaatagtcaaggttatgatgatatgagtggaggatatgcacagcaaggtggttatggttcagccccgccaaggcgatactaaaattcttccaaagtaccattagtattatttataaaaaagctcccaaaatgtgtttagtgtatatggacaaatctttttatattaggagtaattttattttaattacatacatattttttttgtgttgtttgaaagaatgactaatggtagcggctttaatctgaaaaagaacttgaataataagtgtcttggaatacaattttaaactaggataataattatttggtttaaacttatttggggttctttatctattggaaccaaatatgggagattgcccccgttcaacaaaaacattttccaactgctgtcaataaaaaactgttttttaatctccaaaaataataaaattggcggctgctcccaggactaccaacaacctcccnnnnnnnnnnnnnnnnnnnngttttttttcactaggcagcctctttcttcttt

SEQ ID NO: 7105 - DNA, 159 bp, Diabrotica virgifera
  misc_feature (75)..(99): n is a, c, g, or t
  misc_feature (141)..(158): n is a, c, g, or t
acatagaaaagatttaaagttgggtatattaacttgctttatctaattgaagttggtgaggtagcatattggatnnnnnnnnnnnnnnnnnnnnnnnnnggaggatgaaattttctttttccattagatggaatagaaaannnnnnnnnnnnnnnnnnt

SEQ ID NO: 7106 - DNA, 514 bp, Diabrotica virgifera
  misc_feature (10)..(298): n is a, c, g, or t
  misc_feature (300)..(330): n is a, c, g, or t
  misc_feature (334)..(367): n is a, c, g, or t
  misc_feature (415)..(433): n is a, c, g, or t
  misc_feature (444)..(466): n is a, c, g, or t
  misc_feature (470)..(512): n is a, c, g, or t
ggaagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnngttnnnnnnnnnnnnnnnnnnnnnnnnnnnnnnnnnngtggtttgaggtgtttgttttgttttttgtgtggttattgtgtttggnnnnnnnnnnnnnnnnnnngtttttgtggnnnnnnnnnnnnnnnnnnnnnnngttnnnnnnnnnnnnnnnnnnnnnnnnnnnnnnnnnnnnnnnnnnntg

SEQ ID NO: 7107 - DNA, 884 bp, Diabrotica virgifera
  misc_feature (598)..(619): n is a, c, g, or t
attgtataaagcgacaaatagttgtaatgtatatgttttacaatagtatgttcattatctacatagtatcagttctaaaagccaaaaggcaagaaaaagttttataaaatacgttttactctacatttggtactatttaaacttatttttaaaaattcactgatttttataacctcaaaaatctgaagtcttttaaaatacttacgtaatataacaactgcaataaaaaatggatcttattggtttcgtatattttatagaaaacatttttaaatcgaactatagaaaaatatgtgtatattcacatcagtaaaaaaaacacagtttaaaaaattgttcaatggtaccaaacgaatctacaataaatttcataattctaagatacttaaacctaagtagtaaacaataatggtaaataaatgatatggggaatgaagctatttcagtaaagaaataatctacaggatgacaaactacaaaaagagatcagaaataaaatagaagatatgtatatgattttacaatgtaataagtacatttcaataccgtgcataaatatatttatcacattttttatgcaaaagaatcaatgctacannnnnnnnnnnnnnnnnnnnnnttaaccccatttaaacttttgatgcactaaaatccctttgatttataccctttgacaaaaatggttctttatatgtatatggcataataaaagggcgacatacagtctcttccccggatacctaatttttcctagttttcaccaaaacctttaaacaaccccccaaaataaatccatttttccggctttgaaagggtttttatggatttaaggttttccccccccttttacagtttggaaaaacatattggttattgaaaaattt

SEQ ID NO: 7108 - DNA, 599 bp, Diabrotica virgifera
atagtattgatggccggtgagttttttagaatatttccactccaatataatagtgtgtcgttagaactaatatatttgtgaaaaattcccagtgaaagggaatatgaaaaacagtgatgtgagtataacaccagtgatgcatcaaactaaacaatgtggacgagtgtgtctgctgtttacgggaattttcctaatctgtttcggtaggtggattttcattttcttcgaatctatctacgatctcctcttaaactacaacgctcagatttgagccaggctctttggcataccaaggagtgggagaggagtccccccgtctgagatcaacatttatttgttcaactggaccaatcctgaggatattaagaatcattcggagaaggcgaagtttgaggagcttggaccttatatgttctacgaggttatggggaagagtaatatttctttcgttgatgaacttggtaattataaaatatattacgaggccgttttccgacgagaagaaaggagggctgaagtttaagtgatgtgttacattccattaatactgttgctcgtgagtacaggataccgaggctggtttccaaagttttctgcac

SEQ ID NO: 7109 - DNA, 439 bp, Diabrotica virgifera
  misc_feature (2)..(20): n is a, c, g, or t
  misc_feature (36)..(56): n is a, c, g, or t
  misc_feature (145)..(165): n is a, c, g, or t
  misc_feature (190)..(236): n is a, c, g, or t
  misc_feature (243)..(303): n is a, c, g, or t
  misc_feature (306)..(384): n is a, c, g, or t
gnnnnnnnnnnnnnnnnnnncttagggataacaggnnnnnnnnnnnnnnnnnnnnncaaatcaataataaaaaatttgcaccccccatgttggatttaaatttataatttggggaaacactatattttttaaattctgttcaacnnnnnnnnnnnnnnnnnnnnngaaggttaaaacggggggagacccnnnnnnnnnnnnnnnnnnnnnnnnnnnnnnnnnnnnnnnnnnnnnnnggggccnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnncgggcgcgccgcccccccccttccagccgtaaccccccagctttttttttttcta

SEQ ID NO: 7110 - DNA, 246 bp, Diabrotica virgifera
cggggggacccttttgggcgcccagccgtccgcggccgacctgttttatttcttttttttgttcttcattatgaagtattattatatcaccattatcatcttatttcgcaagatctctgatttccgttttgtctctgaataatgtctagtaatattaaatccgagaaatttcatatctgccatttcactagattgaatatctttaatatctatacgatttctttcacttcccccttgcatagtaat

SEQ ID NO: 7111 - DNA, 267 bp, Diabrotica virgifera
ttttgttcgatttttaggtgaaatatattgggtggatagtgttcaactatatttgtccatatgaagaaaactaactaaaatactgcaaaggttcaaaaaatcaattattttcaaaagctataagcgcatccgacaaatatgtgagaaaataaaaaggggatcctgaatatgaggttccaataaagatctcaaaaatatggtagacagaagagtaatctgtagtaaccaaaacagtacggtatccacacaatgtagagtctccggaag

SEQ ID NO: 7112 - DNA, 441 bp, Diabrotica virgifera
acttaaattgattgtttttttacccagactatatgtaattggcagaagattatttcccttgtcttaccggacaactacatgcagggcggactctttttgaagattgcctcctgagaggatacggatatcatctaggtgatctgaaagaaagattaacctttggtgatctggaggaacaccttctttgtcttgagatttcaccttagccgttttcaaaagcatctgaaggatctagttaaagggaggaggcatttcaagttatagcattaaaaacgattagcctaccaccgcaaggacgtaggaccatttggacagcagattatttttgaatgttgacccacgagacagatccgctatctaccctctgcttccgcgtatatttatcccttgggtgatctggcggtatatctagaatgcattgtattttcaataagtcgtttc

SEQ ID NO: 7113 - DNA, 794 bp, Diabrotica virgifera
  misc_feature (389)..(411): n is a, c, g, or t
agatctagctacgtcagagtagagttgcgaaccgattggtctagtccgcgagacagttttggttttttcctgtaagacaagttgagttaccagatggagtgaactccaatctgtttagtctgttttcttggtgagaaaacaaatgttggttacagtgaataccacgatagtatgttttatgtctagttccgtgtattagaaggaacagtctcttatgttgttcttaagaagaaattaatacaagttcgcggagctaggtccccagctttataataagaaataaaaaactcattttttttaaacaaaattttgctatattcaagtgaacagtgtttacatggttccaatgttggaatgttccaataaaaatcaataattagcagttaccnnnnnnnnnnnnnnnnnnnnnnnctttggaattttattctcatatcataaaattttgtgaaacagtctctaattcaaacaaatgtaaagtgttgggtaacaatagttacagctgagatataccagatccaccttagctctaatcatcaatgcagtccttcttctcattgtttgatttgcgtgtatagaataaattgctatgtagaaatgctatcattgagtgtccccgtttaggattttgtcctcttcagggtttgcagtgaaatgtaaaaaagtggccgcaaaagcaaacagtcccgaaaaacactctggggcatgtgtcgtgtcctggtgtttctggtgttcctgggttatgccggacggtggtgtccagaaagctaaaaagacaacagagaaaaaagtttgat

SEQ ID NO: 7114 - DNA, 493 bp, Diabrotica virgifera
  misc_feature (125)..(144): n is a, c, g, or t
  misc_feature (255)..(271): n is a, c, g, or t
  misc_feature (273)..(285): n is a, c, g, or t
  misc_feature (310)..(310): n is a, c, g, or t
  misc_feature (312)..(332): n is a, c, g, or t
gatagctcaccggttcgtttttgattttattgctccgaaaaattgataataatattttttaaggatatttagtttggccgtagagagaagaatttaataatataacatgtttttagagtcgttgnnnnnnnnnnnnnnnnnnnngaagagaaaaagtaatgttatgaatttttgttgaagatgagaaggattttgataaagtgtgggatgaatggttgatgttaaaaatagaaatgaaggttagtgatttaatgnnnnnnnnnnnnnnnnngnnnnnnnnnnnnnggtaatatcggccgtcagatgaagngnnnnnnnnnnnnnnnnnnnnnatacgatctggagtcataaaagaaaagttatgggtgcaaaataataacaatattttaataagatataaaaacaaaggaatatgtaatgaatagaacattcttagatgatacagtatgttagttacagatgaaaattttgccacagctaccgaatttcttca

SEQ ID NO: 7115 - DNA, 752 bp, Diabrotica virgifera
gttgatgatataattcacattgttgttgtaaatgttcttaattacccttatcattttgttacttattctctaatatttcccataatttttgccttggtaccgtgtcaaaagccttttcaagatctatgtaagccatatacatttttttctcctgttgctgatatttttctattatttgcttgattgtaaatatatgatcctgggtgcttctgccttttctgaaccgctttgtgattcctcgagtgtactgtcaatttttccaattattctgttgttcagtaatttttcgtatattttcattccagtgcttttaacagtgttattcctctgtaattgttgcaatctcttctatcgccctttttataaatcggcactatctgtgtcttctgccagtccatcggtatctgttcttctctccaatctgcattgaatatttttaataatagctctgttgcattttgtcccattttttttatcatttcactggttattctatcatagcctggtgcttttctatttttaatttctgcaatagcttcttgccacttcatttatggttatagggtctacattgtctacttctattctttggttcgctacattgttttcttcatgataccagcgagcttgtagcatctcttggaaaaattctctccatctgctcattatttcattttcttctgaaagatttccgccgtttttattcttttatgttttctattttcttgaattcctttctttttccattgatt

SEQ ID NO: 7116 - DNA, 728 bp, Diabrotica virgifera
gacccacttgcgtccgattacacatgcaggacctcacaggaggttgtggatgggaccacagtttacttttaaaacatataaaaccattgccggatctcccctgtcagtaggagaatctcaacctatctatttgggtcactccaaacccatcaatatgccgataacgaaagcaaacgctgttctgatagaatcaagttctgcatcgagttgcgaacaacatctgctggagaattaccatagaactttggaagaaggaggaggagtaggggagttgcaattgaaagaggatctggccgacgcaatgttggaatcgcccggattaagagatactggtgatgcgactgattacccagttcgtgaagtacaagacgaccccagttccgtaagcaggttcagttctgctagtcgtgcttccccaacacctttcggggaaaatcttcttcactttcctggagattgcagtggttccatgtaacatacggtgcatacgtctgtgttaactcgtaaagctcaaaagggaaaatccactttcacctaaaacccggggtacatttagtcgggatccattacctttcattgtggataacaggatctcttcaagcctgctgcgtctttaaaaaaaatcgatttctagcatctattttataaaccaattgcccccccgggatagacatttgaaccttcatggcgagctggttccaaatgggttatcctaatttatagggcag

SEQ ID NO: 7117 - DNA, 278 bp, Diabrotica virgifera
  misc_feature (43)..(43): n is a, c, g, or t
  misc_feature (80)..(80): n is a, c, g, or t
gggcatacactgtggtggacccctttcgaacgatttggataantcgacatgcggggaaaaaataccattttgaaggtggntaggagaaagaccaggtatgaactctggcgacccgaaatcttcagaaggtgaggaaaaaggttctttatgctgatgacgatgcgagaccttacagaaccagtcgatgaacccaaaattgaagaggaggaggaataggacggaaaatatgttgaagaagaataggaagacgaggaagacgaggaagatcattgatgcta

SEQ ID NO: 7118 - DNA, 886 bp, Diabrotica virgifera
  misc_feature (252)..(279): n is a, c, g, or t
cttctattgcccttttcatgatcatttttcagtgcgtaacaaatgataggaaaaagggtaagtccgtgataatacacattgatgacatttatattaacatgacattttagttaaatctgacagttgtcacattttgttttcaatttggaataaaaacaaatcaaatgtgtttcttgcatttataaaatggtattttctttgatttgtatagtcttataaattatacagattatatttgtaatattattatcnnnnnnnnnnnnnnnnnnnnnnnnnnnnggcgccatctatcgacaactagaatagctagaataaatgttataaaaatgtcaccgacgaaatgtaatcaccgacgtgccttttttctgtcacatacaatttaatgcgttagaaagaaatcgaaaaactgtgacgcactgaaagatgatcatgagaaatactgtatgttctcaccctcacatccttaaaacgtttcataccgataacgatattcgataacactcgtaaaatactggtcccgtccgttactcgctaggatacgattggtagaaagtaatcaagtgtactggtttgtagatacaatatatgtttactccgctctgataccaatttggtacggagtaaacgaaagtaatcccagtaattcaaaagtaacgattttgccttctcctgtaatagtaatcgttactttccggtattcttaagtaactagaacttttggaccgaataatttactttttttcaacttcacctaatgcccaaaatcactcggaaactccaaaaatgaacgggccctaaaccccaagggaatccgggggggagggttttatttttctggcaacccccaaaaactggccccaagaaatcctttttggcatccaattta

SEQ ID NO: 7119 - DNA, 363 bp, Diabrotica virgifera
  misc_feature (5)..(164): n is a, c, g, or t
  misc_feature (171)..(208): n is a, c, g, or t
  misc_feature (228)..(241): n is a, c, g, or t
  misc_feature (244)..(266): n is a, c, g, or t
  misc_feature (274)..(296): n is a, c, g, or t
  misc_feature (326)..(357): n is a, c, g, or t
cgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7120 - DNA, 131 bp, Diabrotica virgifera
cccccccatctcttggacttacacgggattctccgaatctccccctattggcttacaaaatgcacctgccttcaaccacacactacacccgaatttccacacaataccaaccccttaccatcttcacgtgg

SEQ ID NO: 7121 - DNA, 675 bp, Diabrotica virgifera
gtgtgaaaggcgattaatcatgaatgtccttattctagttgccgcatgtggatgtagctgtgtagtgctacatcactccaccaccaatgacttccattaacggaagaccattcctccaaagacggacatcttaaaaaaaaacccgtactcttccgaattgtctctcaaactctccacagaactgaaaaacacaatgcaagataccagaatgctgaagggtccttctacttgacgggctatacatggtcgcagatatgacttcataggaattcaggctatgcttgactcccatactcattcaccagcctaaacgatacctaacatcccgagtttgtagcatgactcctcaatgtgactcgcatcataaatcatatcgactgtaatagaatgagggtgcatttgctcccatataagtaccaaagacggtgtccatcatgataatcactaagtgccactgctgctcatgattgacaaacagttttagagctgaacgaactataagaactgactacccatcatgtaatatagcgttccggtgattaccacgatgctagcagggatgtggcatgaactgattgaacatatcactacattttggatcctggacctctgtatagagcctgactacgagtatcgagagatagacatggactgcaaacagtgtaaatccaagaa

SEQ ID NO: 7122 - DNA, 61 bp, Diabrotica virgifera
gtgagtatgtatgtgggttgagataacgagctacttccctttttagttggactgggtaatc

SEQ ID NO: 7123 - DNA, 734 bp, Diabrotica virgifera
  misc_feature (10)..(44): n is a, c, g, or t
  misc_feature (46)..(121): n is a, c, g, or t
  misc_feature (123)..(138): n is a, c, g, or t
  misc_feature (140)..(261): n is a, c, g, or t
  misc_feature (263)..(286): n is a, c, g, or t
  misc_feature (288)..(320): n is a, c, g, or t
  misc_feature (322)..(370): n is a, c, g, or t
  misc_feature (374)..(416): n is a, c, g, or t
  misc_feature (437)..(458): n is a, c, g, or t
  misc_feature (465)..(482): n is a, c, g, or t
  misc_feature (484)..(504): n is a, c, g, or t
  misc_feature (602)..(623): n is a, c, g, or t
  misc_feature (660)..(678): n is a, c, g, or t
ttttcgtccnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnncnnnnnnnnnnnnnnnnnnnnnnnnnnnnnnnnncnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnntaggattcacaaattttctcnnnnnnnnnnnnnnnnnnnnnncttttcnnnnnnnnnnnnnnnnnncnnnnnnnnnnnnnnnnnnnnnctatacatttcacttatttacatttactaatgatgataatattactcttacaaaattgtctattcagtatacctcttctaggtttcatcaacggactnnnnnnnnnnnnnnnnnnnnnntgctttattcacaacctgccctctctggattcattgnnnnnnnnnnnnnnnnnnngggattattttccccggcccccccattttcgcccggcaacaaaccaatattcattc

SEQ ID NO: 7124 - DNA, 815 bp, Diabrotica virgifera
  misc_feature (274)..(305): n is a, c, g, or t
  misc_feature (727)..(727): n is a, c, g, or t
atctgttgtggtttgcacaagaacacacagaatttcgtttttcggaaatcaactcgctgatttcactttttaacatagaaatgaaatttgttcaacaaccaaaagatatagaaccatattggattgttgaatttagctcagaaagggatgtaaaactattggccagtaggtctgtatctttaaggaattgcttggaattgtgggcacatgctaattcagttccagaactacatgataagatgaaaaaatacccccagaatttgctccaatcacnnnnnnnnnnnnnnnnnnnnnnnnnnnnnnnngtagagactttttgtagacattttacacaaaaggaaaaggttgagaaattagaggcttttagctacttacctgttttaggaccagtgaatttgaagaatcctgatacaacgttgcaatatattgaatattatggcaccagagctaacgatcccccagaattaccatatgatgtattttttggtaaatggatagccaatggattacgccaattaatcaaaaagttatcactaaaaacgagaaaattcatcgggaatacaagtatggatcctcaactgtccctgttgatggcgaatcaagcaaaaataaaagaaggggatatagtattagatccgtttgtgggatcaggctctcttttggtagcagctgctcaatttggtggttacgttctgggcacagacatcgattacttaatgcttcatgncaggacgaggccttccagaatatctcagaagtctagagcaaaagacgaaagcataagggccaacatggagcagtataacttacagcat

SEQ ID NO: 7125 - DNA, 523 bp, Diabrotica virgifera
  misc_feature (12)..(31): n is a, c, g, or t
  misc_feature (33)..(49): n is a, c, g, or t
  misc_feature (55)..(68): n is a, c, g, or t
  misc_feature (70)..(155): n is a, c, g, or t
  misc_feature (157)..(183): n is a, c, g, or t
  misc_feature (201)..(265): n is a, c, g, or t
  misc_feature (350)..(375): n is a, c, g, or t
  misc_feature (377)..(394): n is a, c, g, or t
  misc_feature (415)..(435): n is a, c, g, or t
  misc_feature (455)..(518): n is a, c, g, or t
accacgtgtccnnnnnnnnnnnnnnnnnnnngnnnnnnnnnnnnnnnnnggaagnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnncaatttaaaagagctagnnnnnnnnnnnnnnnnnnnnnnnnnnnnnnnnnnnnnnnnnnnnnnnnnnnnnnnnnnnnnnnnnattttaaagtatatctaattcttgtagaaagaaattaaatgtatttattatgaatatattgataattaaatatctttatattacnnnnnnnnnnnnnnnnnnnnnnnnnngnnnnnnnnnnnnnnnnnncaaaatttaattctcaatacnnnnnnnnnnnnnnnnnnnnnatgttttacaatatgatagnnnnnnnnnnnnnnnnnnnnnnnnnnnnnnnnnnnnnnnnnnnnnnnnnnnnnnnnnnnnnnnntttag

SEQ ID NO: 7126 - DNA, 802 bp, Diabrotica virgifera
tacaaatgatggaaacacgtttggtggaggagcgctaatgtgaggaggtggtccaggtggaggacctgttagatgaggtggatgtgtggttggaggtgcggagaatgttggaactggagtaggatatacagccgtaggtggggggccacaagtaaaagtttggtaaggaaattggggcacttctgaatgaggtggtattttgaccatcggagggggctgttcaggcgaagaaggtttttcgtgaccatttgaagctcttggtattggtgatggtgtttgtggacctttttgtgccattggtggactgtctggaggatttgtatctgattgcgaatataaatccaaaacctgatgacatatgtcctctaatagatccatggtaacatcttctacaaacatgtcccaccatctgcaatgtttagaatgcctgcctatccagtctataacttcaaatttactaagttttcccagccaagtacattaatgctacagcaattatttcagggtttccccactggaggcataattgtggcacttaaactgtcatttacaaaggtccaagccatttgaaccatcttttgccaatttaccttttgtccctttttagacatttttgctatttttacaggcactgataaggatggtcaacttgaaaattaaatttgattgtttgaagtaaaaattcttttctaaagtatcccctcttcctttgggccccctccaaatggtcccaaatctatgatctttaagtaatacctttggaagtttttatttatgtttttacatttctttggcggtttcc

SEQ ID NO: 7127 - DNA, 248 bp, Diabrotica virgifera
  misc_feature (31)..(31): n is a, c, g, or t
  misc_feature (39)..(39): n is a, c, g, or t
  misc_feature (129)..(168): n is a, c, g, or t
  misc_feature (196)..(196): n is a, c, g, or t
cggaattttccgtgggccgaccctttgcgtnggctttantttaaaaatatggcatcactatttatttcgtgtgagcaaatccgaaaatacaggatataatgtcaactttggatgatgacaacacagatnnnnnnnnnnnnnnnnnnnnnnnnnnnnnnnnnnnnnnnngatataagaaatcatcctgtaaactggnaaacctatttccagccacaaatagattttaaaggaagactacaaacttaata

SEQ ID NO: 7128 - DNA, 661 bp, Diabrotica virgifera
  misc_feature (213)..(246): n is a, c, g, or t
  misc_feature (268)..(289): n is a, c, g, or t
  misc_feature (641)..(659): n is a, c, g, or t
gttaaatttttttgtctgagtcgggttggaacctttgccgtccagcttggtaagtcagtatctagctagagaactatggctgccacggagttaagccgtgcttagcttccagttgatcgtactctcgttcgccacaaaaaaactggcgatcacgaccgagcctgcagtgccccttcgtactcttattgcgttgggtggggaatttttatcgcnnnnnnnnnnnnnnnnnnnnnnnnnnnnnnnnnncggttgatatattttaatgtcnnnnnnnnnnnnnnnnnnnnnntctatcacttaagtgagatatggagtcctttttttacaatattcacatataatacataataattcagtagtgagtatctaaataggtacacataagtatgtcttacttaaaattatgaaattgtctgttttcaaaatacataatatattttaatggcacaatggcagcatccgaaataacacaaatttcttgtgtccataacactatggtctatttcacatgtttcccataaaacatttatttgttgctgcgatttaaattgctatagtagggatatttaccaaacttcacgaaccttagaaatacgcatgccttaaaaaatcggcggtggatcgcgccaagactctaaaannnnnnnnnnnnnnnnnnncc

SEQ ID NO: 7129 - DNA, 153 bp, Diabrotica virgifera
ttatcataccttgtcttctggaagaagcaggatacatttttgttctcattggttttggagaatttgaataatggaaaaatatctactaccacagagctcccccacacttattgtcccctcccaataaacaacagaaggaaatttagattcctc

SEQ ID NO: 7130 - DNA, 102 bp, Diabrotica virgifera
aggcgttgtagggggacgacctggcagggcccgggtcctggtatttttcgggtcagacctctgggtgcggatataataattgcgcaactttagaccttattt

SEQ ID NO: 7131 - DNA, 645 bp, Diabrotica virgifera
  misc_feature (9)..(76): n is a, c, g, or t
  misc_feature (78)..(142): n is a, c, g, or t
  misc_feature (169)..(209): n is a, c, g, or t
  misc_feature (223)..(253): n is a, c, g, or t
  misc_feature (256)..(268): n is a, c, g, or t
  misc_feature (301)..(324): n is a, c, g, or t
  misc_feature (495)..(511): n is a, c, g, or t
  misc_feature (514)..(526): n is a, c, g, or t
ttttggcgnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnataaatgtaaattatttaaatgtaggnnnnnnnnnnnnnnnnnnnnnnnnnnnnnnnnnnnnnnnnngaaatatatagggnnnnnnnnnnnnnnnnnnnnnnnnnnnnnnntannnnnnnnnnnnncttgtcttgttgtattaaatattcagactcggnnnnnnnnnnnnnnnnnnnnnnnnacgcggaattctgaccgtgcgaaggaagtatattgattagttttggaattgaaagctggaaagaggaggtgggatgaaaaattactgtgtttatttgaattataaagaatggtattgtaaggcaaagacgctcaaatcgttcggagagacgagaagtgcttttaggagtgnnnnnnnnnnnnnnnnngtnnnnnnnnnnnnnggattattggacgaatcaagccatcctcttgggagagaaaaaaaacattgtaaaactttcgttacgtccatcagaacccgtcattcatttttttgatcccatatatttggtcatgcgag

SEQ ID NO: 7132 - DNA, 734 bp, Diabrotica virgifera
  misc_feature (3)..(531): n is a, c, g, or t
  misc_feature (538)..(575): n is a, c, g, or t
  misc_feature (595)..(608): n is a, c, g, or t
  misc_feature (611)..(633): n is a, c, g, or t
  misc_feature (641)..(664): n is a, c, g, or t
  misc_feature (695)..(724): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnnagtttaaaccggtgtgagccaggttggtttnnnnnnnnnnnnnnnnnnnnnnnnnnnnnnacgaaaggac

SEQ ID NO: 7133 - DNA, 92 bp, Diabrotica virgifera
cccaaaacatccaatacttacctacttaggggggcattttttcggctgaaatggtgggtgcgcaccccgaaattagctattttcttaacaaa

SEQ ID NO: 7134 - DNA, 54 bp, Diabrotica virgifera
ggggcacgcgaggaaacatacgggggggcccctttgtggggaagtccgagggtg

SEQ ID NO: 7135 - DNA, 1355 bp, Diabrotica virgifera
  misc_feature (697)..(720): n is a, c, g, or t
  misc_feature (806)..(806): n is a, c, g, or t
  misc_feature (1056)..(1089): n is a, c, g, or t
  misc_feature (1133)..(1155): n is a, c, g, or t
  misc_feature (1172)..(1252): n is a, c, g, or t
  misc_feature (1270)..(1296): n is a, c, g, or t
  misc_feature (1299)..(1315): n is a, c, g, or t
  misc_feature (1317)..(1338): n is a, c, g, or t
taaatttctttttcccaaagctgtactataggcggtccctgagatgtggccgggcgccattcttgttgggacacccggtacaatcaattgatattaatatttcagaccacaaatatagcaggcagataaatttaaaatcaatgtttttgattatgcttgaagccccaaaaacagtttcattattccattcatgattgttggtcatctcctttagagcagtgtataatcccttaatgtttttctcaatagaagtgatggcctgtctttttgaagactatcgtgtgtaactgtgtaccttcagagagctactcaaatacttgttaaaacattcccatcgtatcgctgaacaactggccaaacagaatatactctgtacaataccaaaaaaagtgatcatgattggggatacttctgctgcattaacaccaaccaaattcaagctgtgcgcggcacatggcacaaatctagctaagtcattgatgttgtcaatgtgagcttgtacgctgttgcatcgctgttgtaaattcctgccatgttcgatccgttatctaagccttgaccacgacaatcatttacgtccaatccatcttctttcaattttgttagaatttcatttgagattccttcaccagttttcttgtggctaacaataaaatcaacaaaactctacacgatttgagcctgaccactagagaannnnnnnnnnnnnnnnnnnnnnnncgtttgttcggaatgcgaaacgtccggagtacctacagtcaaagatagcacaaatagagtacaaatacaatagcgacttcttctanatatttcacaaatatttcaagcaagagaactatcagtccgcaagtctacgtcttttttcttcataaccctgaactggacctggacgttgtggggcagctccgctttcccttgctcccgcacgatcagtttttatctttttgccgttcgaccaattgggctttcttgggccccctgtattacccttgccgaattaaaattaactttgaaaccctggcaacccatccaggttaaccccagtttaaaaatccnnnnnnnnnnnnnnnnnnnnnnnnnnnnnnnnnnggttactgggacaccccacccgggtatttttttggatttctctnnnnnnnnnnnnnnnnnnnnnnncaaaaaaaaacgggccnnnnnnnnnnnnnnnnnnnnnnnnnnnnnnnnnnnnnnnnnnnnnnnnnnnnnnnnnnnnnnnnnnnnnnnnnnnnnnnnntttgtgtgtattttctcnnnnnnnnnnnnnnnnnnnnnnnnnnnccnnnnnnnnnnnnnnnnncnnnnnnnnnnnnnnnnnnnnnntttgggcccccccgctt

SEQ ID NO: 7136 - DNA, 892 bp, Diabrotica virgifera
cagccctctgaagttttgtaattgtcatgttggcagattctttattcgacgaagtgtacatgttacacgacaattgactacgtgacttctacttgacatgatcaacccggaactttactccattattctctcgcacaataacattcgataatatgaaaccccaatcccttaaaggtatcacctcacaacaagcaactttgacttaacacaataacaacaacaataatggaaagactgcaccatttgactatattgttattaatggattacatttactagaaaatacaattgaaattattaaataaggagtcctaaaccaaaagaattacaactccataaatgtattaaaaaactaaattgctataattaaaaatggtccacttgaagatctggatataaacagacttacgctttccgaaaattctctgaatactcttacacaagaaatgtctctttggggctaatatcatctaatgataaattagataaaaaccaatataaaaagaattgaatatactactttccatcctattaagggattgactagtataaacctcacgaataaccaaattgtatatattacaaatctgcttatacacttatatcatttgtacgatattaacttgcactacaacttaattatagcactctacccagactattttgcaagctctaaaatatctgctctatccattattaccaatcagatgtatcagatcggcaagaggatattcattgatctctcattcacaactatctcccttactgtgaacttgatctctaccatcgaacactgcataatagatgatacgaaagatgttcttatcctgaaacttgtaagcaacatgattgacgactaaacacctacttctttggtacactaaacaacaat

SEQ ID NO: 7137 - DNA, 812 bp, Diabrotica virgifera
  misc_feature (762)..(762): n is a, c, g, or t
aaaccatgtgagaatgtactttcagaaattaacctaataaaatcatcactaagtacaacgtcaataatattaacaaactattctaagagatctaccagatgagagctgaagatactgatattaattcgacaataacgaatttagataatagtattaaacgattagagatggagtattaaagactttactggaaataataaagacttacgactagtatttaaatgaattgaaaaatgatttgaggaagaaattagtatactataatacgagtatcaaaatacaattaggtaaagcttgcgcattcttcaggatcaaatgtatataaacaaacttaatccagcaatacagagtcttaaccacagcagtaacaacttgcttacatagagtgactattctcaaacaagacaccaaaatgtctatacggcagttgaataacgacttgatggtcactcaagactcgctagaaacagatgacgagaagtttatattggtcaatttagcaagcgttgaaatgatgttcggtagaaagctagacgatgttttagcatctgcaaagaaagaatgcgacaaatcactgaatgatgtgactgcgtgtaagaatatccttaagaacgatctagcagacggtggaagggaagcttgacaaatgctcaattgatcaaaagacgacttccaatgaactgaaaaaggtagaacgagctttatctgctagaatttcatcatcttactacgacattaagcaattatatgattcgctctacnattacgcttatatgtcgatttctagtctaacagatgctaccaataacgac

SEQ ID NO: 7138 - DNA, 882 bp, Diabrotica virgifera
  misc_feature (276)..(451): n is a, c, g, or t
gaaagttgtcaatgatgttgtaacttacagagaaaaaaataacgtatataggaaagacttcatgcatcttctaatccagttgaaaaatattggaaaggttactgatgatggaacgatcaaaacagactccagtaaagatgttcatctcaccatgaaagaaattactgcacatagtttcgttttctttatagccggctttgaaacttcttctacagcgatgacatacgctttgttccatttggctcaaaatgaagtcctgcaggacaaggctagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaggaacagtactcaacatatcaacacgtggaattcactacgaccctgatatctaccccaacccaaacgtgttcgatcctgatagatttagtccagaaaataagagttctacatccccgatggcctttttggcatttggtgaaggacctaggctatgtataggattaagatttggaaagctgcaagccaaagttggattgtgttcaatattaaggacatgcagagtaaccttgaacgaaaaaacacagctacccttgaaatacgactcaaaaacacattttcccaacgtcgaaggtggtgtatggttaaaccttgaatccctggaataacctctaaccattaggcaagataacaaacaaaaagaagaatgagtattggtatcagattagtattagccattagtataagtgtatggtagtgaaatacg

SEQ ID NO: 7139 - DNA, 932 bp, Diabrotica virgifera
  misc_feature (533)..(550): n is a, c, g, or t
  misc_feature (799)..(800): n is a, c, g, or t
  misc_feature (835)..(835): n is a, c, g, or t
  misc_feature (852)..(852): n is a, c, g, or t
ctccaatgacttttataaaaaatacaagttaaaatgaatcataataataatatgttacaattgtgtagactgtgtttagttaaggacgaagttaatataccaatttttgaggaacaaggtgatattaggcaaatattcctgaaaattagttcgtgtctaccggtgaaggtttcccgagatgaccaactgcctaaaaaaatatgtgatggatgttcctataagttagatatgttgtatgaattttggaatactagtgcgaatgcagagaaacaattgttaacatggttgggagaggcgggcatgacatctcagatgacagatggaaccatttcagctgtagcacaacaaatcaagccagcagatgcatttgtaaaacaagagacaatagacccgccagatatccttaaggatgatgacgatgaggatgaagaggataaagactatatgaaacaggaagagagctcgaataatgttgaagagcctcctccaaaaagggcgaggcggacagctgcagttaaagctgccatcgcctnnnnnnnnnnnnnnnnnnacgacgatgattcaggagagccaatgactaaggttgaagatgacaccgacgatagtgataatgacgatggacctccgttcgttgatgtaccatcaactagtgcagatgatcaacctggaccctcgggcgttggcaaagatggagtagaagcaccgttttacggaaatagctatagtattaactcataccctagtacattagataatattgacttggaattggctattggcatgtttccctgaatgtgtnngtatagtttcagaaccccaatacactaacgacganacggtattcgacagaanaatagagaaagataaaagatcctttagaaaatacaaagaaagggcaaagaaaaacaatgaagagaagtcagaagctaaaa

SEQ ID NO: 7140 - DNA, 584 bp, Diabrotica virgifera
  misc_feature (461)..(492): n is a, c, g, or t
gcgcccgcaggggggctcctttcaaattagttgttcttaaaattacaaatcatgaaaagggggaagccgttttttctgccggggggggaaaggttctgaagggttttgaaaacaacgtacaaaaagttgaacttcaaacaaaagttgaacatagggtggaaaatttccccctcccagttgactcctcagggctcgttatgactcaccctcccaaacaaggaaaggaagagagaagggattttttccttgaaagcaacaagggaagggtcaagatcgaagccgaggttactcccgttcaaaaaattctaccccttgaaccccgtctgggggaaactcttttgccgggccggggccacattttcgatctcgggggaattccttttaatatggttgttttagaggggaaaatttatggggaggaggaagcggttttttcagcaaaagggggaaacgttcttccnnnnnnnnnnnnnnnnnnnnnnnnnnnnnnnnacgtggaacacaaagttcaaaaggttcgtctaccagttcactcagccgggttggttctagttcacccagaaaaagagaacgatgaccatagg

SEQ ID NO: 7141 - DNA, 644 bp, Diabrotica virgifera
  misc_feature (118)..(135): n is a, c, g, or t
caaaagtaatattcaaatattaacagtttttctttacgttgattgggagtcccttaagaaaaaacgccgagtacactcctgcatcaaaacatctgcctagcttccattcgactctaannnnnnnnnnnnnnnnnncgcaaacaatcagaattgctatggaggattttacggcagacactgatttgccataccagtttaaggcagaggatttaatagcagaaggaagagcatctaaagaacacgttgatgaaatacgaactttcgtatcaaatttaacagacaaatatgtccctctgaggatacaggacgaaatgataatcatatttttactatcatgtgcacacgacgtagaactcaccaaaaaaacaattgtaaattactactatctcaaatggcacggtcctgagatatacgacgacagacatatggataggcctgatatacaattagcaataaagactatacgtatgtcaagtataccagttcgaacagaagaaaacgacgtgtatcactatttcaatttaaaggataccaattatagaaattttgaaatgatacctataatgaaggtatcatatatgctaatggacatcgcccaagaaaaaaatcccccaagtgttctttttgtaggtatagatatgaaa

SEQ ID NO: 7142 - DNA, 418 bp, Diabrotica virgifera
gaattatgaataacaaaataaagagagatagctgcctcgaagttgcgatttcttcaaacgtacatctcatcctgcaccatgtctaacaagaagtgctgtcatcccatggaatgggaataatattttccttgatcacattgatctctgaaataaattgcagtattctagatattgatacttgctctcactcaataactacatcctacttaccactaaatcatcgatcaaggacttactttgaatacatcacctggtaataatctgaactgatattatggcagaggatgtgatatcacactacatgagccttagtgcatattccgttatagatgtggttactatagagatagctagaggtgtcacaacaatacgatcgaaagatatacaaggagggtagaagtgatggtactgatttaga

SEQ ID NO: 7143 - DNA, 551 bp, Diabrotica virgifera
ctttcggcgctcagacgatcaacaaaaactcgagatgggctgttttttaaccaacagcatcgagaagaatgccatcggcagcacgttaaaagattacataatcgctttggaaatagtcaaaaatgccttagaatacataactatgcacgcaccttggggcgggccgactttattaagggtagacagcgacgagttgaaagatttcatatccaaaccggctttggagtacatcttgagatttttaactggattagcacatagtcacgaaaaaacggaactagcgatagctgctgcggaaactattccgatcattcatcgtctggaacaggtgtcttcagatgaacacgttggatccctagctgaaaacttggtagaggcactctgcacgaatccagacggcgcgaagcagattgacgccggtagagaggttaccagatctgggaagaaacgtctcggcctgggaatgagggaaaagcaacttgggccggtgggaatgagaacccacgataaagggccagtcactggaaaggcctaaaatactcccacaaatt

SEQ ID NO: 7144 - DNA, 714 bp, Diabrotica virgifera
  misc_feature (231)..(256): n is a, c, g, or t
  misc_feature (568)..(588): n is a, c, g, or t
  misc_feature (658)..(682): n is a, c, g, or t
aacagtatgtgctggaaatgtaagaaaataaccaaagcctaccagtgaactatctcagaatgtttttaaaaaatgttaatggtatctttatttttgtccagtaatttatatcattaacactaaattatatatttatagatatttattcataatggaagtatttaaatagttgattattgattttttatgtcatcttaagagctaatgtttaaatgttcggtgtactgtttnnnnnnnnnnnnnnnnnnnnnnnnnnctttttaaataaagcaatttttgtattttaacatatatttatgacagatttcaaagggctgttttaattttctatatttgtttatttacgtagaatacacatatttatatctattgatgttgaggttattaactcgtagaataattaggtccgccaatttgttaatacttgaaagattatacttgatgtcacttttaaaatctgtaaatcacttttaaatgtacagttaatttataagttaaagttcgttcatacgacaccgaatcgttactacattttactgtaaattttggtgcacctttacacaatcannnnnnnnnnnnnnnnnnnnngtctacatgattttttagattttattttgttgattgcttaagccaaagatgtagttactgcaattaaaannnnnnnnnnnnnnnnnnnnnnnnntgtgtacatctgtttatagataatcctgcaag

SEQ ID NO: 7145 - DNA, 300 bp, Diabrotica virgifera
ggaggaggaggggggcgggccgcgcgggggggggggggcgcgggggggaattcgcgggggcgcccccctgccgcgcgcggggaggtgtaggggtatgcttgtttctctgtttctggaatcgagagggcagttctcgttgtttggggatggaatgattgatttttgttgctgatatctgattgtttatcatctgtatgagagggggatgttgattgttgtctgtttgggaatggtgatggtactggggttaaagatttgtttatttagtaggtgtctcttggtgtgttggagggtgaggcg

SEQ ID NO: 7146 - DNA, 576 bp, Diabrotica virgifera
  misc_feature (369)..(406): n is a, c, g, or t
tcattttctactgccataaaaataatttaactggtgcagttttagaaattataagaaatggctagtttattagcgaaaagctttagggcagtgtgtagaaactcctcgtctttacgatctttcagtacaaggcctttggcagtcacattagtaaatagatgcagtgatattttacaaaatagctcacaaagtaaacctggttctttgatcgatatacagacaagattctattcaccagaggtaataaaacctaaaccttctgaagaagaaatcaaacaaagggtgctgaaagtgtgttcttcatatgataaagtaactgcagaaaagctgactttgaactcccacttcatcaatgatcttggattagannnnnnnnnnnnnnnnnnnnnnnnnnnnnnnnnnnnnnatgaattcggctttgaaatcccagatgctgatgccgaaaaattactgagacctgcagatattgtgcggtacgttggggacaaagaagatatctatgaataagtaatgaaatatgtaaaaatataaagtaaattactgtactcctgtcatatagtgttaattaagtttatt

SEQ ID NO: 7147 - DNA, 75 bp, Diabrotica virgifera
  misc_feature (22)..(44): n is a, c, g, or t
aagtgaaaaagaagcacctgcnnnnnnnnnnnnnnnnnnnnnnnccttcttttcttctggcttggcggaattttt

SEQ ID NO: 7148 - DNA, 799 bp, Diabrotica virgifera
  misc_feature (68)..(88): n is a, c, g, or t
  misc_feature (238)..(262): n is a, c, g, or t
gcaaatgaaaggaataaattcgttatttcgtaaaccggcgacttttaggaaaaatcccgaaacgggtnnnnnnnnnnnnnnnnnnnnngatattttggcatatatggcatactagcgacgtcatccatctgggcgtgatgacgtaatcgatgatttttttaaatgagaataggggtcgtgtgctagctcatttgaaaggttattattaactatttagatgggaaataaaccacaattnnnnnnnnnnnnnnnnnnnnnnnnncgtttcgacgcccaaatcgggtgtcgttgacaaaatacaaaattgtactactaaattaaacaaaaatgttgttgctaagtaaaaaattcttctaataatttatgactcatttatattggcaattcagacatatattatacattttaaagtagaagactttaaaatgatattgccaatatttatgagttgcgttcctgggacgactttactgaaagatagttcattcgattacatgaaatcaaccccaaccaactcaagaatattcgtcacgaaaaaatcatagcatgtgatctgtctttaaaaagacaaccaaatgcaatgatgacagtaaaattctcgcgttagagattccatagtaaatcacgagggaaaaccaggaaaaaatctcgtgatactatcccgacatcgtaagtatttggtcttacatttaatttactctcaaaaaatatatcaaattctgactttataatagtctcccattttataccgctgtggctttggagtatagcaggatagtctgctatatctagggcctac

SEQ ID NO: 7149 - DNA, 1222 bp, Diabrotica virgifera
  misc_feature (2)..(566): n is a, c, g, or t
  misc_feature (568)..(582): n is a, c, g, or t
  misc_feature (698)..(712): n is a, c, g, or t
  misc_feature (722)..(749): n is a, c, g, or t
  misc_feature (794)..(846): n is a, c, g, or t
  misc_feature (857)..(1014): n is a, c, g, or t
  misc_feature (1100)..(1127): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnntataggtttaaaaaggaattccggaacctttttttccccctggttattaaaaccatgctttttgcattaaaaataagtctcccccggcccctggtttatttgaatggccgcgggannnnnnnnnnnnnnngggagcatannnnnnnnnnnnnnnnnnnnnnnnnnnnagaagggggggcgaaaaaaaaaccggctttatttcaatttataannnnnnnnnnnnnnnnnnnnnnnnnnnnnnnnnnnnnnnnnnnnnnnnnnnnnccccaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgggaaacccccgaatttttttgggggggccacccccaaaataaaatgcccccccccgcgcgggcggtaaacggtatttattnnnnnnnnnnnnnnnnnnnnnnnnnnnnctcccccccccttcctaaaattttttctctcctgccgggggcgtaaaccccgggcgggggggcgggcggcggggggtttttctcttttttctctt

SEQ ID NO: 7150 - DNA, 888 bp, Diabrotica virgifera
  misc_feature (264)..(279): n is a, c, g, or t
  misc_feature (281)..(298): n is a, c, g, or t
  misc_feature (607)..(619): n is a, c, g, or t
  misc_feature (621)..(633): n is a, c, g, or t
  misc_feature (860)..(878): n is a, c, g, or t
cccacgcgtccgcataatttaagagtaaaagtcgacctgttttaggactttttcttaaagtcggtggcttgcgaaataacgaatttatgtattccaaacatgcatcatactgtacgtaattgcataagatgccacaaagaaataaattcagaagaatatttactttattttgttagaaaatttgaaaatatctgtcaaaacacacatgataatttaataattacatagatcttagatttaacttttacgtaattacttacctgnnnnnnnnnnnnnnnngnnnnnnnnnnnnnnnnnnggtacgccactgcaaagttgacaagagaactattggtgactcgttttaagtgcgatgttgccaatgaaacaccttcaattaaaaatagttgaactttttttataacatgggaaattaaagaatgtctttcgacgctatacgatttgtctcgtactatctcacaactgaatatgttttccatcttttgcgttattttgctggtttttagcgcactcatcactgtataatattccttttattttctgctatactgctatacactatcttctgacacaaacaaactttgttttgctaaaagttctgaaaatnnnnnnnnnnnnntnnnnnnnnnnnnncgtgccaaaaaggaattatattcgagtaaagaattagttgttgctatttcgtctcaaaatctttcgttatttaggaaaatcgtgtatatagatgtaaatattactaattataactgaagctttaagtattattatctagattgttataatcatattagtggtttatttgttttacttactataaattgatatttaatgaaatatgtttttaatttcatttgtgtacnnnnnnnnnnnnnnnnnnntttttgttgt

SEQ ID NO: 7151 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7152 - DNA, 927 bp, Diabrotica virgifera
  misc_feature (473)..(548): n is a, c, g, or t
  misc_feature (812)..(813): n is a, c, g, or t
  misc_feature (821)..(821): n is a, c, g, or t
  misc_feature (832)..(832): n is a, c, g, or t
  misc_feature (892)..(892): n is a, c, g, or t
tgtatattgaaccttggcatgctgatattctcgaatttttgaacctaagtaaacccggtggtaaagaagaagtgagaacaagagatttatcatatgctttgtgggtaccagatttgtttatgaaaagggtagaatctaacgggaaatggtctctaatgtgcccccatcaatctccaggtcttactgattcttatggagataaatttgaacagttatacgaaaaatatgagaaagaggggaaatatataaaacaaatacaagctcaagaattgtggagggcgattattgttcttcaagcagagacaggtggcccggttatgatgtacaaggatgtatgcaacagaaaaagtaatcaaaaacacataggaacaattaggggtggaagttacagtggtgaagtagttgcatatacatcagatgaagaaatagtagcatgtccccaagcttctatcgctgtaaatatgtttgtcagnnnnnnnnnnnnnnnnnnnnnnnnnnnnnnnnnnnnnnnnnnnnnnnnnnnnnnnnnnnnnnnnnnnnnnnnnnnnattgatgttagcttctatcctgtgcctgaagaaaagaagtcaaacttaaaccatagagccattggcataggtgttcaaggtttggctgatactttcatattgatgcgtatgccctgtgatagtgaagaggcgcgaaaattaaataagcagatattcgaaactttatattatggagctctagaggcaagttctaatttggcagagttgaatggaccttacccaatgtacgaggggcagtcctgtcacaggcaaaggtgttcttcnnatatgatnttgtgggacgntaaaccatccgatcttatggggattgggcatcacttaaagaaacaatcgctaaaactggntgtgcgtaattccttattattttgcacagatgtcg

SEQ ID NO: 7153 - DNA, 764 bp, Diabrotica virgifera
gttatgtttcaagatggtatacttttagaataaatctcatatcatcatcatcaccaatttcgcactcctaacattcgcaagtcgtctttcacctggtccttaaatcgtgttctgggcctgctttttcttctcactccatccggtctctagatataaatgtatgtcgatggttccacctcattcattctctctaagtggcctagccaccagagcctgtttattttgatagatctaccaatactaggctccctataaaggcagtaaagctcaaaattatagtatctatgccataatccattttcctgcacgcctttataaatatgcctgaggatgttcgttcaaaactgcctcaccgttcttcaccagtttttgttttcgtccacgtttctgacacataagtaacgactggtttaattagagttctatatatcaatatttttgttctttttgtaactatgttcgatgttaaaagtttctttaatccacagtatgctctatttgctagatatgtgtattaatttctgcagatattgtattaatttggttgatttgtgagcctagatatacgaactctcttactccttcgaaagtataatatgttccaaccattatatcttcaggttttgctacttcattattatttgtgaccctcacataattagttttattagtgtcaacgtataaacctattccttttgctgctgcttttaataccgtgaacaggtccgcctttctacttgctatgatattaatgtcatctgcat

SEQ ID NO: 7154 - DNA, 890 bp, Diabrotica virgifera
  misc_feature (803)..(803): n is a, c, g, or t
  misc_feature (836)..(836): n is a, c, g, or t
  misc_feature (869)..(870): n is a, c, g, or t
  misc_feature (880)..(880): n is a, c, g, or t
aaaaaattgaagttacttatttagaaaaacggtaaaacgttataaaacttaaaattattaatatatgtcaagctaaaacgtactattggcgagagccagctaacgaaacctcaagagtattctgaagaactctcgcgtatcaaccatacatatatgtccatagaggacagtaaagaaaaaagtaccccctaacgtaaaatgtataaaatacaaacgagacgtctaatccctgcggcctatggattctaataacccggtcaagttagttcacaaaatgggggtaaggtttcaaaaattcgaatagagctaaaaattggtacgaatgttcggaacaccattatatgtgaaagttaaaaagtacccgttaatcctacatttgcaaaataaagttgttcatgatcaaaggtcgcaaataagttctttacatttttcagcctaaccatacgtattattataaaaattagacaaaaatcttagatcatacatttatgtataaaatatgtctatactttttcttctgagagtcatagtccagagaaataaggattttctcaggacactcaaatatttaggtagctgactattgttttagttattgtaaacctataggaagaaaacctacctgattcctgcctagagttggcgtccgttttttaattattaacaatttactgcaaaaaccgctgttttttgatttttgcaccccgttaaaaagctaaatagttgacacaaaattacaaaatttgattttttagactatttaaaaagcttcaaaatgccgattttcgacatacttatactanatttaacttagaactttagggtttcacccaaangtgggtatgggagtatttaacgaacccacaaannattagaccgnatcattaatt

SEQ ID NO: 7155 - DNA, 1343 bp, Diabrotica virgifera
  misc_feature (678)..(678): n is a, c, g, or t
  misc_feature (723)..(724): n is a, c, g, or t
  misc_feature (925)..(948): n is a, c, g, or t
  misc_feature (1131)..(1184): n is a, c, g, or t
  misc_feature (1199)..(1222): n is a, c, g, or t
  misc_feature (1236)..(1256): n is a, c, g, or t
  misc_feature (1269)..(1339): n is a, c, g, or t
cataatttagtaggatgtacagtacctgtattttctgccaggtatgacggggatgtgtcaaatggttttggagccctgggtggaagtggttgttaaatttttaaatggagcaccctgtaactcggtaacgagccacattttatttaatgatttgtgttaaaatcttaatattttgaggtctagaatctgcatctgaaagattggacattcttaatgaatcaccctgtatattaatagtataatctcgcacatttacaagacaatgttcttacaaaaatcgtttaaaacttttgcaaattaaatgcttaggtttgagattaaatctgaacccagaaattattctgacagactttgaaatagccattcacaatgccataagaacagtgttcccaaattccaaaatagtaggctgcaggtttcatttggcacaagcatgtcacaaaacagtgaaacagtctacaattgaatcggtcatttcaaaaacaacacgagtcacatattcctaattttaaaagagagtaaaaaaactaactatagtacgttctttgacggtaaaatattgcaaaacctcccaaattttaaagaaccgattggattgacatgaaatttaacataaacatagctaacaagtcaaagagaaaagtgatatggtggccgatggtgtgcttttgccctggnggtggttttcgccccctttttggaggtgaaaaaatattcttccannggtagtccgggaattgataaactgactaattctgagtaacttttgttctatacagttttttcaataagtcaatactttttcgagtttatttgccagtgaatatgttcattttttcaactattagacgggttttcgcaaatgacttcagtaagtagggaactttgtccgaaaaaactttcctagcaaaaaaattaggctggnnnnnnnnnnnnnnnnnnnnnnnngtatattttcccggtttttttacctagtaaaaagaagagtttatagtctaattgaaaaaacaaggtttaatttttcctcaaatttcccaaaatgataataatttttaacgcgggggggggcccaaataaaaaaagccacatttttcgggaaaagggttctatttaaaactttggttttgaaannnnnnnnnnnnnnnnnnnnnnnnnnnnnnnnnnnnnnnnnnnnnnnnnnnnnntttctttaacaaatnnnnnnnnnnnnnnnnnnnnnnnngttggggcgccccnnnnnnnnnnnnnnnnnnnnntggggcgcccccnnnnnnnnnnnnnnnnnnnnnnnnnnnnnnnnnnnnnnnnnnnnnnnnnnnnnnnnnnnnnnnnnnnnnnncccc

SEQ ID NO: 7156 - DNA, 880 bp, Diabrotica virgifera
gacgtatatttgtttagcagtgttttatttccatgaagcgtaatttgcgttttgtgtttctttgatgtgcgacctaccttaatcattagatagaatgtataaagctaggataaatcgttcaaaccgtttaaatgtttactaacacaatataaacacatcttacacatttgttagtgcagaactttcaaatagaatcggatattttattgtagaaatatttaattttcttactaccaccatggtttaagaaagaatctttagtattacaaagtgttagaacgtttcagacccagagatcatcattaaacattatttctctgctttttattgttacaagatgcgtgtgaattattattgatttctatctgagtatttttacatagttagtataactcttaatatcgtaaatttctaaaaaattgccctcatacatgaaccttttctgggtctgattgacttgaagaaagcatttgacagagtaagattcaaaaatgtcataaaaactattaaaaagatctgccaaaacaacaaaatggaagtcagaataaattgacaacttattgaacctatagagatagacaacggaataaaacggaggactccttaagccataatgctgtaccaatttaatcatggatgacgtgtcaacagtgaaaggagcatcaacagcgtcaaccaaaggaataaggataggggaattgggaaaacaaaaaaagtatactcaccgcgaggggacccgccaaagcgtccggattaccaattaccgccctctttgcaaataaaatggacggcccatctttgccaagtaaaaaagaaatcttactctacaccccgcaacaacactttacccctggagttagggatccctttttccatttac

SEQ ID NO: 7157 - DNA, 1012 bp, Diabrotica virgifera
  misc_feature (323)..(349): n is a, c, g, or t
acctaagtggatatatttgccataaattgaaactgcctttatcaacggatacttcccattttacatggacagaccaggtttccgagggaggtttaaaaaagccaccagaagaaatggttacaaaaacagttgaactggagagaattttcaaccagattcatggaaatgggcttaaacctggaaagaatttcttaaaaaggctattaacatcagcaaatgatgttgattgtgatgataaaataaagacacttttttttaggtcacgaatgtattttagaattaaggaattgaatcttaatttaaaggacagtaagacaaaaacnnnnnnnnnnnnnnnnnnnnnnnnnnngtaatgcttgttttcttcttcttaatgtgctgtgacgaatgttggtgatcatcatcattaatctttatttgatttgcagcagtgcagaaaagttgcatagatattgtgttgaaccaggttctgaggttctttaaccaggatgttcttcttcttggaccttgctttccaaatatttttcctcataggatggcttgtaggagggcatatatggattcatttcacataatgtatccaaagtattttaactttccagatttgatggtggtcactggtcactacctctttgttctttttcattcttcggaggacctcctcatttgtgacccggtcagccacggaattttaaatattctctggtacagccacatctcagatgctttcaattttctgcacttatcttcgatcagggccacaattccacaccataaaaaaggacagaaaaaacggaaacatcgcagtattcctccactttcatgccaagcgaagggtttgtggtctctaaaagaaggtcccccccccccctttcagttgaaagggggatctagccttttctggagggggctcttatccccttgggggggggggccttttttcaaatatgggggcccaagggaattggaggggcttcccccttttccacggggggttaagggggtggtgggg

SEQ ID NO: 7158 - DNA, 513 bp, Diabrotica virgifera
atgacggcggcgaagaagaagggaggagagcgcaggacactctttgcacgcagcggggcgcgaccaacacaccaagggagaaccggaagagacacagaagagggaacgggatcgcgcttcgactcgagaggagaccaacgcggaaaccgcaagaggggggccgagcccagacagggcgagggggggcacagaaggccaaacacaagaacccagaggggccaagggggggaaccacggagaacgggagaagctatcgaccgtcgtaccctcgctggagtttgagagaacctgaactacaaccaaggggagatagggactggtattttgcgtgctcgtgcaggagatgtcgacgtccccagaagccaaaaaatgtcttaaggggaagcaggggcagacttagactgagaagagattgtcccggatgctgggaggtcgtatggatgtgggagatgatatatgcatgggacccgtgggtctgtggggcccgcccaatgaggtgtgggacaagggggg

SEQ ID NO: 7159 - DNA, 197 bp, Diabrotica virgifera
  misc_feature (52)..(94): n is a, c, g, or t
gttatattattagaagaataatatcatttcgtgaaatatattcactattgcnnnnnnnnnnnnnnnnnnnnnnnnnnnnnnnnnnnnnnnnnnngccgtgtatctcagagattatatatcataatcaatatcatcatatgttatatattttccacacctataatcagagtgtacaaaatagtataaacatctattgt

SEQ ID NO: 7160 - DNA, 764 bp, Diabrotica virgifera
  misc_feature (19)..(76): n is a, c, g, or t
  misc_feature (82)..(94): n is a, c, g, or t
  misc_feature (96)..(191): n is a, c, g, or t
  misc_feature (208)..(221): n is a, c, g, or t
  misc_feature (223)..(285): n is a, c, g, or t
  misc_feature (295)..(372): n is a, c, g, or t
  misc_feature (376)..(468): n is a, c, g, or t
  misc_feature (494)..(534): n is a, c, g, or t
  misc_feature (538)..(590): n is a, c, g, or t
  misc_feature (597)..(645): n is a, c, g, or t
  misc_feature (656)..(763): n is a, c, g, or t
gcggggggttctccgcgcnnnnnnnnnnnnnnnnnnnnnnnnnnnnnnnnnnnnnnnnnnnnnnnnnnnnnnnnnngccctnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcccccgcccctcnnnnnnnnnnnnnncnnnnnnnnnnnnnnnnnnnnnnnnnnnnnnnnnnnnnnnnnnnnnnnnnnnnnnnnnnnnnnncactttattnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcgagggggggggggggcgcgcnnnnnnnnnnnnnnnnnnnnnnnnnnnnnnnnnnnnnnnnnaccnnnnnnnnnnnnnnnnnnnnnnnnnnnnnnnnnnnnnnnnnnnnnnnnnnnnnaccaccnnnnnnnnnnnnnnnnnnnnnnnnnnnnnnnnnnnnnnnnnnnnnnnnnttattttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 7161 - DNA, 399 bp, Diabrotica virgifera
  misc_feature (2)..(93): n is a, c, g, or t
  misc_feature (95)..(148): n is a, c, g, or t
  misc_feature (333)..(385): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnagaataaattaccttaagggataacagggtaatttttattggagaagtcaaatcgaaaataaaagatgcgaactccaaggtgggattaaagtttataatttgggggagaaatttaattattaaagtctgtcccactttttaaatttttaaatggttcctgggtttaaaacgcggggggggacccnnnnnnnnnnnnnnnnnnnnnnnnnnnnnnnnnnnnnnnnnnnnnnnnnnnnnaaaaggggcccccc

SEQ ID NO: 7162 - DNA, 1161 bp, Diabrotica virgifera
  misc_feature (1015)..(1043): n is a, c, g, or t
  misc_feature (1078)..(1099): n is a, c, g, or t
  misc_feature (1115)..(1135): n is a, c, g, or t
attgatttaaaaaaaggataaattcgtcaaagtttttctggacgcttcgtatattcatatgtagtatttttaagggaagattactatttttactaaattgattaaattctgctattgcattgattgtttgggcgttaatttcattattatcataatcacgtatgaatggatccatgttcaaagtttaataagtaggtatattagtattaacaacgaatatagacgcaaaatattaaatacaactatttattagatgaacgtaacctagtaagatgacttgatttttcgagctggttctctgtagacttatttttcacttctttctcgatattcttctttatattggcactcttaatagaattttactggtttttgggtgtacctattggtttttgttcaaatactggtatttctgcctcaaaggtcttgtggatagttggtgtattcggctcactatttgtttggtgtagattttcccctgtatctgtaagtcttctatagagtaagaacttccgtctacaaaaagtttgttgcccttaatgtagcttttagtagttgacttctctctggcaagtttaaggtggtattttaatagtttttgctcttctctttgtttttggtatagtcgtgagttatgtttatgttttttcctttcaaccgatggcaatttttaaggatttctcttttctttatatttgaaaccaattctagtttaattgggttatttttataatttttgaaccagataaaggtgttaatatcagacaaacaaatatcaatacctagtaattcttttaggctatcacaaatgaatttagaagaaatttctgctttgctcaattctattccttaatgaaaattgagttttccttggatttctttctactttttcaggttactttttaactgtaaattttctttctcaaatcttttactttttatttaaaccttcaccattcaaataattcggggtttcagttgcccctttggttttttttgggggcattaaatttcnnnnnnnnnnnnnnnnnnnnnnnnnnnnnctcccccccttcccccccgttttccgccaatttcnnnnnnnnnnnnnnnnnnnnnncccgcggggttggggnnnnnnnnnnnnnnnnnnnnncctttttagaggcacccccaaaaaac

SEQ ID NO: 7163 - DNA, 412 bp, Diabrotica virgifera
  misc_feature (24)..(42): n is a, c, g, or t
ccttggggtgcgcaggggtcggtnnnnnnnnnnnnnnnnnnnactcaaaggaaacctattcgaagttttcgggagaaactcccggaatttcctgtatctccccaggttggctcccagcaatgcccccctttgggaagacacaaatcccccggggatgtgagagcagattgcataaaaaagcgggggagggctggtgagggccatggtaggatacgggcttatcaggggactcattcaaattgggggggtggaaagctcatactgaagccattaacccaaacgggcccccacaaaggctacctgaacccaccgagggccaaagaacggggggggtcctttcgtggaggtggcggatggaaacgcccttgagaggcaagaaggggagagcgcggagccttcgggcgcgggccac

SEQ ID NO: 7164 - DNA, 362 bp, Diabrotica virgifera
  misc_feature (7)..(63): n is a, c, g, or t
  misc_feature (72)..(93): n is a, c, g, or t
  misc_feature (112)..(129): n is a, c, g, or t
  misc_feature (137)..(155): n is a, c, g, or t
  misc_feature (200)..(217): n is a, c, g, or t
  misc_feature (290)..(341): n is a, c, g, or t
ggggggnnnnnnnnnnnnnnnnnnnnnnnnnnnnnnnnnnnnnnnnnnnnnnnnnnnnnnnnnccaattttnnnnnnnnnnnnnnnnnnnnnncctttagggaaaaaagggnnnnnnnnnnnnnnnnnngttcaaannnnnnnnnnnnnnnnnnncacctccatggtggggaataaaattttttaattgggggggaaccnnnnnnnnnnnnnnnnnnttggttcccacattttataaaatttttctcgggtctgtgggggttataaccccggggggggagaccgggggtnnnnnnnnnnnnnnnnnnnnnnnnnnnnnnnnnnnnnnnnnnnnnnnnnnnncgcccaaagggggggccaccc

SEQ ID NO: 7165 - DNA, 944 bp, Diabrotica virgifera
  misc_feature (774)..(791): n is a, c, g, or t
  misc_feature (800)..(800): n is a, c, g, or t
  misc_feature (880)..(880): n is a, c, g, or t
  misc_feature (890)..(890): n is a, c, g, or t
gtgagagtgagcagtgtgcaagccgatgccaataatatttttcttgtttttgaatagtttatcattatttgttccgagtttcgagttttaagtcagtaatttaacagtataatgactttccaatatattgaactaaacagtgatccagaacctctaattcctggcacgatggaagggagtttaagtaaatggggtcaaccagacgagtttatagggatgaaaaatccgtcaacgaacaatttctcgtgcaacaccgaaattccagaaaggcctgaaaaccgaaaacccacagatcaaaaattcctgattgcatttgccgttgcagtgattattctgcttccgttccttatatatacattggtgtactctgatcttgaccattataaaggctatgaccaatgtggtaacgtatgtggacagaaaaataagaagtatgataattgggcttgtagtggagaagataatacaaacaaaccgtatttactgtactacaccagtgttcataatttagaaggagaaagaaaatgtgttgaaagatgcgaagatggagattatccaggtaacggtgcgtactgtactaagattacatcaagtgatgattttggggatggcctatctgattacttaaacaaacatgctgggacaattgtattcgcatgttttctatcactaggtgttggattgataatgttgttcctgtttaaatccgctacagatgtagttgtttgggtcggtctagtaggagctctattttctggaaccatttttgtactnnnnnnnnnnnnnnnnnntttcaattntcaccatgtaatggaagaaaggattggtaacgtgaagtaccctgaagaggtgtttctatttgccgctctagtttatactnagtacatatncgatacagtgggtttctgactgtattcccgtaccaaaagatacaattagtcatt

SEQ ID NO: 7166 - DNA, 923 bp, Diabrotica virgifera
  misc_feature (880)..(880): n is a, c, g, or t
gccaaaaaagttactcttttggcctggacaatttttttaaaaagatgacggatctagattcgcccaaaaaaaataacgactgttatttttattattattcgacatgttctaagggagatagttgtatatttcgccatgaaccatctgccttaggttgtgaaaccatgtgcagtttttggaaggaaggcaagtgttttaacatccaatgtaatttccgacatatggaactaagaaaaaacagaaaagctataccgtgttattgggagagtcaaccaggaggttgtttaaaaggacattgctcatttttacatcagaatccaagacccgtagatgctgttaatagatcatatttatctacagccgagtctgtaggcaatttaaacaatagtgaacgaaacgtaaccgtaggagaggacctagtcgtaaattttgaagaagagtcagataatgagtctatgcccacatactcgcccgcaaaacacaaggaacgcatttgtacagtgaaatctttggaagagatcaggctagagaagatacaagcagaatcagctgcttactattcatattcagatgattctttccaatatgacggtcaagctaatatgatgagagagaggatattttcgagaatgcaaaataaactaccaacagaaaggacagttgttatacccaaaagacaaaatgacagtcagtttgtccctacattaccgaagaaacgaagactcgttttccacaatgaagatggtaatcttgagattagaataaataaaggaaaaaacaagcttatgccgaaaacaaattcgatacataaattggaaagaacaattgaaaatcagttatatcgacgaacaaccataccaaatcacttcctcttatactngaacaacttagagatatcaaaataaaactttggatgaaatacg

SEQ ID NO: 7167 - DNA, 809 bp, Diabrotica virgifera
  misc_feature (57)..(78): n is a, c, g, or t
  misc_feature (761)..(761): n is a, c, g, or t
  misc_feature (787)..(787): n is a, c, g, or t
tgtatctccttacttttgccgatcaagacccagattcaagtcttcttgggttttaannnnnnnnnnnnnnnnnnnnnnctatttagaagatggcagtttcagttagaggtttctctcatcggattggacatttaagtagcgttttagctactgttaaatcatcccctagaacttattttacatatacgaacgaaccctcgcaacccattaaaggaaaagagccaaaatggtgtactccagaggaagctttccaagatttacaatcaggtcaaaccgtattctctcagggagccgcagctacaccgatcgactgtctaaatgcaatgacaaaagtaggaaagagcaaaaatcttaaagatattacagtatgccatatgcacaccgaaggtcctgcggcgtatacggatccttcttgtgagggaatttttaggtcatgttcattcttcatgggcggtaatgtacgaaaagccgttgccgatggtaggggagacgccattccgatatttttatcagaaattccactactttttactagacaaatagttaaaccagatattgcagttattcaggtctctcctcctgatcaacatggatactgcagtctgggtaccagtgtggactgtgtaagagcaggaatgagccattccaaaattatagttgcccagataaatcctagaatgccaagaacatttggcgatggtataatccacatcagtcacatcgactacgccgtaaaagtagacactccattaccttgccancgtggaaaaccgccatctgacgtcgnaacacagattggtaaaaatatt

SEQ ID NO: 7168 - DNA, 691 bp, Diabrotica virgifera
aagacttcttgtactgactggagaccgctgatcgacatgatgatgatggtgttatattgatttattatgaactttcacaagcctcaccaggtgctgctgataaaatccttaaaaatacgtaatatgattgaaagggtccacactgcgttaaaagggttggctaatgtcttctatatggcccccctgatatgcggcgacaccactatgtctttcaatctccatataatgactattgtattgataaactggtatgctgaactcttcaacacgtgtgatagatagagcctgggcttcatttgatattgctgctcttttcgctccccgtatacgacaggagttaacgtgtgaggctgacggatgagatagctctgaagcagatggacatctcctgctaatgttatgaccatatgtcctgccaataaaagttgaggaaatctgagtaaatgttatttgggggtaataagacagactacatgattccgcacatagtttggtatactggtacgggaccaaccgaactgctctgatgcacgcaagacaattaaggagacttttgcatcaaaacagaattcattatgacaaccctcctatcgcatatgatacggaccccctgagggaatgaaaaataggattaggacagaagtaacatgtgaggatgatgtagatgtggaagagatgatggatatcttag

SEQ ID NO: 7169 - DNA, 865 bp, Diabrotica virgifera
  misc_feature (78)..(94): n is a, c, g, or t
  misc_feature (778)..(778): n is a, c, g, or t
  misc_feature (840)..(840): n is a, c, g, or t
aaagctcacgtagataaggaccaagaatggaagaaggtacgtcaagatattggaaaaatacaaggacaaagagcccannnnnnnnnnnnnnnnnctaatgtaacaattcctgtcggaggggcaggaatacccgaactacaacagtttcagggacacctcacagattacaaaattgtggtgtatagttatggtagcaagggtcgtgacgttatgttctgtggtaacactaatggtccagcgttaaatcttttgtatcatgaaggacactttaacgtgatcacttctttgacagctgctttttgctgtcgatattattgtgaggagtgccaccagccgtttaacaacaaaaacgaccacagatgtggtggtacatgttttgcttgtcgtcgttcaccagcttgttccaaagattgcgtgaaaataccctgcgatcaatgtggtcgaaacttctacggtaaggcatgtttcaatgctcatgttggttcggtatgcgataaaatcaaaaggtgtaagacctgttacaagatctacaccaaaagtcatgtctgtggtgaggtcttctgtaaaacttgtaagaaaaattgtccgtcagatcatctttgttacatacagcccgattctggtaggccaccgtcaaaagattttctatttatattttatgatttggaaactcgtcaagaaacggtaatgcctgatggttcacttcttcaagaacctaacctgtgtgtttttaaacagtgctgcgacaaatgtttggaatccgatacccgcatgtgtnacacaatgtggtggtcacctgcaagttttaaaaaacaccctattgaacgttttatggagttngtacttaaatcacgtaagtatcaaa

SEQ ID NO: 7170 - DNA, 318 bp, Diabrotica virgifera
attgttccgaatctgggatccaacttcaggctatggatacctctcacgtttccttagtctccttaacgctgaaataagatggatccgacaaatagagatgcgatagaaaccttataatgggcatcgaacttgggaagcatgtcaaagatcttcctatcccccagaaatgatgccacagccgctatcaaagcttatgatgatgatggcatagtaacgcttatgtttgcagtcaaaaagtaggtgaagtttttcgattaagaaatgaaactgaggaatttggacaatgacatttgggtatccagaaacaaatttttcttg

SEQ ID NO: 7171 - DNA, 70 bp, Diabrotica virgifera
  misc_feature (33)..(64): n is a, c, g, or t
ctgagtttaaaccggtgtgagccaggttggttnnnnnnnnnnnnnnnnnnnnnnnnnnnnnnnngaaagg

SEQ ID NO: 7172 - DNA, 884 bp, Diabrotica virgifera
  misc_feature (615)..(632): n is a, c, g, or t
atttttgtttaatttgggataatctagaaataaaaattaattggtttttgcttctgagaatttttcatcagtttaccattagacacaacaaagcctgtaaaaggcaatatattgatgatgacataagtccattagaaagaaaaccataatattttcgagacccgttcgactggcggttcccattggcgatttggaagaagaatcgtcgagtcctgcttggcgattcaaccagaggcagcgattcaacttagccgaggcgtcgagaagaatcctgtagtggtatgacatcttaccttatttttatgtaagtgtgcattttgtttatatctctacatagaaactgtaactgcttcaactgtctggcaagtatgaatggggcttcaaacgaagtcttcgacggaatagatatgcatttgaatcagtcttaaatcatttaccaatggggttcattacttttcattaaaaagctaatatatcgttgaaggaatgtctacaataaataccaatgctccttcatctgctgatgcttgtcttagtattgtgcatagtttaatgtgtcatcgacaaggcggagaaagcgaaggttttgcaaaaagagctatcgagtcattagtnnnnnnnnnnnnnnnnnnacgcgatgaaattaaattccttaattactgctattactacaagtggagctcatcccagtaaatgggtaacaatccagagaaccttaaacggaagattaccagttgcaggaaagaaaaaggttttcctcccgtaaatatttgatccaaatatggaagagggccagatttacccaaaaaagagcttaaacctggtaaaaattggccagtttgcgttggatttaaaggggggccccgggggggcgttaatccccc

SEQ ID NO: 7173 - DNA, 877 bp, Diabrotica virgifera
  misc_feature (637)..(676): n is a, c, g, or t
gattatggcgttcttgagcgctacaaccctttgtgagttgtggctggcttaacaatgttcttccattctgccctgtcagatactttccttctgaaaacatttttattaaaaagtcttgatctgcaaccaacagatatatcactcttaccccatggaaataatgtcattttttcagcataaaatgatgaatcgaacagagttacatgtttcaaatatattgttttatattgtccattagtggtttttgatagtgtgaagattatggtgttggcgttacaaatactaatattgcttccatggctccaataaagctgacaacaaatatattcttcatttatactagtagcctccattgttactacacatccaatgtctaatttcttaagatacaataatggcttctacaggatgagtggatatttcagatataaatatttttcttatgtatcttcagtacggataatctacaataaaaataatttcaatataattacatatactcagtaaagtagtggtaaatttgagtggagtgctgatctcctttatgtattatgttatatttcttcaatttgattagatctattataggttgtttgttcattttttaattgtataatatataggatgttaagaaacnnnnnnnnnnnnnnnnnnnnnnnnnnnnnnnnnnnnnnnntatagcgtgatttgcagtgactttaagtaggaaaaacatagggctatgtaaatcttatggaaccttggagatcagtgttgccagttttattattttgaactaattcatagatactatgaaaggtatttatatgatattaacgattagcccagggcttcccaaactgtgcgtcacgacgccccttgaggcgtgctgactttt

SEQ ID NO: 7174 - DNA, 189 bp, Diabrotica virgifera
  misc_feature (21)..(45): n is a, c, g, or t
  misc_feature (108)..(127): n is a, c, g, or t
  misc_feature (156)..(178): n is a, c, g, or t
aatcataaagatattggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgcnnnnnnnnnnnnnnnnnnnnnnnttatactatta

SEQ ID NO: 7175 - DNA, 163 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgggacccagggttggttt

SEQ ID NO: 7176 - DNA, 898 bp, Diabrotica virgifera
  misc_feature (22)..(40): n is a, c, g, or t
  misc_feature (633)..(661): n is a, c, g, or t
cgacagcggtgggactcaagannnnnnnnnnnnnnnnnnnagaattgtttatggtaagtacaagatcatctaaagttgagaaagaaatggatacatccggacctccagcatgatttttaaaaatggaagagttgaaacagaaacgtaggcaagaagagaaagaaaatgaagagaaacgtaggcaagaagagaaagaaaataaagggaaaagtaggcaagaagaggaagaaaatgaagagaaacgtaggcaagcagaaaaagaggaagataaaaagattcccattgagcccagtatgcctttatatttccactgtatttggatatttcctgccaaataggtcttactccatttttaatctacacatacaacaatcaagaagtcacgtacgagaatgttctggatgtcatggaataacccagaaatgtcataacaatacgttatctcgaaggttttcttttaaatgtctgcccagcgagtgactttcctaaggttggaaacacaaacaagccgttcagggtcaagtctggagaatacagtggacgagacagaagtttgtagcctcattcgaccagtttggccatggcgatggcagaggtgtgagccggtgcgttgtcatggtggaaggtcatttnnnnnnnnnnnnnnnnnnnnnnnnnnnnncaataatgtggcatagtaaagccctgtgaccatattctccttttccagaaagttgatatagatcactccttgttattctattgacggtccgagttttatgggcacaaataaatggggatgtttccaggtcttatggctttcccgtatttcattttctttaagttcatctatctcgtccatactgattgggtatactttcgtcttcatctattggatctattctgaactatctataat

SEQ ID NO: 7177 - DNA, 180 bp, Diabrotica virgifera
  misc_feature (4)..(153): n is a, c, g, or t
gggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattcactcgcggtgattacaaatc

SEQ ID NO: 7178 - DNA, 865 bp, Diabrotica virgifera
  misc_feature (519)..(551): n is a, c, g, or t
attattttggtcgagacatggttgacagataattttactgatcatgagctttgtttcaacaattatagtgttttcagagctgatagaaacttaaatactagttcaaagaatagaggtggtggagttttaattttagttaatagtaagtttaaatctacgcatcttaccactcactttattaatgttgaacatctgtttgtttctttgtcaagccataacgaaactgttattattggagctgtttacattccaccatcatcaaatcatgatatttatgtggatcattgctctgcagtagagtttattgttgaaaacaaccctaatagtagcttatatctttttggagactataatcttccacatgcaacttggaattattctactgaggatggtctttctgtctcttgccctgcagaatatcctgcattaacggtttgtgaaagtttttcatatttgaatttaaggcaggccaatgtagttgcaaatcagcatggagtattacttgacttatgtttttgnnnnnnnnnnnnnnnnnnnnnnnnnnnnnnnnncacagcggtggacactttattgtcaaacaattaccaccatgttgcactttcatgtgaattaactgttagtgatattaatcctttgtcttgcgatattctgtattatgattttaagaatgctgattatatagctttaaatgattattttgctccaattaattgggagcatttcttagctaatgatgatattaacattagcattgaaattttttatcagattctaaaattagcatttagatttgtttgtacctattagaagatacaaaccatctgtatatcctcgttgggtctcatctgaacttaaaaaagttgat

SEQ ID NO: 7179 - DNA, 465 bp, Diabrotica virgifera
attttagccgtggaaagaaatcgaagacgaataaatatgatcttaatatagtcgaaatctacgatggtgatcactctaaatatacgacatatgcccttgatggttgacaaaagaggctttaacaacaggtgaaaagtcatctcttcagcctgttgtaccttcttttcgtctcccttctttgaccaatctggattcttttctttgacttcttcttcgaagagcacgctaggagaacgtggaaaaattagggcgagtaataggaaagccggagacgtgatgtatggtagatggtccactaagaggagtgctgggataaaagggatgagtactggttttccgcccccctgtccacgataatagggaaacctaacgaaacgtggtcacgactgcagaggaagacagaaatacgcgtacgagaataggtggtaatgctcggagaagcgcaggtcaaccattagataggat

SEQ ID NO: 7180 - DNA, 1105 bp, Diabrotica virgifera
  misc_feature (953)..(981): n is a, c, g, or t
  misc_feature (1081)..(1103): n is a, c, g, or t
gttctatattttattgtaattaaacgacaaatcttgtttcaagcatccattttttctaataaaacgaaaaattgtcttattcaatattgggtgaaaataccatttccaacttttctgtaaatgaaaggtcgccttctgtttcttgcgcttacgcttttaacaaaagtaacagtttgaggaaactcttttggattggttgtctccaaataaacgtcgaaatatgaacacaaacgaacaatttgtaaagataatactgatggtgaaagtgcttctctgacactcacattcaataaccgctccatatctcttatttcatcgtcattttccgaatgatgcactccattataattaacacaaaccgaaatgataggtaaagtacttgggtagttacttttaatcacgataaatgcttccagagaggcacttcctctagatatctgaagagagtaaaataaatcggaaggtgccacaagttcctcttcaagaaatgttttggtaaattccaactgacaatacttttgatacgatattgcggtccatttggaaatagagcatgtaaagctgactggacagtccgcaggtttaggcattgtaggaatagtattttgctctagttgttgtaattgggtggctaactgatagcgagattccaatcttttaaatattattttcattataatttctacattagttctgcctaattcatccgaatccatttttttattaagaaaatctctttcgcatactctttgagcccaatggtatgcgtatccgatctgtggcactaacgattgaaaagaagtaagtccgatcttcttaatctgaaatttcgttattggatttggactttttaagccattatcatcttctacccactcccctcagaaggttctcccccggtaaacctttccctacttgagattgccagttaattttaaatgttgaggaagtcnnnnnnnnnnnnnnnnnnnnnnnnnnnnnaattttattaggaaaagaaaacttaaaaaaacaaccaaagggaccacccctttattttttgccccttattttaaatttggaaagggaaagggaattcttnnnnnnnnnnnnnnnnnnnnnnncc

SEQ ID NO: 7181 - DNA, 841 bp, Diabrotica virgifera
  misc_feature (26)..(51): n is a, c, g, or t
  misc_feature (231)..(251): n is a, c, g, or t
  misc_feature (542)..(576): n is a, c, g, or t
  misc_feature (781)..(798): n is a, c, g, or t
ggtataaaaaaatctttatgtcaccnnnnnnnnnnnnnnnnnnnnnnnnnntactttcctaaaattttaattgaaaattgcagattttttttggaaaactcggattttccgagtaaaatttttgttgaaggaaatcggaaaaaaataacattgtgcagaactaaaatgcggggaatttttatttgagtgtttttggtttaaaggaaaaatcttaggagttacagagcactnnnnnnnnnnnnnnnnnnnnnttgggagtgctaatttgtttgtaaataatataacacatttacttggtagtcagcgttggcctaagatagttgattaagtttcctggtagggcttcaccatgttcccggaggttatatcttgtaacatcggcgtttagcctgtttaatactacttttaaataatgtaaatcgaattataaattcaaccattgtttaatactacttttaaataatgtaaatcgaattataaattcaaccattgtttggttctggggctatttagcaagtattcaaattcactgatgatggacnnnnnnnnnnnnnnnnnnnnnnnnnnnnnnnnnnnttattcaatccattgggatttttaaaacttttaataaatataccaattacatagaagtagtttttacttcatgttagagttttttattataacacactttctgcggacttgtcataccccatattactatgcaatcttaagattcgatttttagcaataaaatagctggtaaataacttttcccaaaataacattttttcgatannnnnnnnnnnnnnnnnnacaaaggttgtggtggttgcatagccaataaaatctaataaac

SEQ ID NO: 7182 - DNA, 481 bp, Diabrotica virgifera
  misc_feature (2)..(40): n is a, c, g, or t
  misc_feature (49)..(72): n is a, c, g, or t
  misc_feature (308)..(321): n is a, c, g, or t
  misc_feature (428)..(450): n is a, c, g, or t
tnnnnnnnnnnnnnnnnnnnnnnnnnnnnnnnnnnnnnnnttatttgtnnnnnnnnnnnnnnnnnnnnnnnntgctgaacgtgacactagggaagtggtatcacgacactacgtaggactatgtggaataggaggaatcctctcatgtggtataactcacacaagctgtagtaccaccagaattagaaaaaggccgaatccgaggacagcatgataagtaaaagagtgtattgaatgggtttaaagtaagccatgaggaagagggaacgagaggaaaagctaaaggcaggggcccaaccttctgtgannnnnnnnnnnnnngtctgtgcaaattcggtctatagggaagatcttcaaaggaatgtatggcgagatgattggcaaggaaaatgcctacctctacagaagttggttgaacttatcagatnnnnnnnnnnnnnnnnnnnnnnnatgatattgccttaactactatggaagctgc

SEQ ID NO: 7183 - DNA, 769 bp, Diabrotica virgifera
aagactgaatttttatacacattaagaaagaaaaacaatagtagagggacgaagttagcccccctttttttaattcacaggttcttgcaaaataattttccaatatttacaattatttttgtcattttttgtattaggttagtagtgtaaatcttcttctttcataaactgtccgaagtattgctgttgcttcatagttttctgacttatagtgttgcaaagaaataatttgggataaacagattgaatagcttttgaattatttgaccggttgctttgaaatttacggtatgatttgggcaccggaagtctcagcattatttgttatctaagttaatttttacataagttatgaatatttgtaggagctcaaactgtatgatttattttgcaattttctaggcaaccaatagggttggatatattcagcgaacgccatattgaagttttttatacgatttgtgagtttcttactctcaaattggtttaaaatgcctaacttcttggaagtagacgaaaaaagcgaaaatttgccgtttttgtctttatttgtttgtgactatgtatatcatcaaaattcgctgtaaaggaaacatataggttactctcaaattactgcaggaaacatataggttattaatatggatgtctatactactcagagaatttggtttcggcctggagggggttgtgtcacgaacaggatatttttttccttacttctctgaactagtaagcgtaatgatctaaacgtactcagaatcaaaaa

SEQ ID NO: 7184 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7185 - DNA, 996 bp, Diabrotica virgifera
  misc_feature (92)..(104): n is a, c, g, or t
  misc_feature (106)..(120): n is a, c, g, or t
  misc_feature (148)..(178): n is a, c, g, or t
  misc_feature (224)..(238): n is a, c, g, or t
  misc_feature (240)..(262): n is a, c, g, or t
  misc_feature (264)..(277): n is a, c, g, or t
  misc_feature (291)..(336): n is a, c, g, or t
  misc_feature (338)..(372): n is a, c, g, or t
  misc_feature (374)..(386): n is a, c, g, or t
  misc_feature (403)..(417): n is a, c, g, or t
  misc_feature (419)..(529): n is a, c, g, or t
  misc_feature (531)..(545): n is a, c, g, or t
  misc_feature (588)..(616): n is a, c, g, or t
  misc_feature (639)..(701): n is a, c, g, or t
  misc_feature (703)..(740): n is a, c, g, or t
  misc_feature (782)..(823): n is a, c, g, or t
  misc_feature (844)..(861): n is a, c, g, or t
  misc_feature (863)..(898): n is a, c, g, or t
  misc_feature (909)..(926): n is a, c, g, or t
  misc_feature (940)..(974): n is a, c, g, or t
atttcttttccaataatacactattttttagtaatagtacccaagaactttatttaatgatacttaactactattgtgagacaataccttcnnnnnnnnnnnnncnnnnnnnnnnnnnnnaccctgggtatcagggattattacttcnnnnnnnnnnnnnnnnnnnnnnnnnnnnnnncagacctcacacattacaccttttattgtcaaatacatattttacnnnnnnnnnnnnnnncnnnnnnnnnnnnnnnnnnnnnnncnnnnnnnnnnnnnncacatcaattcccnnnnnnnnnnnnnnnnnnnnnnnnnnnnnnnnnnnnnnnnnnnnnncnnnnnnnnnnnnnnnnnnnnnnnnnnnnnnnnnnncnnnnnnnnnnnnnttaatttttacataacnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncactgtatattcagtacaaatatatcggtctaataacggaacnnnnnnnnnnnnnnnnnnnnnnnnnnnnncaaacatgtcttcttgcattacnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnccggttggatgaaccaacaactgtctttatctaatttatacnnnnnnnnnnnnnnnnnnnnnnnnnnnnnnnnnnnnnnnnnnccaaaagacccctatagaggnnnnnnnnnnnnnnnnnncnnnnnnnnnnnnnnnnnnnnnnnnnnnnnnnnnnnncatttaatctnnnnnnnnnnnnnnnnnncttaacctttttcnnnnnnnnnnnnnnnnnnnnnnnnnnnnnnnnnnncccattttgttggataataagg

SEQ ID NO: 7186 - DNA, 493 bp, Diabrotica virgifera
cataaatattgaaattggagcagagaaacgagattaaaaaagtatttttgaaataagttattaggtgctagctattttatacagctcttctttaattagttgtgaagtttctttgataaatatgcagaatccaaatgaagatactgaatggaatgatgtcctacgagctaagggtattatcccccaaaaagaaaaagagattactgaagatcagattgtgtctatgttagaagaaaccatagaaaagaaaactgcaaatggaaaaaatttgtctgaactagacctggatgaattagatgaactggaagactcagaggatgaagctgttttgctcgaatacagaaactagaggatagaagagttaagagccttatctgagcgccagaagtttggttttggtggagaaatatgtgcccaggactaccatcactgaagtggataaagcaggaagagggaatatgaggaatttttggtttagtcactccaaggataa

SEQ ID NO: 7187 - DNA, 749 bp, Diabrotica virgifera
  misc_feature (643)..(662): n is a, c, g, or t
  misc_feature (704)..(731): n is a, c, g, or t
ataattttcttccaaggagatcagttgaaaattatagtgaagaaaatctgcgaaggattcagggctactctctacccttgcccagacgcccctgccgatcgcacagagatggctatgggtgtcgtgacgagaattgaagatctcaatacggttttgggccgaactcaggaccatcgccacagagatcttgtagccgctgctaagaatattaaaaattgggtcgttaaagtcagaaaaataaaggccatctaccacacgctcaaacctatttaatttggatggtactcccaaaacgcttgattgcagacagttgggtggcagggactccaatctggaagaatattccaaatgggttttgaggggagggaactggaacagaaaggaaaatccaagcctccccattctaaacccaaagggaaaaagggccgaagaaccccccccccctcctccctcttacaaacaaaaataaccaaaagggtcgcaaaacccttaaaaaaaacaaaaggaattgccttccttttttggaaaatagatataaaaaaccccggggaccgagggaaacactttcccacccttttttttctcttggagggtccgtgggtttttggtccctttggtttttttattggggggggggcgtgtnnnnnnnnnnnnnnnnnnnncggccacaaacacacaccccccgggggcgcggggcccgcacnnnnnnnnnnnnnnnnnnnnnnnnnnnnttctctcgccccggccgg

SEQ ID NO: 7188 - DNA, 130 bp, Diabrotica virgifera
gtaccgtggttggtgttgctcatctcaatatctgtagagattgttgggtttgcataccataggattcagaccatatgtcgatgatattggcgcctctcttagttgtacgcactaggcgaccggagcatag

SEQ ID NO: 7189 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7190 - DNA, 1027 bp, Diabrotica virgifera
  misc_feature (216)..(233): n is a, c, g, or t
  misc_feature (357)..(407): n is a, c, g, or t
  misc_feature (952)..(972): n is a, c, g, or t
ggagaagaagaatatcatggttaaagaacccgaggaaatggttctccacaacaacaactaatctatttaaagcatcagttaataaaataattatagccagaatgatcgccaatattctaaacgaataggcactaataaaagaagaagtattgcatcgtctgcatagcagattattttaagttgtttttctcccatttggtatccttttttagttcnnnnnnnnnnnnnnnnnncgcccatgatcaggttgaacaataaaggactcaaggaatccccctgttttatcccattgccggcttcaattgggtcagttagttcatcttccacttttacttttattgtgttgttctggtagannnnnnnnnnnnnnnnnnnnnnnnnnnnnnnnnnnnnnnnnnnnnnnnnnnaattgataacgtcctttaatgtgaccctgtcaaatgctttcttaaggtccacgaaacataaatatgccggtttgttgtattccaacgatttctcttgaacttatctcattataaatatagcgtcagtgcatgaccttcccgacctaaaaccttgttgttcttctgctaacggtatatatgtatgctagaatattccacagggtgttccgaactttgggaggaaaatacattatgattgttacacccggtatagagtggcatttgcctgtctggcaacaatgttgttacatcgattttcttgaatagcggggctataacatgctaaaaaaatcgctcaaatcggacaacaggtttggggaaattcgagacttccggcgtgtacaattcagcgagtgagtcgattgttttgctctcaagtgtagttgccagttattttgtgacatctcgtatagtaaaatcgttatctatagcattgtgcttcgctgtaatgttctatttaaatgggtagaaaccgtgccttgaaaattgattgtttgaaatccaannnnnnnnnnnnnnnnnnnnncggccttcatttttataaaacgtttccaaactaataaaaaatactgcccctttcc

SEQ ID NO: 7191 - DNA, 928 bp, Diabrotica virgifera
gtgacaagaaaagtgctaagtgctccttttattggttttcaagacaaaatctcgtaaaatgaagatcttagcagcccttgtcttattatgcacactaaactatcacagcagtttggctagcgatgacggatttaaaggcattatttccccaacaaaccaaaaaatgtatggacaagccttagaagccatctttactatgggctttaggcttcaagatattctaaatatgtcaacagaacaaaatttagttgtttcacctctcagcactgcagccatcattggacagttaatgataggagccgatggtgaatttagagaagaacttcacgaactccttggtctacctccttctttagcttcatttaacgtaacccattttagtaaagaaagaaacgaaagtcaaatcctaccttacgctactttccacttgcaattagcgattttaataaaaaatctgagacaaagaaagccaggtgaagaatttgtcttaaatgtggcaaatgcaatgttttacaactcagatattgatttaagaactgtatttactagtagcctcaataaaatgtacgatacggatattaccccattggatttttcaaaagacacgactcgaataattaaccaatgggcagcggaccgcaccaacggcttaatcaaatcctttttaacgtctccacctcccaggaatactgcttccatgtttcttaattccatctacttttacgctgattgggaaacaccgttttccgactcattgaatcacatggatacgtttacagtgagtcccacacacaacgtcagcgttctctacatggttggcaaaatgaaagacgtaccatacatcgaaacgaaaaatacaagctggtttgtttaccttacaaaaatagagaacttggaatggatgttttccttcccagaatacatcatg

SEQ ID NO: 7192 - DNA, 888 bp, Diabrotica virgifera
  misc_feature (18)..(35): n is a, c, g, or t
  misc_feature (226)..(299): n is a, c, g, or t
  misc_feature (304)..(369): n is a, c, g, or t
  misc_feature (388)..(422): n is a, c, g, or t
gatctatttttactaagnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcggnnnnnnnnnnnnnnnnnnnnnnnnnnnnnnnnnnnggatctcgcctgcccagtgagtaatttgtatgaccgtggtaattggaccgatggaagtgtctcgaaggccgaagctggtgttctccacacggaaccattatacgaaggtaaaaaactttccaacgccatccttggtttggagtttggtgcggcgtgactagaccggctaatctccttgaaggattattactggaaagaggttacccatttaccaccgccgttgatagggaatttgtccgtgatatcagacaaaaaccctgctatgtagccctctacttcgaagaggaaatggccgccgctgccgcttccacctcccctcgaaaagaggtactaattgcctgatgggaaaggactcccctattggtagcgaaaagattccgatggcctgaaggccctcatccaacccctcctttctcgggaatcgtaatcttggagcaaatcctacaaaacccgtataacaacccca

SEQ ID NO: 7193 - DNA, 199 bp, Diabrotica virgifera
  misc_feature (7)..(30): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnntcgataatatagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnngaaagg

SEQ ID NO: 7194 - DNA, 1233 bp, Diabrotica virgifera
  misc_feature (217)..(232): n is a, c, g, or t
aagacaaccttatgcgatgatcacttatactgtgtctcggtctcaccgacactgtccaaaagagtgcctttctgagggatacctagcgcagagtaataacatgagaaggccttacactacacccaagaacaaaatcctttggaataagctgaagatcaatggaaacaattgtgcctggttgtaccacctacatatgaaaccatgagcgaggactagnnnnnnnnnnnnnnnnaccatacgaacgacctacggataaacaatcctcctagaaaactatgcacagacaagtactcctgtaaccaacttgtgtggcagaagattatgatagaagattccttatattcttggacaatagaaataagaggtggctgcgctcgagggaaccacgattgctgccgaataactgcgacaccctatgtcttatatagtgccatcgaaagtgctctcatggggacattgcactcattctcattgactgtacaaaaccctggagatccctgctaaatcccctcgtggagaatgccccctgttcaccatgtgtggatgttaccaaataagtccgcaccatatcacctgcccaacatctgcacaaaccgaatgcatgatgagacgaggcctgcatcggcatcatacccgcgatgggacgagctggtgtaactgcaacagaatcatctactctacattggccgatatactccactactctcccatacaactgaatactcactcggcaaaagatccattataacggcggctgggataacgctttccatagatattcaaggggaatggacgccggaatatattaaattttccctgcgatgatcaagaaattgggacaattacccccccgtctggaggcttctgggaaaaccgtggacttcgtccatctgggatgccaaccccttggctgggaggactacaaaggtctccttaagacaaaaaatccaatcttaaaatttatttgggtaattggagggggcttttttccaagcatgaaatttcagaaataaaacataatacaaaaccccgcgaaaaacaaccgccccctttccgcccgggaatttaacccatttctgggcagagggaaccccataagggggaaaccaaaccggggaaaatagcccccccctctggacacactccctctttacaggggtttatacacaagaaaacaggggcggggggcgtttgtttaataattaatccccccaaaacacaaaagttattttt

SEQ ID NO: 7195 - DNA, 677 bp, Diabrotica virgifera
  misc_feature (264)..(294): n is a, c, g, or t
  misc_feature (515)..(545): n is a, c, g, or t
gtcatttttcaatgagagtggccagttttcggccacgagtggctcaagaagtgtttgagttctcaaaaaaattatacaacggtttttgcttagaattgggttctctggctacttctgtggttgttttaagggggggggggggtatgtatagttaattctgcgttttttttgcataattttaaaacgttttcccttgaaagtggtgaggttaaattaaataggtaaaaggatatcttaaagaacaacacttgaagatgattcagnnnnnnnnnnnnnnnnnnnnnnnnnnnnnnnaagcagtggcgtcatttttaagtagacgatccaaaaaagaagatgatttgcggtgtacactatatattcggacagaatcatttgaaacatataaaccaaaaagattattttagtttaatagtttcttgagggagtgacgtcgaggttttatgattatattgatttttaaattaaataggtagaaggatatcttaaagaacaacacttgaagatgattcagnnnnnnnnnnnnnnnnnnnnnnnnnnnnnnnaagcagtggcgtcatttttaaatatacgatcccaaaaagaagatgatttgcggtgtacactatatatttcggacagaatcattttgaaacatataaaccaaaaagattattttagtttaagaatttctttga

SEQ ID NO: 7196 - DNA, 60 bp, Diabrotica virgifera
catcatccttgatctatagacactgacgaataccatgatgttgttaatataacggaccac

SEQ ID NO: 7197 - DNA, 865 bp, Diabrotica virgifera
  misc_feature (429)..(454): n is a, c, g, or t
  misc_feature (686)..(717): n is a, c, g, or t
  misc_feature (813)..(833): n is a, c, g, or t
acgactagtaaaaggttgctgctgcatccccccaaatgagcaccaggctgggggcaaactgtacctcctgtaggtccagatgtagcgacggaaatggagctggaacgctcgagaaagcttgttcccccagtgaccaaactgtaaagtgacttgactgtgactgtgggtggaatcggctccttccaggtggtcgaaggattcatggtagggtttaatatttctcccaaatggctaaaaacaaacatttcccagtcttagtttcaatttccaatcgaacatgtgtgactaaaaaaagcaaaagaagtactgaagaagaggtttttataatgaacagcaataaaaaacatccattatcaaggcttatcaaatgtgaaaaggtacgagtgtgaccttgaggcggaatttaaatacaaaatatgatatttagannnnnnnnnnnnnnnnnnnnnnnnnnggatgttcaatcagcttaatacctacagagaaaagataattatttcccatattaattgagaattgcatatgtttggttatgtctaaccaaaaaaatctattaatatataattttccttgaatgggtaaaaaaaaagatctaaataatctacataaactttccctaatagggtgcctaagggaatttaacaatggaacaaatattttacatttttccttaaaaaactccaccnnnnnnnnnnnnnnnnnnnnnnnnnnnnnnnncccgggcgatttttatcccgatcccattgacggggattccatccctcttccaaaacaaaaaggggaggcgggctgttctccttttataactggaannnnnnnnnnnnnnnnnnnnngggttcaactttttattatataaccccgccct

SEQ ID NO: 7198 - DNA, 812 bp, Diabrotica virgifera
attttgaagaattttagcggtaatagtgtaataaggctattaagtaatgatgctaaaggggaaaccactgctttgtataattttcacgtggaaaatggtggtaaaatagttaattttggaggatttatgcttcctgtgcagtataataatctcagtattgttaattcgcatttatttacgaggagcaatgcttcattgtttgatgtatcacatatgttacagactgaaataaggggagcaaaatgcgtagaattttttgaaacaacatgtacagcagatttacaaggcctaaagaaaaatacaggtagtcttactgtttttacgaatgaaaaaggaggtatcctggatgatcttatcgtcaccaaaatagatgaggaccatctatatgtcgtatcaaatgcagctcgcaaacaacacgatcaacaacttatgttaagagccttagatgcttataaaaagaacaattctgccgcagatataaacataaaattttatgaaccaagtgggagaagcttgctggcccttcaaggtccaaaggcagcagaaagcctgcagaacttgacagaagtgaagctttcggaattatattttatgaatacaacaactggatccgtggctggagttagcgactgcagaataactcggtgtggttatacaggagaaaatggatttgaaatttccatacctgcttctgaaactgtcaaagtggctaaaaccctattagaaaatattaatgtgaagttggctggtcttggtgctagagattctttaaagatttagaaagctggttttatgcttgattggcaatgata

SEQ ID NO: 7199 - DNA, 198 bp, Diabrotica virgifera
  misc_feature (7)..(44): n is a, c, g, or t
  misc_feature (109)..(130): n is a, c, g, or t
  misc_feature (159)..(189): n is a, c, g, or t
taacagnnnnnnnnnnnnnnnnnnnnnnnnnnnnnnnnnnnnnntgcgacctcgatgttggattaagtttataattggtgtagcagctatattataaagtctgttcgannnnnnnnnnnnnnnnnnnnnnagtttaaacggtgtgagcccaggtggttnnnnnnnnnnnnnnnnnnnnnnnnnnnnnnngaaaagaac

SEQ ID NO: 7200 - DNA, 939 bp, Diabrotica virgifera
  misc_feature (121)..(142): n is a, c, g, or t
  misc_feature (282)..(330): n is a, c, g, or t
  misc_feature (493)..(511): n is a, c, g, or t
  misc_feature (717)..(717): n is a, c, g, or t
  misc_feature (728)..(728): n is a, c, g, or t
  misc_feature (893)..(893): n is a, c, g, or t
  misc_feature (906)..(906): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcatanattattcctanagtaccaaaagcttctttttttcttctctcttgcctaaacatatgagaaattaatcccaatcctggtaaaattaaaatatatacttcaggatgacccaaaaaatcaaataaatgttgatagagaattggatcccctcaccagctggatcaaaaaatgatgtattntaatttcgatctngtaataatattgtaatagctccagctaaaactg

SEQ ID NO: 7201 - DNA, 72 bp, Diabrotica virgifera
  misc_feature (25)..(25): n is a, c, g, or t
taacagcgtaattttattggagagntcaaatcgataataaagattgcgacctcgatgttggattaagtttat

SEQ ID NO: 7202 - DNA, 334 bp, Diabrotica virgifera
  misc_feature (3)..(33): n is a, c, g, or t
  misc_feature (39)..(112): n is a, c, g, or t
  misc_feature (142)..(179): n is a, c, g, or t
  misc_feature (199)..(212): n is a, c, g, or t
  misc_feature (215)..(237): n is a, c, g, or t
  misc_feature (245)..(267): n is a, c, g, or t
  misc_feature (297)..(328): n is a, c, g, or t
ccnnnnnnnnnnnnnnnnnnnnnnnnnnnnnnncgtttnnnnnnnnnnnnnnnnnnnnnnnnnnnnnnnnnnnnnnnnnnnnnnnnnnnnnnnnnnnnnnnnnnnnnnnnnnttaagaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7203 - DNA, 581 bp, Diabrotica virgifera
  misc_feature (2)..(66): n is a, c, g, or t
  misc_feature (70)..(237): n is a, c, g, or t
  misc_feature (240)..(321): n is a, c, g, or t
  misc_feature (465)..(486): n is a, c, g, or t
  misc_feature (529)..(569): n is a, c, g, or t
gnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnngaaaaaattacccttagggataacagcggaattttttttggagaggtccaaatcataataaagatttgcgacctccaatgtgtggattaaaagtttaaaaattgggggaaagcagcttaaatttattaaaggcttggttcgaannnnnnnnnnnnnnnnnnnnnngatattggagttttaaacccggggggggggccaggggtggggnnnnnnnnnnnnnnnnnnnnnnnnnnnnnnnnnnnnnnnnnccaaaaagggcc

SEQ ID NO: 7204 - DNA, 549 bp, Diabrotica virgifera
  misc_feature (522)..(548): n is a, c, g, or t
gactacccaggtcggtctaggtcaaacacattgtgttggtattggtggggatcctttcaatggaaccgatttcatcgattgtttagaagtattcctgaaagatccagaaaccaaaggaataatactcattggtgaaattggaggtgttgctgaagaacaggctgctgattatctgataaagcacaactctggttcaaatgctaaaccagttgtgtcctttattgctggtctgtctgcgccacctggacgtcgtatgggtcacgcaggtgctatcatttctggaggaaaaggaggtgctcaagacaaaatcaacgcattggaaaaggcaggcgtaatagttacgaaatctcctgcacagatgggcaacgaattgttgaaggaaatgcgtcgtttgggattagcctaagtatgtttgactgtatgatataaggctccttattgttcggttaattattaactgcatagcctctattcgttatttttctcacctgttcttattgtgtatattccaaaattcacgtnnnnnnnnnnnnnnnnnnnnnnnnnnnt

SEQ ID NO: 7205 - DNA, 189 bp, Diabrotica virgifera
gtatgactgcaatctcaagcctgtacgacactctactgacgcccaatggattttcttaaggggcagtcctccgccgaatagagctattttcgctgattgacggtattttgtatctcttgtgacctaggagttccaatgtttgaaacgtcgaatcatgacagtcacatcattaataaaacccaagaactt

SEQ ID NO: 7206 - DNA, 285 bp, Diabrotica virgifera
  misc_feature (30)..(45): n is a, c, g, or t
  misc_feature (65)..(65): n is a, c, g, or t
  misc_feature (216)..(244): n is a, c, g, or t
gaatggttgaataacattagatatgcagannnnnnnnnnnnnnnnttattaatactcctttcgcntaaccgtctaaagcttccttaaatacaattccatatgtaactatttatgagaattgaagaaagaatatatgacattgttgaactcgacggtgttgaccatcgactaaagtgaagccggacaaatagaatcagctataggtccattgaatannnnnnnnnnnnnnnnnnnnnnnnnnnnncaacaaaagagaagaaatctagatacttttcacgatctgct

SEQ ID NO: 7207 - DNA, 864 bp, Diabrotica virgifera
  misc_feature (58)..(828): n is a, c, g, or t
gacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagattccaaaaccccaactcccacaaaaagaa

SEQ ID NO: 7208 - DNA, 772 bp, Diabrotica virgifera
gtgtttagatcctgcaatatgttattttgcttttggatggctcgttgttattacttgcccccatcactgttatacacattaatggagtcgtactccacgatgttctgccttcatccctatttttgaatgtcagtctcttgaacttacttgctgattctatattatatatattgaaccttctgactgaagctgcaccttttgacttccacaatcaattattacttatataccttattattgaagcatacctctgaggatgtgtttataacccgatagcgctcaactaggaattatttactatacccacttcaaaagtacgcttctctctatttacctgtgattcataagtgtgtacaaaactatttcagtgctttacatttatatatatcgtttcctgttactccgaacagcagcatatggcatccaccaagcttctccattggactctatctctggccatatctgctacctcttccccgctctttctcatacctttgtaaccagcttcaattgttcttttccaggaccatgcgcatcggccttgctttcttcatctctgctactgtacattatacagctttctttgatatgcgtcattctatattgccatacctatatactatattcctagttatttgtgttaatttattctctatttttactattttattgtatatcttgattgatttttaattttttatacgacatatatgcttacatgcaacaatatcttgacactatagctaatacaacgcctattatctatatactt

SEQ ID NO: 7209 - DNA, 1103 bp, Diabrotica virgifera
  misc_feature (339)..(358): n is a, c, g, or t
  misc_feature (563)..(582): n is a, c, g, or t
  misc_feature (963)..(984): n is a, c, g, or t
  misc_feature (1007)..(1021): n is a, c, g, or t
  misc_feature (1023)..(1069): n is a, c, g, or t
gctctttccatctctcgctatcttgtgcggatggcatccagatactcataaccagttgacattgctttgtgtaatccacagtgctttaaagtttaggtgtacctggcacaaatttatacgagaaacagtgccttatcaaaaggagacaaaatttatggttgatcgacgcattgcttcgaacctttatgctgagtcagccgtggttctttttgtgttctttggtgacattctaattttttgaggttaagatttaactgggtagaatcccagtaaggatgtctcattggcattgtagatatcatgggaagtatttgtgtagccagataggcgttatactcnnnnnnnnnnnnnnnnnnnngaaactgataagccacgttatatttctgaacaaaaaccaaatatatcatcgttatttctagaatcgtgtgttaagctttcctaattctacaccagtcgtctatttcgtgataattttgaaccaaaatttttaaattttagtcatgattttcttttagtctgatatattgtaaatatacagaaccataaacaactacagtttcacnnnnnnnnnnnnnnnnnnnnctaccttttagtctttgttccttattttttcgtttagttgtcattgggatgatgaatatgaaggcacagcagaaacaaaaatcgcaaattgatccaaacttcgaatgatagcagactgataaaattttagcatgaagtactgtccaaatattcccaaaaatacggataataagaaaacaagcagtatgagaaacacaactgttttattttgttttaaatctttttgcattgttttatatagaccctggcgttaatttgtccgaaacaattttactccattttatactttttactacgcttgctaaaagtataaaattaccgttgttttatgtctatttggtatggtatttgggacaaacacttggtagggcccccaatttnnnnnnnnnnnnnnnnnnnnnnccccaaccaattcaaccatcccnnnnnnnnnnnnnnncnnnnnnnnnnnnnnnnnnnnnnnnnnnnnnnnnnnnnnnnnnnnnnnccattccccctcgggaaaaaaatctctaaaattt

SEQ ID NO: 7210 - DNA, 970 bp, Diabrotica virgifera
  misc_feature (874)..(906): n is a, c, g, or t
  misc_feature (908)..(926): n is a, c, g, or t
cattaaagtagaaaaactttaaatttattcttcataatcattatcgtccagttctcgtcttattattttcactgtactaatatccgtcgactaatttacaatgattaatgcaatgttaaaacatctaatcgttagcggtttctggagtgtcttagacatatctaatgtcattgataaaatgcgcagtcccaccgatttccacttgcaccatacctcttttatacccgtcccatatagtaatgtaagcatgaccgtttttggatttttatttggttgttgggaaggactttgagccatccataagtatatttatttagtaggtcttcttcttcttcctctttataagcaattctgcttgttcattggcggattgatacctctatggaaggttgtcactccatcatttgcgcggtcggccgatacttctaccgattgatgatttatctcttgctattttgaccacacgtgtccccccattctggttatgtggttgttccattccctttttctatttagtgtccattcgtttatatactgtacgttacattgccttctgatatcttcacccctctttcgatctctcagtgtatttcctgtaattcttctcagtactctcatctccgctgtttccagtagcctttgtgttgtggctgtatcgggtcttgtttctgatgcatatgtcattattggtcttacacttacatttagtaggtcagtggtatggttcttttcatgagcatttttcagtgcgtcacagtttttcggtttctctctaacgcattaaattgtatatgacagaaaaaaacgcacgtcgctgattacatttcgtcggtgacatttataacatttaatctagttgtcaatagatggcgcnnnnnnnnnnnnnnnnnnnnnnnnnnnnnnnnncnnnnnnnnnnnnnnnnnnntgtacaatttataagactatacaaatcaagaaaatacattttat

SEQ ID NO: 7211 - DNA, 279 bp, Diabrotica virgifera
aatgaggcggcgcgtaccagcttctccctcctcgtgacttctgctgtaccgaccctgtcgccccccttctaaatgtttggctgtcaccaactggagaagcgtgtagattcacacatctgccagatgtacgtattttgtttagtaagtatctgaatatctcttaccaccgagttttctttgaaaatatcacttttctgaatcagggatatgccagccttgtggaatgaccaactagggagttatatatttttcgtaatagattcggccgcaagggagata

SEQ ID NO: 7212 - DNA, 198 bp, Diabrotica virgifera
caaaattatattattgtttgcatagggggaggtagtaaacaaatagtagaatgaattaatttggcgggggtaacaaaagccgccgatcagagtagagagggatccgaggctatgagggccctgcaataggtacagaaaaggtgacgaaacaataaatccgggtttgtaggtgatgctacaatgtctgccgaaaaagaa

SEQ ID NO: 7213 - DNA, 911 bp, Diabrotica virgifera
  misc_feature (756)..(778): n is a, c, g, or t
cctatagggaaagtggtacgcctgaggcaccggccgcggtattccgggcccacctcgcgcgcggagagagtgaaaatacaccattgtagtgaaatttattattcagtatacagatttataataagatcgattttttaccaaaatgacaagtatcaagactgtgggcaccattgtcctgaaattgctgaagataggagatccatttgatatagtactcatcttgtaccgaaccgagatatcaaagctacttcttgggagtaagaggaacctgcaatctaatccaagaaaaaaatcccgatcgcacaaatatgtaggcttccgggggtatatcggtaggatttatgatgtacacctatcgtctcgctgatcattctttgcttcgctagtgtagaacacaagactacattcactgatattctgatgaatatactagggatttttatgtgaatagctgctggagctacagctcttcattattgacttgtgcacttgcccgaatacaattacatcgacaatagattctgatcgaccaagctgcgatgagagtctgagcgatgtgtataataaatgcagcgctctatcttgtagacggagtactttccccaatctttatcctctcagccataatgcaataacttttcatcgcaatatagaatatagtttatttaggtaatatactttactctaagcacctcaagtatacccgggacattcccactcatacatcaatgtctataattagttcctgacaaatcnnnnnnnnnnnnnnnnnnnnnnncattcattcgttcaaacaccctttttttacattttttcaaggattatatccaatcttttttaaagaaatttggttggttattaaaccggattcaatccattatacttccggaaaaatacactattgcggtctt

SEQ ID NO: 7214 - DNA, 919 bp, Diabrotica virgifera
  misc_feature (429)..(443): n is a, c, g, or t
  misc_feature (742)..(742): n is a, c, g, or t
  misc_feature (792)..(815): n is a, c, g, or t
attaatttaagcgcaactaaatacgaaatcttgcccccagagcatcgaaaattttaatgtcaagtgagaccaatagacaaaacccgaggtgtgaacaaatgctataaatagcacacacaaaattgattcagctagcaataaaattaaaaaatactaacaagaaccggcgaaagccaacaaaaaagaattaacaaaccccaaaaaacccgggcacaaaaagcccaaacactctggcaccaaggccccgaactgtacgtagcccggagcggagacttgaggcccgagcaagcaattcagattcgcggataagtcacaagaatatagcaggaataaagcgcctcacgctagattgcattgatcggttagggaaccatgttggagttcttgtacccgggacctccacatgaagagaatttggctgatattgtnnnnnnnnnnnnnnncagagtgctatagagggaaaggggtggtctggaacattcgagcgcggtggagtgattcctgttcttacccgaattaatacacctcgctccaatgcatagtaacacccgaacgtcattttaaggggtgtacaagtctctcaggctgggttaaattaaattgcttgctacgccgctttggtttgaggaagataacgcatactgtctttttataatgtctactgaagttgtagacgaaaatcattcaattactttttattgaaattttaacattatttttgaacttttctttatctgacgtnaatgataccactaaattgaaaatatggtggtatagtataagggtgatgtnnnnnnnnnnnnnnnnnnnnnnnnacatacatttatatgtagattatagtgttacgtgaatataccatgttatataataatatgtagggacgtatattttgtacatgtatggaatttttagtaaattg

SEQ ID NO: 7215 - DNA, 231 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (202)..(228): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggacnnnnnnnnnnnnnnnnnnnnnnnnnnngat

SEQ ID NO: 7216 - DNA, 1103 bp, Diabrotica virgifera
  misc_feature (32)..(70): n is a, c, g, or t
ccgggccgccccgcgcgcccggttagatcgcnnnnnnnnnnnnnnnnnnnnnnnnnnnnnnnnnnnnnnngttttcttttgtttttttctttgttgttgtcgggggtgttggcttgtttgttgttctgttgggttttttgtggtttcggtccgggggggggggcggaggcgcccgcacccggaccccgcggcacgcggcggcggggccggcggcggaggccggggcggcgggggcggacgcgggggagccgagggggcgcgcggagcgggggacgggcggcgcggcgcacggggggcgtggcgggggcggcgccccgggcgggggggggggcgcaggggggggcgggggcgggggggggcgcgcgcgcccggaggccggcgccgcaccgaagcgggggggggggagcgccgggcggcgccccgggcgggcgggcccggcgggccggcccgggcccggggggggcgggcccgggcccggcggcggcgcggcgggggggcgggcggcggggccgcccgggtgcaccccgtcgccgggcggggggggcggccggcgccggcgcggccggccggcccgcggcccggccgggcccgggggaggcccggggcgcccccgcgcccgccggcgccgggggcacgggcgcgggggggagcgggggacgggggcgcgcccgccgcgccgggccggcccggcggggggcggagcgccggccgccccgcgggggggcccaggcgggggcgggcccgcggggccgccccgcgggcggggggcgcgggggcgggcggcccccggcgcccgggggggccccgattcgcggggggggggcgcccacggggggcgcgcccgcgcgccgggggggggccgggggggccggcggcgggccggcgccccccccccgggcggggccgcgggggccaccccggggggcggggccgaggggggcgggcgggggggggcggggccccgggcccgccggggcggaaggggtcccccgccaccgccccccggccgccgcggggggcgcggcgggcgccccccggcggcgccccgccgcgggcggcccccgccccgcgccccggcggcgcgccggcccgggcggcggggg

SEQ ID NO: 7217 - DNA, 939 bp, Diabrotica virgifera
aaattattaaattaaacgttttgattttaaacaaacattatttagacacaaatgatcagtcactgtggatagaagtaaattaaattattatctttgattcaaataaacgtcataacaaaaatgattgattcaaataaagaaaatcaagacgatataaatacagtagaaaatcctacaaagaatgttgcagatacagaaaatataccagttactgaaagagctttaaaaattaataacttagtagaaatgtgcaaaagcaatgcaacttttttcgcaagagataacactgaaaacggtcaaagactctatctgtcttttcttgccatggtggatgttgtagacaggattcaaccaaagcttatttctatagaaagtcaagtacatttttttgattttgatgaaagtgttccgggaaatggatacagaagttttcttattgtgattgatggagctattcaaatggctgttgagtgttctgaaaaagtgttacagaaaagggatagtacgttttttcgtaaaagtactttaactaaggacgttgaatcttgttcacaccttttaaccagtttagatagttgtctaacacacttagggacaataatgtcatggagtgaaagaggcagtctttttgttaacgaggactgtccattaggtgacttattttcaaaatatggagagattaatcaacattgtttctatggaagaaatttgggatttcagtattgcgattcaatacggaatgtcttacaattcatagccttatcaatgactttgttttctgaagtatactacagccaaggatcattgattagcaaagcgaccagttcagtagtgtccacgacaaaatttataaccgatccgggacaaagagctagaagaatgtaaatatcgcccagaacgctgaagtggacttctgcaaagccttttggtttctatccg

SEQ ID NO: 7218 - DNA, 900 bp, Diabrotica virgifera
  misc_feature (737)..(760): n is a, c, g, or t
aagatggcagacaacacactttatgatattttaggtgtgcccagaaacgcaccagcaaacgacattaaaaagcaatataggaagctagcgaaagaatttcatccagacaaaaacccagctgccggcgacaaattcaaagaaattagctatgcctacgaagtcttgtcagatccaaaaaagaggtccctgtatgacagagtgggcctcaaaggtatgcaagagggtgctcacgatggatttggtggagacgatctactttcacacttattcggcggtggtttatttggaggattcggtggaggggggccgcggaggagactaagaggtgaagacacagtgcatcccctaaaagtatccctggaagacatgtataatggaaaaacattaaaactacagttaagtaagaacgtgatctgtaatacttgcagtggtaaaggtagtaaaagcggaaacaccgagaagtgcagcacttgtaatggttgtggattaaaagtaacgtatagacaagttgttccaggaatggcacaacaaactcaaacacgctgtccagactgtcatggtgaaggtgaaataatcaaggaaaaagatagatgctctagttgcaagggcaaaaaagtatgtaatgagactaaaatactagaggttcatgttgataaaggcatgaacctctagttgcaagggcaaaaaagtatgtaatgagactaaaatactagaggttcatgttgataaaggcatgnnnnnnnnnnnnnnnnnnnnnnnncagaggtgaaggcgaccaacagccagatgtagaacctggagatgtagtgattattttgcagcagaaaccacacgaaaagattcccaaagaaatggtgatgatctacatggtaaacataatatttcctttacagaagcact

SEQ ID NO: 7219 - DNA, 366 bp, Diabrotica virgifera
  misc_feature (107)..(135): n is a, c, g, or t
  misc_feature (308)..(340): n is a, c, g, or t
accctgggtgaaaaggaaaaagaatgcttgaagaatcaggttgggggggccccaaggggggtttaccttccaacctgggattctccaaaaagcgggaaagaatcccnnnnnnnnnnnnnnnnnnnnnnnnnnnnncgtttttccacatggaggaacccaccttttaaaagttctcgcgcttattgtgtggggcggggattttttcccccggattttggccccccggggcaaaaaaaaaaacctccgggtccgcccccccataacccaattttctccacaaaaaagagattgtgggtgttgaagatatnnnnnnnnnnnnnnnnnnnnnnnnnnnnnnnnncatttattgaggaggggggggtgttg

SEQ ID NO: 7220 - DNA, 859 bp, Diabrotica virgifera
  misc_feature (24)..(49): n is a, c, g, or t
ataaatacatcatataatgatacnnnnnnnnnnnnnnnnnnnnnnnnnncaacagtctttgaacggttacgaataaaattctatctctcgcttctttgcagcgaattggtttatggacattatttcagaccgttcttgtaaggcaatttttacttcattagcggtaacttcactgaagccttccctgtaatctttcctacaaactaaatgatgattggacctcctgattaaaccctccgccaaacatttcacagcctccagcatcattcgtgctgctccgttcataatcactccatctgaaatctcttcagatcgtaaaattattccacaatccaacgcagtttccctaacgaaatcgcaatgattcttgagagaactatccgatatatctatgtaagtcgtcggcaagcttgcatctgttcgtcgcgacgttgaaggagatgaattatctccttctgattcaatgtcaaccttgacatcaatgtccaacgacttaatattgatcgcaccggcttcaacctctgaaaaacaatcgttaataagtctaagatcctccgacgaatgtttgaagaacgcagcagaactaagcacaggcgaatacttatgggatcgggcgtacataaaaatggccctcgtactccattttcttaaactcggaaacctcgcagataatattttcttaatttctttagctcgattccactctgcattcaacattttaccaaaaggccacgtctcgaattcttcctttgagaaggctataaacggatacaaggtcttgaaactcgaattcgtccgtttttcgttccacaatgagaattttcttagcaaatatggtaacgcttcgcctatacttttg

SEQ ID NO: 7221 - DNA, 967 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (777)..(777): n is a, c, g, or t
  misc_feature (783)..(795): n is a, c, g, or t
  misc_feature (798)..(842): n is a, c, g, or t
  misc_feature (852)..(934): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttanaatatnnnnnnnnnnnnnccnnnnnnnnnnnnnnnnnnnnnnnnnnnnnnnnnnnnnnnnnnnnnctcatccccnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaaacgaataacattcattac

SEQ ID NO: 7222 - DNA, 764 bp, Diabrotica virgifera
caaagcttcacaagaggccgataatattctcattattcaagataagcgacttactgctcttcgaggaaagaaatatttacaagttgtcaaaaatagatatagtggagacttaggaataatgccattagatttcgataaagatagcttgagtttccaacaaaagaaaccgaaggagaaaaaagtggatctgatccaacctttaacacatcctgaaactgatgtttctataccaaagatttaaagcattttatcaacaagttttacacgattgttatcaatgtagtgtgtgtaattggattgtaaagcttacattatctctcaacttttaagttatgtccctaacactcattttttttattcagctaatgcatcaaaaactaatggccattggcatggtacagtgatttcgcaattagtgtaatgtgtgtcttattgcttagtaaagtcaacttcaatgtctttacaaagacaccctaattgtatccgaacgtctgcgatcccttcggtgagtaccgatcccacacggatagaaactattttcatttattaattgttaatgagtgaaaaatttcctacccagttgagattcgagctcacaacaattggatccaaaggctcccttaccactgagccacagaggaggtttttacaatttacgttatctacctcacgaaatttaaataaccttaaatttcccacgtaaccaccagctgtcaaaaccctaatcgtttctgtaaccttaatttcccgtgactacaactaaa

SEQ ID NO: 7223 - DNA, 364 bp, Diabrotica virgifera
  misc_feature (297)..(324): n is a, c, g, or t
  misc_feature (329)..(345): n is a, c, g, or t
  misc_feature (347)..(362): n is a, c, g, or t
ctcatttccaactgagataaagttagccggtctgggaattatacaaattatggcatcacaacagtggggacaggaggaaataaaaaatagtccaggacttattgaatatcttttggatagaaacatcgaggtaattaaagaatgcaaagaagtaaaatacgaaatcattaagctattgtctagcagtaccatttttgatgaatttactttaaaaaggctacagaaatatgtgaaagaagggcctttccatgtggaggctattacggaagttgcatttgaaagcaatgaataaatggnnnnnnnnnnnnnnnnnnnnnnnnnnnncagcnnnnnnnnnnnnnnnnngnnnnnnnnnnnnnnnngt

SEQ ID NO: 7224 - DNA, 999 bp, Diabrotica virgifera
  misc_feature (283)..(301): n is a, c, g, or t
caaagatgctgttaacatcatcatggatagtagacgttcttgctttctctgtaacattatcaacactgttgtacatatatttcaccagacattttagctactggaagaaacgcaatgtcttttaccgaaaaccaacgccattttttggtaattttaaagatgtagcaagcatgaaaacaaccattggagaatggttacgagacgaatataacaaagcagctaaacaaccctactttggaatttttgttttcgacgaaccgaaattagtgattaaatctccagnnnnnnnnnnnnnnnnnnngataaaagattttaacaatttctgtgatagaacattcgcaagtccagaacacaatgaagtagagtcgaacttcttatttatgatgcataatcctaaatggaagaaacataggactcagctttctccagcttttacctcaggaaaactgaaagcaatgcttcccattatacatgaagttggccagtctcttcaaaaatatttaagtgacaatcaaacagttttagaagcaaaagaagttatggccaaatatagcacagatgtaataggaaaatgttttttgggcattaatcctcattgcttcgataacgacgatgcattgttcagagttttaggaagggctatgtttgattttagtataaaaaaacgcattaaagcaaaactgcgtattttttctacacccggaattgttaagttctttaaaaattaatttctttcgagcaaatggggcacagatcatttttttgacgctttaataaatccctatgaaggacgggaaaaaatctaaaattaggaaaaatgattttccttcaatattcttccaaaacatggaacttaagggaggtattgctaaaggtattcgggtccattctcgggactcagcatgcaatttttcgcttgccggtttttgataaacacaattttcaacccctcttcctcacacttttctcaattattgcttgaacaaaaaaaatcgaaaa

SEQ ID NO: 7225 - DNA, 888 bp, Diabrotica virgifera
  misc_feature (689)..(689): n is a, c, g, or t
  misc_feature (794)..(795): n is a, c, g, or t
gagcttccaaagatgatctgtgagacctgtctgtataaattagaattatttactgattttcgagagcgttctgctcgcacggaaaaacttttaatagaactatacaaggagctctcgaattgtattcaaaacggtcaaacatgtctagtaccgattcacacaaacgaactgataatggtgcagcagcatctacaaaacgtttcagatatatctttaccctcactgtcgcaaaatcaagatattattatgacatcagacatgaactctcattccttggagaacattgtaactagtagtttaagtaacactgatttttctaatcaagcttttgatacgcaacaggagcctgttgtagattctagttcgggaagtaaatttgaagataatttaagtctgatacaacaacatcaattgttgactgaacaatttaggctacagcaagatttacaactagataatgccaatattcctctattaaatgatttaaaagactcatctaaccattcaactcatcgatttgattttcaagtgaaattagaagaacaaaatatctgcagattgcagtttgaaagtcataagctgtcgctaaaccaaataacatctaagtcagatttggaaacatacaaacaagaagatagttccagcaatagcaacagccttagttcctcgcatttagagaaaagactggngagagatcggtcaagaaaatccattgagccaaaaagacatgtttgatctgaactctgggagtagtgatccgattatgagtcttgaaatgaagagggatattattnngtatattgtggcaaaatttttgatcagagagatcaactagatctgcactacctagatcattatcataagtgcgtagtatgtaagactgttttt

SEQ ID NO: 7226 - DNA, 942 bp, Diabrotica virgifera
  misc_feature (224)..(242): n is a, c, g, or t
  misc_feature (599)..(622): n is a, c, g, or t
  misc_feature (918)..(935): n is a, c, g, or t
acttccctatggatgtctttgaatagagagaatattttgcaagcattattcttttccgtattccctcccctcgctgccgtcctcagttatcagtacgcccctgtatgtgagctgttttactacttcaatatttgcgtcgtctattgtgaaaacgattttccaaatattgttcccatatttgtctctttttgggggtcaattccacttgcagaagttcagtgcannnnnnnnnnnnnnnnnnngtgtaattctttgtatatatatgtagagttgtaaatattttaccttatacatatttttaagtctactgtatatattttttcttaattattattacaagcacgaaaaagggtctcacgcatacaaacacatatgccacatgtgcgaatcgtctggaatcggagtttaagataaacagtagccgtcttgactaattttattggttttcgtttattggaaaaagtctgtacatactttgatccaattttaataggttggttctcaggggaaaacggaaaagggagattagatgtaagagaatttgttttagcgtagggggtgcaagaagcagttgatttttagattcgaatgaaagaggnnnnnnnnnnnnnnnnnnnnnnnnacgcgaagtttaagacgtactaatatattgacaacccagtcatatattaagtagataaacgcgattatttcaaagacattttcttttgtgagaactcgtaaaattttagtcgcaattacacaaacacttttacatttcgtcaatttaatagtatctataatttagttatctattttattaataaaactgttaacatcacacggacttttaatacgattgtctttaactaacctacatatatttcacttgcaaatcttttaaaacggataaaagataaacgggaacccttgaaaaannnnnnnnnnnnnnnnnntttttcc

SEQ ID NO: 7227 - DNA, 1016 bp, Diabrotica virgifera
  misc_feature (123)..(146): n is a, c, g, or t
  misc_feature (225)..(360): n is a, c, g, or t
  misc_feature (377)..(407): n is a, c, g, or t
  misc_feature (439)..(473): n is a, c, g, or t
  misc_feature (490)..(523): n is a, c, g, or t
  misc_feature (526)..(541): n is a, c, g, or t
  misc_feature (544)..(560): n is a, c, g, or t
  misc_feature (622)..(664): n is a, c, g, or t
  misc_feature (695)..(749): n is a, c, g, or t
  misc_feature (761)..(784): n is a, c, g, or t
  misc_feature (809)..(825): n is a, c, g, or t
  misc_feature (828)..(846): n is a, c, g, or t
  misc_feature (861)..(907): n is a, c, g, or t
  misc_feature (981)..(999): n is a, c, g, or t
tgacaaacaaggtagaaaattcaatcaaggaaaaatctttaaatgatctacatctatttaataaatcttacaaaatgctgtactgatcatgtgaagcaagagaaataaatcccaatgttttgnnnnnnnnnnnnnnnnnnnnnnnngtaattgttttgatcgaagcttattctttgggctttactccctgagtttataagacacttaaataaatttaataacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggtggttgggggnnnnnnnnnnnnnnnnnnnnnnnnnnnnnnncccttgggggtttattttccaaaaggggcccnnnnnnnnnnnnnnnnnnnnnnnnnnnnnnnnnnncttccccccccttttgnnnnnnnnnnnnnnnnnnnnnnnnnnnnnnnnnnccnnnnnnnnnnnnnnnnccnnnnnnnnnnnnnnnnnggccggaaattcccccccccccggatttttccccattttgaaaaaggccaaaaaaacccccnnnnnnnnnnnnnnnnnnnnnnnnnnnnnnnnnnnnnnnnnnnccccccccaattaaccaatttttccaaaccnnnnnnnnnnnnnnnnnnnnnnnnnnnnnnnnnnnnnnnnnnnnnnnnnnnnnnncaaacccccccnnnnnnnnnnnnnnnnnnnnnnnnggttaaaggttaaaaataagggtgnnnnnnnnnnnnnnnnnccnnnnnnnnnnnnnnnnnnncttttaaaggggggnnnnnnnnnnnnnnnnnnnnnnnnnnnnnnnnnnnnnnnnnnnnnnntttggggttttttttgccacccaatgtttaccccaatttgggtttggtttttttccccccacccgccccctccnnnnnnnnnnnnnnnnnnncctacttcgacaatttt

SEQ ID NO: 7228 - DNA, 264 bp, Diabrotica virgifera
gatgtcgaggttgcgcatggtcagctggccgatgcggtcggcgggggtgaagggggcgttctcgaccttttccatcgacaggcgctcgggggcgtaggtcaggttgggcgattcggtgttgagcagcgagtagtcgttgccgcggcgcagttcgatggtgacttcgccggtgacggcgcgggcgacccagcgctgggcggtttcgcgcagcatgatggcttgcgggtcgaaccagcggccctggtacagcaggcgaccgagctt

SEQ ID NO: 7229 - DNA, 659 bp, Diabrotica virgifera
  misc_feature (3)..(25): n is a, c, g, or t
  misc_feature (27)..(39): n is a, c, g, or t
  misc_feature (315)..(332): n is a, c, g, or t
atnnnnnnnnnnnnnnnnnnnnnnncnnnnnnnnnnnnntacaatattacagactttacaatactaatcaaacggggacatcccaattatctaattaagaacagagttttaacaaaaaataggataaaaaaacgggattatgataatctactaaaaaaataaaggatggacgttataagcctacaaattaattcaaaaaaaatttatccgaaaaagcatcttccaatagttcaaacatgaaaaccaatctcaattagttcttgagggccaagtattttccttccatcgaaaaggtaggcgggcttcatcatatcnnnnnnnnnnnnnnnnnngccaaaagcaaaaaattcgccccattcggaacagacaaggatgggggggcactcgttggcaccctcataggcatccttgaacaaaaaaatagggttcttatacaattcggggccatcacaaatccccggttggcataattctttaataatttgtccctgggaaaccttggggtcataaattcgaagggatgccccttcgcctaacaaagttttgcctacgaaaatagctgggttttctctagaatcaggggtatttttcttaaaggcaaaaccaagcatgcagattttctttccgctcaaagaattaaaattaaattgtataatttg

SEQ ID NO: 7230 - DNA, 699 bp, Diabrotica virgifera
cgttaaagaaggaaaaatgagaaagaaataaatcttaagatgaaggaggcgatcgggtagccatagcacactgtagcacacgttgtcaccttcgctatcaatgagtaagactccatatccagtttgtcttgtgcccatcctgtaggaacatgttggcactacgatttcgttggtatgaaatttgctcgtttggaacctccacctccaatttatatttgaagctggtgtttccagcatcgactcgatatgagttctttcgccggtttctatatctccgacaaaatggacggccttgtggtcatgagcgctgataattaaactaggtttcaattctctaataactttctcggtaaaaaagctagaagcaccaagcaaggacatgtggctaatgataatagaaagatttatatcagactctgaaggttcatatttaggggaagttttcagcatgaaatttacctttgaaaatttaacattttcgaaaaacactacatcgggtttaagtccaaaatatttatcaaaacgattgagcttttggggagttacatcctcattttcccctcctatatcgttatctccaggtagatagattgtctgatttgcttggagggtatggatgcgaaaaatcttgttgaatctttgatagtaccgcacatattctgaaggggaggctatgctccccctagttctagatcgcga

SEQ ID NO: 7231 - DNA, 595 bp, Diabrotica virgifera
attcaaaaaatagaattcgaagtggctctgcaaacattaaagaggatgaggtagatctacagttaatgaaaattgatggaaaggtgcagaggaatagggatgacaaactctgccgtcacaatgccaactcccgctgtgttcattgctcaccactagaaccttatgatgaagcgtatttgaaagaacacaacattaaacatctgtcctttcactcatatttacgcaaaatgatgtctggagtggaccgtgggaagtttttagccctagaagacatctcttgtcgcatcaaagaaggctgcaaggatcatccaccatggcctagaggtatctgttctaagtgccagcctaacgctatcacactgaatatgcaggcttacaggcatgttgacaacgtggcttttgaaaacacaaatttagttgaaagacttttgaactattggagggttactggccaccaaagaattgcttttctttatggaaattagcgaagtgacaccctgatgttcccttaggaatatatagcctaccgttcgagtatatactgaactccacattaacttatgatagactcgatccatttccttccccatgacgt

SEQ ID NO: 7232 - DNA, 322 bp, Diabrotica virgifera
  misc_feature (283)..(308): n is a, c, g, or t
cccgccctttttcgtccgaaagaattcagccagcgataccgaaaagtgtcctcttgtttggttatggttacaagataagaagaaaggaaaacaagcaacagccaacgccaagaaagctatatttgaattttttggatttgacttcttgcggagagtattgcttactaccgatgaacctgtcgactgtccaccttcggtataccaaacagaagcattatctataataagtgtattgtgcaatgaaaaagaactgtctacccgacaagaaatgctcgagtctggnnnnnnnnnnnnnnnnnnnnnnnnnnagcggcacatgaga

SEQ ID NO: 7233 - DNA, 277 bp, Diabrotica virgifera
gaaggggggaaaatgctatgtctctgttacagtacatttcttgttgtccttctctcgttactatcgtctatgtactgttgcgtatttggtgctgttgaccttggttttcatgccggtgcggtaggagggagttgaagcggcggcgagcatgggccgggccggtggatttcgtgcctattttgttctattttctttaccacaagtgtgtattatgccacgtcgacgttctttgtatcctgttaacggcatcggggtgacaaacaggataccaacacac

SEQ ID NO: 7234 - DNA, 486 bp, Diabrotica virgifera
  misc_feature (4)..(4): n is a, c, g, or t
  misc_feature (13)..(13): n is a, c, g, or t
  misc_feature (21)..(21): n is a, c, g, or t
  misc_feature (23)..(180): n is a, c, g, or t
  misc_feature (183)..(183): n is a, c, g, or t
  misc_feature (359)..(376): n is a, c, g, or t
  misc_feature (419)..(468): n is a, c, g, or t
gtanaaagcttanattttttntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncanttttttttgattaataagaataaaattacccttaggggaataacagccgtaattttttatttggaaaaggtccaaattcgataaataaagaatgggggaccctcgatggtttgaaattaaaagttttataaattggggggaacccagctttaatttatttagtgctgggttcccannnnnnnnnnnnnnnnnncattgattctggagtttaaaaaccgggggggggggcccgggtnnnnnnnnnnnnnnnnnnnnnnnnnnnnnnnnnnnnnnnnnnnnnnnnnngcaaaagggggacccaac

SEQ ID NO: 7235 - DNA, 62 bp, Diabrotica virgifera
aaaggcttttcgggcccacccgcccctggggaggggaacccgggcccccgggaatccccccg

SEQ ID NO: 7236 - DNA, 919 bp, Diabrotica virgifera
  misc_feature (40)..(62): n is a, c, g, or t
  misc_feature (429)..(446): n is a, c, g, or t
  misc_feature (513)..(530): n is a, c, g, or t
  misc_feature (624)..(641): n is a, c, g, or t
ccctgtatactgctctgattctatgcagaggttactgagnnnnnnnnnnnnnnnnnnnnnnncgagctgaactattatgtagataaattgggttaatattattaatattgcacgcatttatatgggtttggtaggctacaataattgtacaaaatcgtaatataattctagtagctaaatattaatcaacactattcatggtcctggactttctctgttaacttttgacatattagtaacattcattctatgtgtagttttaatcataatataatttatagatttattcgctctgaatgttgatccatcacaatttggcaaaatttcatatacacaagtattcttagaaacaatttcaatcctcgatcaaatattttaataggagagtgaacagtggacccttaaacaacaaatacactaaacttcggnnnnnnnnnnnnnnnnnngtttgtacttcaacattttgtttgttggatatactaaacatgtaataggtgtaaatgatataagtannnnnnnnnnnnnnnnnngatgctcttgttacagagcgaaaacgttttgtttctatgtttgtagccttataggggctttttaaactaatataccttttaccaggacaaaacnnnnnnnnnnnnnnnnnncttgtagttaatgatattaagcgaaagttagtcttagctcaagatataattcttgaaagaatgctttttgtatctaattatagtaaaacacgttatatgtacctaccctcactcgtagtgccacttgttgtaaaaggtttattttgtatagaattgctgggtaaatgtgctggataagatcactttttgtaaactataatatcctttcatttcatgttaatcatatcatggtataatattttgaacatcattttattaccgtaattcctattgaacgt

SEQ ID NO: 7237 - DNA, 613 bp, Diabrotica virgifera
cttcccttgttcccaatccttctctgaaaccgaagtcatccaatcctttttctttattgggtctttttctggtttcaaaacttcagtttgctatggtgaccatggcggaattcatgatatctagattttgaccgatattttcttgttcagatctttctaactgttttttaatctcacgatttatcttattttcgacctcatctgctattacggcatttcttaggagtcgactattaggtttcttctgcgttgagggggcttttattctttttagttttagtttgaatccagcacagagcagattatggttagttgctgcgtctgcacttgggtatgtttttgcagatgtaatactgtttctaaaccttctattaatgataatgtagtcaatttcatttttgactatctttccctcttgatcagctggagattttcaggtatatagtcgtcttttaggttgctgaaacaaagtacttgctataatgcatttctcttcttggcaggactgtattatctttgccctctttccttcctttctccaagtccataactttccggatatatcttgtgcgatttcggcacccacttttcgcagttcgaagcactcctgcta

SEQ ID NO: 7238 - DNA, 782 bp, Diabrotica virgifera
  misc_feature (14)..(35): n is a, c, g, or t
  misc_feature (442)..(462): n is a, c, g, or t
gtacttatattacnnnnnnnnnnnnnnnnnnnnnngtcaagactctcgttcacaccttttgaattttatcttaaccttctggcttcacgttcagattctaggagggggaggatgtctccttctcttacgggtcccttaacgttcctgatgatctgacgggtgtgttccccccgaaattcgaacttttactggagtacattgtccccggaatccagctctccccaaaacttggagatacgcgctcgagaactatggtccaacccatgttgtctaggagaatgccgcaaccacttcaaacatatgtgagcaaccaaacctcctaggatacgaccacactcactaaacgaaagacattgaccattaatgaaaggaaaagtcgccactatagcaaacaagaaacaacgtaccgtcgagagtccggaaaatcaagtgggatttgatnnnnnnnnnnnnnnnnnnnnntacatatcttcactgcattgactgatcattggataggaaacatcgcgcaaaaacttttgaagggcgttcaaacgttgtaataaaaattctccgaaacaaacgctccttgtgcgttattggcggagagagatcaaaactcggctccattaccgtggaacagctctcatatgcttataaaaacgcttagagcctcttaacgattttgattcatcgatctgatgtgatcacattctcggattctggggcgtggacagttagtgagactcttaaactatatatcaaacgaacacaaaaaattcctgtttccaaaattcactatt

SEQ ID NO: 7239 - DNA, 890 bp, Diabrotica virgifera
  misc_feature (741)..(741): n is a, c, g, or t
  misc_feature (839)..(839): n is a, c, g, or t
gataaagtgaatttgttttttggctgtaaattggtacacaaatcaaatttgataacatggaagtaaaacaagaaacttgtaaaatagaaatagataataaagagtttgatggtgatggtaccttggatgacttcaaaattgaaattaaggaagaacccaagagagaacccgcctacaacgcgtttaactatttagactttcctgaaaacgctaaattagaacaagatgaacataaatttaatgtatgtgaagaaacccaaacaacaaaggaagaaagtctacgtctgaacgagattaaaacgaaatcacacactggacaaaagccttacaagtgtaaaatttgttttaagcaatttggaggagcaggaagtttgaaagagcatttaaggatacacactggaggaaaaccttataagtgtgaaatttgttctaagcactttagtcgagatggacatttaaaaattcatttgagggttcacaatggagaaaagccttataagtgtaaattttgttccaagcaatttagttaagctgagcatttaaaaactcatttccggattcacactggacaaaagccttataagtgtgaaatttgttctaagcaatttaatgaagcaggcaatttaagaaaacatttcagattgcacactggagaaaagccttataagtgtgaaatttgttctaagcaatttagtgaagcaggaactttgaaaaagcatataaggatacacaccggagaanagcttttcaaatgcgaaatttgtttgaagcaatttagtgaagcaggaactttaaaaaggcatttaaggatacacactggagaaaaaccttataagtgntgaatttgttctaagcaatttactgaagcaggaacattgaaaagtcatttg

SEQ ID NO: 7240 - DNA, 873 bp, Diabrotica virgifera
  misc_feature (172)..(191): n is a, c, g, or t
  misc_feature (815)..(815): n is a, c, g, or t
cttcagcaatgtctcaaatcaacttcgcttcgtatgggcatagggcggtttcgttcctggctaggaatttctacagtctaaaatatgtggcgttggttttggctttctgtatcaactttatgcttctcttctataaggtgtccagtctaaatgaagactccggcagtggtannnnnnnnnnnnnnnnnnnngatataatcgaaggatccggcatcgaagccggcagcggtctagatagcggagaagacgacgacgatttaccggaactggtccacgttgacgaagatttctactatatggcgcatgtgatgcggttggcggcgatgttacattcgatagtttctctagctatgctgatagcgtattaccatttaaaggtacccttagctatattcaaacgagagaaggaaatagccaggagattggaattcgaaggattatatatcgctgaacagccagaggacgatgatctgaagtcgcattgggataaattggttatttcggcaaagtctttcccagtaaactattgggataaattcataaagaagaaagttcgtcagaaatacagtgagacgtacgacttcgattcaattagtagtcttttgggaatggagaagacgtcgttccaccaacaggaatctgaagagaagaagagtcttctatcattgatcatcaatatcgactggcgataccaaatatggaaatccggagtgacgatcacagacaactcgtttctctactccttatggtacttcaccttctccatccttggaaaatttcacaacttcttcttcgccgcccattttgcttgacgntgcccgtcggtttcaagactttgcgtaccatcttgcagtcggtaacgcacaacggcaa

SEQ ID NO: 7241 - DNA, 768 bp, Diabrotica virgifera
ctacttttttggtgataatgagaagtcttacaacaatacacagttaattttgttatatacagtttcttttaaaatgtttacaattcgtatttaactgcaacatgcctcctgccattgaaaatcactattgtgacattttaacggacgaagaaaatgtgcaaatatttaaattactaggaaatcgttgccaatccctatgtaccacagtagttcagttatatttgacgacccctccggatcattcaaaatggatcaaaaagaccactggtgttttgtgctttgtaaaagacaatacaaaaaagaatttcttcttccgcttattttccatcgacagaaatataaagctgtgggaacatgaaatgtacaaccatatggactacatcgaagccactccattcttccacatgttcgaaggcgagaactgtcacgtagctttcaacttcgcgagtattcaagatgctcgagaccttcgaatagtagtaaatcaaaaagtcaatgctaggaaaaaacgagaagacaagaaaaataaagttattagtcaaagccaaacgctgcctccaccaacgactcaacttaattttaataactacagaaagacattagatccggagtctcacaagcgaagagaagaaggaacatcactaaagtcgatattggaattcctagagattttaaacatatctcgcatgttgtatgggactcaaacctcatgtattttgatggacaacaacagtaaaacgaaagcttaatagctttccttttaaagaa

SEQ ID NO: 7242 - DNA, 874 bp, Diabrotica virgifera
  misc_feature (37)..(80): n is a, c, g, or t
  misc_feature (116)..(135): n is a, c, g, or t
  misc_feature (483)..(500): n is a, c, g, or t
cttatttttacgtaaggaatccaatccgcaataaaannnnnnnnnnnnnnnnnnnnnnnnnnnnnnnnnnnnnnnnnnnncctccgtgggggtcgagtacggtgccattcgatagnnnnnnnnnnnnnnnnnnnngcatgtatttttcagtttttcgatctgagaggcatttcgcaaaatatcgagaggtttgcccgcgatatttgtgactcgcccatttccttacgcccggctcaaatcgtcagatttttgaaatatacactgttttgcatgtacttaacttaccttatattaatctgatgatttcgagtttttctaagggtggattttttttcagcccccccttaacgaactcccctgtattaagagtccatatggtagaggtacatttacatattcagtacaggttctggcgaggtaaaacggaaggcgtcactaaaggactagaacaacaaaaaatatcgatatctatcattatgtacnnnnnnnnnnnnnnnnnnggcaaggaaatcacactaactgaaaaatttgtccacatttttagcggcataccacaggacaagagggcagtcaaggggatatctatacttattggacaaaaaccttaaaataaaataccaaattggaaagcatttaatgcaaggggtagttactgcaaatctaaacatgatgcagatgaaaactccaaacaatataaagagctgaggaaaatagttaaaaaggcaatacttgcagcagaacaacaatcctgaaaagattttagagacaaattggaaaagtacagcaggagcaaccaaaacctattttataaagtgatagggctaggaggaaataaaaataaagtaaggtggataaagaacgattacggggaggg

SEQ ID NO: 7243 - DNA, 596 bp, Diabrotica virgifera
  misc_feature (21)..(21): n is a, c, g, or t
  misc_feature (25)..(28): n is a, c, g, or t
  misc_feature (34)..(34): n is a, c, g, or t
  misc_feature (36)..(37): n is a, c, g, or t
  misc_feature (52)..(52): n is a, c, g, or t
  misc_feature (130)..(130): n is a, c, g, or t
  misc_feature (138)..(138): n is a, c, g, or t
  misc_feature (146)..(171): n is a, c, g, or t
  misc_feature (242)..(242): n is a, c, g, or t
  misc_feature (259)..(259): n is a, c, g, or t
  misc_feature (320)..(320): n is a, c, g, or t
  misc_feature (330)..(360): n is a, c, g, or t
  misc_feature (395)..(416): n is a, c, g, or t
taaaggccgaaacgatgaagntggnnnnaggaangnngccccttaaaggccngagtaacaaaaaagcaacaccccggcgacccagacatggaaaactagaaagactacaagatttccctctaaagaaggnggagaaangggagaannnnnnnnnnnnnnnnnnnnnnnnnnggggaaagagaggaaggagatgacaaatgagggagaaaggagaaggagagaagaggagagaaagggagganatagggagcaggagaanggtggaatagaagtaagaggaaatagtggagaaggagaggatgtatgataagaagaggggntgtaggatannnnnnnnnnnnnnnnnnnnnnnnnnnnnnntgtatgaagatataagtgagatgaaaatgaattannnnnnnnnnnnnnnnnnnnnntacaagacacatttttgacacatgaaaagaggatgctacaaatgagatcgcatcctccccgacctatacgactacgagatacccagcaagcatgaagacttgatgctccgaaagcacctcggacaaacaatctctgggagcagcagtaactcgattcatccactaccaggaggcacaaaa

SEQ ID NO: 7244 - DNA, 958 bp, Diabrotica virgifera
cttatctaatgtatttgctgccgcaatggcagattgtgtattttgtgaaatcatttccggacaagaggaagcaactctgttctttgaaaatgacgattttattattttcaaggatataaaaccagcttcaaagtatcatttgcaagtcgtgcctaagaaacatatacgtaatattcattatttaaaaccacaggataaagattttgtggaagaaatgttggtactcagcagatacattcttgaactgaatggaggagactgtaatgatgctagaataggttttcattgtccgccatatacaagcgtaaatcatctccatctccatgtaatatctcccgaatctgagatgcgtgcctatcaacgaagcagatttgaatctcctaaatttaaattggtaataactatttaaataaaacttttttaatgtatccaatttagggaaaataccattagtccagtcgggatagcatgtgaccttgcttggtagcaacctttagatccagcttcgtcaatatttcaaataatatgtttaatggtaatgcatcataggctttctctaagtcaacaaacactaaatgcctcggttttctagctgttattttctctatgattttctcgtattataacctcccaatgagataataacgcttatacctctgtaatttttcatttctcctagcctccttttttgtggacagagcttatacataccaacctttttctggaatatttcttgtttgattagacatttattaaagatctcgttcgtcttatctcgtccacactgattggttgtacttcgtccttcgctattgtatctcttccgaagtctctgtaattatttcgcaaagtggtcttgcttccgtcaatacagtcaatcgttttttttttatctaaacttggaaaacgtcttttattatttcatcttttgtctgtgacgttttctgtccacgccatt

SEQ ID NO: 7245 - DNA, 364 bp, Diabrotica virgifera
  misc_feature (327)..(351): n is a, c, g, or t
aagaattcgacaattataagaaaaaatttaacaaatcgtatgacactccagaagaagaacagaaacgattcaagatcttccaagacaatttgagattcattgaagatcataaccaaaagtaccaacgtggagaagtttcttcaacagttggagttaaccagtttgctgatcagtcaaaagacgaatgggccaataggaaccacggacttaaaattgattagagtcgtattgtttctgttgtaggattaaagataataacaatgtgaaaatattttaaaagttgttagtttaaatgccgttttagcattactgtatttaaaaacctgnnnnnnnnnnnnnnnnnnnnnnnnngcattcttaatag

SEQ ID NO: 7246 - DNA, 916 bp, Diabrotica virgifera
  misc_feature (6)..(27): n is a, c, g, or t
  misc_feature (674)..(688): n is a, c, g, or t
  misc_feature (872)..(872): n is a, c, g, or t
gatcannnnnnnnnnnnnnnnnnnnnncaagtgttgaaacgacaggttcagtcgctgacgatgcatcagaaaaagttggaagccgagttacaacagatcgaggagaaattcgaagccaagaagagaaaatttattgagagcagtgaacagtttcaagaagaacttaaaaaacactgcaagccagctgtagatgaagataccttccagaaaatggtcgaaagacaatatgatataataaagagagataaaagcaaacaaattcaagatgatgttaaaccgaaaacagaggaaaatggtcacgctacttctcccactactcaggaaaatggaactaatcaatctgaacccatggaacaagatcaatccgacaaaatggaccaatctcaaggtcctcctgcaccatccgtgacaaacggtccctcaccaccccaagcggaaaaaacaacaatggaccatccccaacagtctccccatccagttggccaaccacactatgcccatccttcagctgctcatccagaacaccatcaaccaccaccacccacacaacctatgcattctgcacacgaaccttcaccacctcacagtagtggaaatatgcacccacatgctccaccaccacatcaggctggtgcacctcatcatccaccacaacaaccgtcaccgggcggacnnnnnnnnnnnnnnnctccacaaggtcctcacggccccatgcctcctcatatgcagcaaaatccagctcatccaccttcagctcaaggaccaccaccacaccagaatcccatgatgccaccttcacaggttcctcaacaatatgctcaacagtatccgccgcaaggacaaatccgcagtcggtgcccttgcacctaggncacctcatccaggctacccgggttatccgccccaacagcaaacc

SEQ ID NO: 7247 - DNA, 504 bp, Diabrotica virgifera
  misc_feature (92)..(111): n is a, c, g, or t
  misc_feature (176)..(224): n is a, c, g, or t
  misc_feature (364)..(384): n is a, c, g, or t
tttttatttatcagttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccttccagctgaacacagatattctgaattgccaatattatcatc

SEQ ID NO: 7248 - DNA, 888 bp, Diabrotica virgifera
  misc_feature (721)..(740): n is a, c, g, or t
ctggtccaactgaaaacggagaaatccttaatggtactggcgaagttaccaatggtaactgcaccgacaccgatatgtcaattaaagattacgaccggcatagtacgtctggtgctagcgagttgcagttttccatgagatcacgtactcctagcttgaatggttcattgtatagccccacaagcatgtctagaaagatgtttggttatcgttctccatcaccaggattgatattaagggatcataataaatcagcccatttagccgatgatatatcaagaatatacacgtacagttaccttacggaagaacccactcaaggttatcttagaaaaccaatcgatccgtatgacagggctcctacatctccgcattttcacagaccgacttctcaaaactctctaagaagtagttcgggatcgggaagaaggagcacttcgcggacagctatgaaagttctggtcgactcgatgcatacggatgtaccaagacccaaatcgccccatatgaataacgaagaacccatagaattggctcatttccccggagctaaaccacctcagccaggcgaacctacgaaaatagagcgtgacgatttcccggcccctccgtatccgtatacagatccagagcgcaggaaacgctggtcggattcatataaaggtgtcccgtctgacgaagatgaggtagatgatgccactgcgagagaaattcaagatcnnnnnnnnnnnnnnnnnnnnaatgaattaagtaaaatagcgagtggaataggaaaagtatttttaaaagaagttcaagaacgggaaaaatataaacaatgggaaagcagctaaccttgaccctaggaacgcttccagaactccatctgcaaagaaagagcctaactat

SEQ ID NO: 7249 - DNA, 631 bp, Diabrotica virgifera
  misc_feature (531)..(561): n is a, c, g, or t
aaaggaaattatatcgaacataatttacatataaatttagcgatcaaaagcgaatttttcaaagacgagatctgactactgtaggatataagatgagtaaaacgggtgtgtctactagtgcagataaggaaactgcaattgctaatgctccaatacctacaaacagaactcaagttcggagtttctgtggcctaattaattattacagacgttttttaaaagatacttctacaattttacaaccattaaataatttacttaacaagaatgtcaattttaaatggtccaatacttgtcaaactgcgtttgacaaagctaaaaaactcatttgttctagaaatgttttatgtcacgacccaaatttaccattagtcctactaactgatgcatcaccctatgggcgaggtgcagtactttcacatatcttttccacatggcacagagagacccctcacagctcgcttctcaaactcctactactactcccccaaggtattcacaaatagacaaaaacccttaccgccataattnnnnnnnnnnnnnnnnnnnnnnnnnnnnnnngtggtccacaatttactttgctcacttatcataaccccgcatgttcacattttttccccctgcataaaag

SEQ ID NO: 7250 - DNA, 247 bp, Diabrotica virgifera
aatgcgaccagtatgggctcatcaagcgcgaagggtggggcggatacgccgagacgaagaacggtaacatttgcgcagagacaatatacgaccagcgctctatcgctcaacttggccttcgttttctacacgacgaatcgccgaactatcctcggcaagatctaaatcggagggctcactttacggctccgatatagtggtatacgtgaccctcgaccccgaaaaaatagattagggtgatggccca

SEQ ID NO: 7251 - DNA, 884 bp, Diabrotica virgifera
ggccgcccgcgatctagaactagtggttaccatcatagctaccttaattttatttattgccaccctaaatcaaccatgaagttcttcttcgttctggactgcgttttcctgctatttttacttgaataatattttgtagcaacctatatttgggacctctcatcaaatgtcagaaataatccaactatttcttcttgatgctttttataatcgcagtagtcttgccgaaacattctagtattgtagagtttcgaatcttctccatccaatgtactcttaaaattcttctattgcaccacatttcgagagccttaagacgatttagatcgattttattcacagtccatgagtccaagaccatacagtaagaccaagattcaccatacaataagaccgagaacacgtagcagcgaagtagtcggatccttaatgccaattttaaatgagcaccacactctcgcgaagttacttcgggaaagttgaccgaagtccgaagtacccgtcactacacactccttcaactttgtgaggaacacattgacgcggggcgatatctattttgattcctttgactcgatcgcaaaaaccgccaccgaatggaagtagaccgaggcgcagcaaagtcgcatgaggttactgtctacactctcgtactcgctgaacttcaatcgacttcgcgagtagtatagtgagcgttttaggtctctgttacgtactttgtacatccttctaaaagcggctcttattcggggggttttattaaatgatcaaattacgataacatagcaccggcaattactatttttatctggtctctggcattttaattgaatagatggcaataaacagatttattatgggactttttcatttattatgttcag

SEQ ID NO: 7252 - DNA, 970 bp, Diabrotica virgifera
  misc_feature (25)..(25): n is a, c, g, or t
  misc_feature (352)..(370): n is a, c, g, or t
  misc_feature (580)..(580): n is a, c, g, or t
  misc_feature (618)..(618): n is a, c, g, or t
  misc_feature (642)..(642): n is a, c, g, or t
  misc_feature (698)..(698): n is a, c, g, or t
  misc_feature (727)..(727): n is a, c, g, or t
  misc_feature (872)..(889): n is a, c, g, or t
ctaaaacatgatgtagaatttattntgggatatacagcatgatattgcttttaaaaatctgaaagacattttagcaagtaggcctgttttacaattctttaatcccaataaaaatattgtaatttcagtggatgcttcccaatcaggggttggaggttgtttattacagaatggtttaccttgtgcatatgcctctaaagcattcactgaaacccaaactcgttacgcacagatagaaaaagaattgtatgctatctgttttgggttaaacaaattttatcaatatatctatggacaaaaagtaacagtggagactgaccaccaacccttaatatcaatatttaaaaaaccnnnnnnnnnnnnnnnnnnnagacttcaaagaatgatgttgcaattacaaaagtttgatattgatcttaaatataaaccagggaaagatctaattatagcagatgctttgtctcgagcacatttaacccaaagcaacaataatgatattttagggactttggatgatgatattgagagtcaggtttgcatggttagactggagttaaatgcaacagatgaaaaaaattanagaatttcaagacacaactacaaaagatattgttttanatgaattgagacaagttattttanatggatggcccaataactctaaaaaacttaaagatcacataaaactttttgctccnttttaatcagagttgacagtggtagatgngctaatttttaagggtaagtgtttggttgtaccaaaaattttacaaagagaaatgctagaccgcattcattatagtcatttaggtataaaataagtgtattaaattagcccaggagtccttatatttggctggcatggtacaacnnnnnnnnnnnnnnnnnngtctatgtcatcaatgcttgacatatgcaaattcacaaaataaagtacctttagttcacatgaaataccacatctaccctg

SEQ ID NO: 7253 - DNA, 1270 bp, Diabrotica virgifera
  misc_feature (390)..(409): n is a, c, g, or t
  misc_feature (1016)..(1054): n is a, c, g, or t
  misc_feature (1222)..(1241): n is a, c, g, or t
cgtccggaactgtagaggaatgtactaaagccatttaaatatggaaatacatcgatgtgaggtattttaaaaattgtattttttacttattgtgatctattgatatactatcgtttttaagcacgcagtagatttagtatgtatatattctgatatttatagattaggataagattttatttaaggaaagtggaaaaattggcaacttttttatctttaattccaaattggaaccaacaatttcgtttgcttcaaaaaatactgttctgaagctgtttctttgtggcatctcatacaatttactattttattgggaaataagccacagtttaatgtaaaaatgaaagttattgacatttcgacttgcacttcggagctcgttatctaaannnnnnnnnnnnnnnnnnnncaaaaatactgaggcttggcttacttgccaaaaaaatactgaagaaacagtcgcttattaaggccacacgtgtcatcgtttaccaacagatggcgcaaaagacatcagttttgttagatgaaatattccaatttttccattaatctgtattagaaataccactttttaagtcttttttcattactgccaactcctttaacgttaaaattagtctaaaccgttaaacgtgaccccttttgaattgttttattccattcgaaatatacaccatcattttctaggtacatgaaaatcatcatcaccaaattacatcacaatattataagaaaatagtattctgcatttgtttatgtgaaaattacttttcagcagccgtacagggattatattttccagataatgcacttttaccaaagcctttctacggttcacaaataaggggccttctctatatggttgcctttaccaaaaaaacttgattgggattccaaaatttgtatttccctgaccttttcttaacaaagggtggacagttaaaccgatttcttccccttttaatttctggttgggcgcccttttggattattatcccaaatttgattaattnnnnnnnnnnnnnnnnnnnnnnnnnnnnnnnnnnnnnnnccttagggcttcacacttttttggggcgggaaaggggggtgtgggtaatacttcccccctttcgtgcgccccttttttttccgtttttggtggggggaggtggggacaaaatggggacactggggaaccttttttgggggtatatttgagaaatattatctcttgtgnnnnnnnnnnnnnnnnnnnngcccccctccaggggggccaccccgcccg

SEQ ID NO: 7254 - DNA, 895 bp, Diabrotica virgifera
ggtgtttttgtttgtggaagtcgaaacttgatattattacaataattcaataattgtgtctttgctattgacttttttaactactgtgttggtctaattacccactgttccactgttgtgtcaacatgcaacaaaatgggaacgtgaataacgaaaatagaaataatcatccaggcaggaggggtaatggaaactggagaaatcgtgatggtggaccagctcctaatttctcaaggaatcaaaactggagggaacgtaatcgtggttctgatgctatacctgaacatggtcgtggtggaggacggggtcgtggttttgatcctagacccgaacgtggtcgtggtggtggacggggtcgtggtcattattatgtccctggtaatgacgatgatactggtaatgatcgtggctttatccctgtgaagacagaatataatgaatcaaacagaacgcgtaaaccgcgtcagatgggattcagagcattggaagaattgattaataatgacaacattgaagatattattttagatcttaatgatagcaagaaaggttttaaaacattactgggtagtcaattatcgacagatatgattgttttggttgtaaaaatgttagctaaaatatgcgattccgcttttgatgcttcgaagactaaagtactacaatatgcgatcgaaagtgactttgccaatcaagtgacctcttttataactctcttggctgttcagaattcaagagacaaaatgtataacaagtacttttggaaggatactgatgatttttggaataatataatcaaaatatcagaacattattatgacttattgccttttacttcttgcgattttacagtaaaacttttaaaatctgttaaactcagtatcccttttgatag

SEQ ID NO: 7255 - DNA, 701 bp, Diabrotica virgifera
actgataagagccagattcatctctacctaatatctctttgggctgatgctatactacccagggactgattacacacgatatcaaaccatctagtgtaaatgtcggagctgatctatctgttggccttcctacccaccctcctccattcacagaagaccgaggatcagactataatccccccgaatttgcatgctgctcccaacatactcctgggaattgtagaggctgtaaacgcctttttgtaggctatcaccaacctccaatgcgaccgcaaccgatgaggcaaccattatgatggttctgctaatctttgcacagctcatgtcggtattgggtgtggccaaagctcccattaatagctacacacactctcttattagagaaaaactagatgagagtgactatgaaatacggacgccagcttagtactaaaatgtactaacattatatccaggctttgacattgactccctgcaaagaatcattgtgtctgcaaacttccaattatctccaacagtagattacaccctcaatagagtcattcttttgagaaaagtattgaaaagctatttgcacgttggaaaatccgatgaccctgaacactctatgtataacgtctagctccaaatgcttcttccacgtgatctatacttgcaaggattggttaatgaccactacttcgctacgaatgatattctta

SEQ ID NO: 7256 - DNA, 513 bp, Diabrotica virgifera
  misc_feature (2)..(314): n is a, c, g, or t
  misc_feature (321)..(358): n is a, c, g, or t
  misc_feature (378)..(391): n is a, c, g, or t
  misc_feature (394)..(416): n is a, c, g, or t
  misc_feature (424)..(446): n is a, c, g, or t
  misc_feature (476)..(507): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7257 - DNA, 922 bp, Diabrotica virgifera
  misc_feature (5)..(80): n is a, c, g, or t
  misc_feature (110)..(131): n is a, c, g, or t
  misc_feature (143)..(306): n is a, c, g, or t
  misc_feature (321)..(346): n is a, c, g, or t
  misc_feature (363)..(405): n is a, c, g, or t
  misc_feature (435)..(450): n is a, c, g, or t
  misc_feature (452)..(511): n is a, c, g, or t
  misc_feature (563)..(631): n is a, c, g, or t
  misc_feature (661)..(699): n is a, c, g, or t
  misc_feature (744)..(772): n is a, c, g, or t
  misc_feature (776)..(788): n is a, c, g, or t
  misc_feature (791)..(836): n is a, c, g, or t
  misc_feature (843)..(899): n is a, c, g, or t
  misc_feature (906)..(920): n is a, c, g, or t
cttannnnnnnnnnnnnnnnnnnnnnnnnnnnnnnnnnnnnnnnnnnnnnnnnnnnnnnnnnnnnnnnnnnnnnnnnnnntctccctcctccccccgccgcccacgaagnnnnnnnnnnnnnnnnnnnnnntccccccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacaaccccccannnnnnnnnnnnnnnnnnnnnnnnnngtgtggtggggggcggnnnnnnnnnnnnnnnnnnnnnnnnnnnnnnnnnnnnnnnnnnnagagagagaggaaagaaaagaaggagcagnnnnnnnnnnnnnnnntnnnnnnnnnnnnnnnnnnnnnnnnnnnnnnnnnnnnnnnnnnnnnnnnnnnnnnnnnnnnaggaggtatttttccttcttccttttttttctcggggggggggcgcggagcnnnnnnnnnnnnnnnnnnnnnnnnnnnnnnnnnnnnnnnnnnnnnnnnnnnnnnnnnnnnnnnnnnnnncccccccggcgggccggcccgccgcagaannnnnnnnnnnnnnnnnnnnnnnnnnnnnnnnnnnnnnncttcttctcttttttctcttctttgtttttttttcttccttatannnnnnnnnnnnnnnnnnnnnnnnnnnnnagannnnnnnnnnnnntgnnnnnnnnnnnnnnnnnnnnnnnnnnnnnnnnnnnnnnnnnnnnnngggggannnnnnnnnnnnnnnnnnnnnnnnnnnnnnnnnnnnnnnnnnnnnnnnnnnnnnnnngaagcgnnnnnnnnnnnnnnntt

SEQ ID NO: 7258 - DNA, 110 bp, Diabrotica virgifera
  misc_feature (7)..(100): n is a, c, g, or t
  misc_feature (104)..(105): n is a, c, g, or t
taatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnntgatg

SEQ ID NO: 7259 - DNA, 850 bp, Diabrotica virgifera
  misc_feature (218)..(247): n is a, c, g, or t
  misc_feature (315)..(327): n is a, c, g, or t
  misc_feature (330)..(344): n is a, c, g, or t
  misc_feature (614)..(634): n is a, c, g, or t
  misc_feature (639)..(656): n is a, c, g, or t
gtagaggtgaacaagccgggacacgttgagtgatactaggagcgctcccgaatcatgatttacagtgtatatacattgtaaatcccaaatcatgatttccaaggtttatacattgtaaattgtgattcggtagtgctcctagtggcatttgacgtgtcttggtttgtttgtttctactgcatcttgagtgtaaatttagtatagtacaaatttgaaannnnnnnnnnnnnnnnnnnnnnnnnnnnnnctacatttttagattaaaatgtacaagcgcatcaacagtcacatcgtgtaaagctaataataactttnnnnnnnnnnnnntcnnnnnnnnnnnnnnnatatgtatattgtatatgtgagacaaaatctcacgcgctacgactgacgtaacggctaacctagcgaccaatgccgggtcaactgtatcaatgtcctttcagacaatataaaaaagaactagtagttctgttgccgtccaatgcctgccgttctatgccgtctgtagtaattaatgttttaaatatgaaaaaggctaatcaagtacttggcacttggacagtggtgtcatggtgtcggaacgccgttccggcaccatgataccagcaacnnnnnnnnnnnnnnnnnnnnnccagnnnnnnnnnnnnnnnnnnttaagcaaatgcatatacattttaaaatatgcagacgtaacttgtattaaaaaaacatcaagtaatattttacttgttaaaaagttagtaaaagtgcgttccggcactgctaattttgccatgacaccactgcacttggaccattattattaataacatttgttctgggatatacacgaactgccatcttgtaa

SEQ ID NO: 7260 - DNA, 898 bp, Diabrotica virgifera
  misc_feature (122)..(140): n is a, c, g, or t
  misc_feature (234)..(273): n is a, c, g, or t
gttggatagaacaaagtcaatttcgttcttagtaacgactacgaacgaaattgacttttggtgctacatttggtacgacatttttggtactacacgagcccattttctgttccagttttgcnnnnnnnnnnnnnnnnnnngtggactacatattttcgtatgacttaatccattttttctttctccggcaaacaagtaagtatattgcctgtttttattttggcactggtaccnnnnnnnnnnnnnnnnnnnnnnnnnnnnnnnnnnnnnnnntcaggagatcctaagaatatctgaccgccagtatttgctagttcatttagagttacccagggtgtacgtgtagtattccactacggacgtgaactagctctacaccccaagcttgcaggaagaatactaaatattcagttcgaaaacaccacactcgcctacaataaaacaccaaagtaccttggggtgactcttgacagaaccctatcattcaaggaacatctgacaaaaacagcggaaaaacttaaatccagaaacaacatcatccagaagctgtgcgacacaacatggggagcatcggctttcaccttgcgatgatctgccctgggcctagtcttctcaactgcggaatactgctcttcagcatggcttaacagtccacatatacacaaagtagatgcccaattgaataatacaatgagaatgactgctggagttatcaaatccacctctacgcaatggctcccagtactgagctacattccactacccaaactacgacgcataaacgcacccactagtgagtacagaaagatagtagataacgataacctgcccatcccatcagatatagatgccgcccacggtaactatctatgctccagacgaccaccaataaaaacag

SEQ ID NO: 7261 - DNA, 791 bp, Diabrotica virgifera
  misc_feature (17)..(40): n is a, c, g, or t
  misc_feature (148)..(174): n is a, c, g, or t
  misc_feature (741)..(741): n is a, c, g, or t
aatatattgatgaatannnnnnnnnnnnnnnnnnnnnnnnccgtgtaaaggttgcctaagtgaaatgtgcaaggaaaatcttggcgggcaaaatacatgcagcgttttggtagtcagtcacgacagatttgtagatttacaacttggnnnnnnnnnnnnnnnnnnnnnnnnnnntgtaccaatcacattattatgttttaattctttttatgcagcattcttggaaaatttttctggaaattaacaaatttggatatttgacagttttgtaacctaaaatgtttgtctgaaaacattttccgggctttttccacttactatcttccagtcaggcataaaaatatagtgctgtttgtattatcagtagtcattgcctaattgtcgcttttgacagcgtctcattgactaagtttctaatttttcggccataaaaattttgtccttataaaaaatttgtccgtctagactaatttacatctatctgtgtgttctttgattccttacgtttatggactgtagactggtatttacaaaactctaataaacaaatccgactgataaaaaatgtaacccgcgcagaaatgtaattctgaataggtaaccctttaaatatttgtgacgactgatactttcaataattagtaatatactagctaaattggcagtttcagatatctgttgaatgacacacaagttgttaaaataatggtagttacatcaattagctacaataccttacanttaaggtaccgtcgaagaagaaactacctactttatgctcttatatttta

SEQ ID NO: 7262 - DNA, 374 bp, Diabrotica virgifera
gtggacctcaaatgtacaaatgcgagagcctagatgtaccatatcagggaaccgcttaaaaaagaagactcacataagggtccaggcccctttggagatgcctgtgtactcgactaatgaaggtcgaaatagaacggggaattgccattgatattgcggtgtggttcttcaaaccagctaaatactatgtagccatcattgatgccgctggacagagagattttcttaagaacatcatcactggtgcatctcaaaatgagtgtggtgtattcattggtggaggtgtaactggtgagttcgcatcaggtatttcgaagaatgccccaacacgtgtactggtctccttgctctcccctcttggggcaaaatcaact

SEQ ID NO: 7263 - DNA, 905 bp, Diabrotica virgifera
aaatgaaatcagagtgttcgattatttataactgatggggccaaactaagaattgagtgctgaggaacagtcctagtcgtgatttgatcttgtgtttatattatacgacggttttccacttaaagaaagtggctaaaagacaaaatattactcacttttctaattagactttaatgatatgaaaattgaaaaataatgtggtttggtacgacgctaacaaaagttcgaagactgttaatacttcggaaaatttaaatgctactcaatatacttggattaattaaagtttctggcaatattgcaaatttttggaaatttggatgcatactacattttttaaccaattttgtcaaaaacaagaaactaaccaaactgaactgatatcctcagtttctcaaaattatttgatactagattgttgtatgacgtaaaaccgttaaatatccattaggtacctccacttcttactctaattcacgcttcacaagctcaaattgaacaactgaaaaagagacctaaaagtataggaagtaagacgtgatagaattccgacatcataaacaatatagaaaataccgtcgtcttaaattgtatgcaagttttttggaactcggtcaattaaaaaatcagtaataaaccaaaccaaaaatttaattgccaattttgtcatctactttttgtaaactgtaaacctacttttcgtataaatacttattttatattttcgtggaaacacttaaaaaccccttcaaaaaccgcgttaagcttggcaaaagaaaaaaatcttaacccaaattttttacttttaaactacctcttacgaaagaagcaaaactgaatctgtttttaaaagggtaagtaacagtccttttattcccagatatggggaaaaccatttttctttc

SEQ ID NO: 7264 - DNA, 1016 bp, Diabrotica virgifera
  misc_feature (9)..(855): n is a, c, g, or t
  misc_feature (868)..(891): n is a, c, g, or t
  misc_feature (894)..(1015): n is a, c, g, or t
ttccccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccctataannnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 7265 - DNA, 678 bp, Diabrotica virgifera
  misc_feature (10)..(39): n is a, c, g, or t
  misc_feature (55)..(78): n is a, c, g, or t
  misc_feature (80)..(92): n is a, c, g, or t
  misc_feature (97)..(148): n is a, c, g, or t
  misc_feature (208)..(230): n is a, c, g, or t
  misc_feature (292)..(323): n is a, c, g, or t
  misc_feature (446)..(482): n is a, c, g, or t
  misc_feature (541)..(560): n is a, c, g, or t
  misc_feature (562)..(574): n is a, c, g, or t
tttcgtccgnnnnnnnnnnnnnnnnnnnnnnnnnnnnnncccactcgtccgggannnnnnnnnnnnnnnnnnnnnnnnannnnnnnnnnnnnaattnnnnnnnnnnnnnnnnnnnnnnnnnnnnnnnnnnnnnnnnnnnnnnnnnnnncccaagaaatgggtaaaggttcattcaaatatgcctgggtactcgacaaacttaaggccnnnnnnnnnnnnnnnnnnnnnnntgatattgctttgtggaaattcgaaacagctaaatactatgtaaccatcattgatgcccctnnnnnnnnnnnnnnnnnnnnnnnnnnnnnnnntggtacatcacaagctgactgtgctgtactcattgttgcagctggtactggtgaatttgaagcaggtatttcaaagaatggacaaacacgtgaacatgctcttcttgctttcacccttggtgnnnnnnnnnnnnnnnnnnnnnnnnnnnnnnnnnnnnngactgaaccagcatacagtgaatcacgtttcgaggaaatcaagaaggaagtatcctcannnnnnnnnnnnnnnnnnnncnnnnnnnnnnnnnttgctttcgtaccaatttcaggatggcacggagacaacatgttagaaggatctgaccagatgccatgattcaagggatggcaaatcgaacgtaaagaaaggaaa

SEQ ID NO: 7266 - DNA, 702 bp, Diabrotica virgifera
  misc_feature (685)..(701): n is a, c, g, or t
attataagaataacgctagatatgtatatcatgcggtcacttttacacgttgtgttgctattgtgtttttgcaagaacttaacatgggcaatgcagtcagactggcctgcaatatgcccagaaatagtctcaaaagcaagatggggtggtcgtacagcaatagcagttgaatacgccatcatgcccgtcaaatatgtcatcatccatcacactgtaactccacaatgtactacagaagagagctgttccaaaattatgcagagtatacaaaattttcatatggaaaatttagagttccatgatatcggttacaattttctagtgggagaagatggaagaatctatgaagctactggatggcacaaagttggagctcacactagaacttataatagcaaatcacttggcttagcctttattggaaacttttcagaaaaacgaccaaacagtaaagcattaagagcagcaaaaaaatttcataaaatgtgcggtggagcttggagaagttgacaaaaattacatcctaattggagcgagacaagttagccagactgctagccccggactatatttatacaacgacataaaagattggccacattttaaaagaaatccataaattacttatatgtaaactacatataaaacgactgaatgcgtattgaattatacgattaatttatgnnnnnnnnnnnnnnnnnc

SEQ ID NO: 7267 - DNA, 197 bp, Diabrotica virgifera
gacaaatctcctcgttgaaagatcgtcccagatgtaaaaggagtggcaaattttcgacggatatgcatatttcgggccaactcggtaccgcaacacagcgtacgatcatctcaatcttttcacttgtgaacgactcaccggcaatgactgtcgtctcgctcactcaattatttggcagtcacggccactcactaagt

SEQ ID NO: 7268 - DNA, 919 bp, Diabrotica virgifera
  misc_feature (25)..(42): n is a, c, g, or t
  misc_feature (317)..(486): n is a, c, g, or t
  misc_feature (742)..(756): n is a, c, g, or t
gatgagaaggtcgccaaggtctcgnnnnnnnnnnnnnnnnnncgctcgcacgtcggcgtggccagcctgatgttccagacgctttcgcaggaaagcatcaacatccagatgatcagcaccagcgagatcaagacctcggtcatcatcgacgacaagtacatggaactgggcgtgcgcgcgctgcacaaggccttcggcctggaccaggcgcccgccgccaaggcctgagcgacgcaggtccggcacggtttttttcacgtccgcggcatcgcgcgggcaatagtgtaaaaagtcgtgctagaatctcgttctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatcgcgcgacgggccggcgcccgcgccggctttggaaaaaattctttggttttggcggtaggacggaattctatgattcggcggcatgattctaaaaccccccgtacccgggaaagccccgacgggggggggcgcctggaacggcccatggttctggtggacctgttccccggcgcgctcgcgggctgcatcccgggggggaccgcggtggacgccaacgggggttcccccccgaaaacttcaaataccgcnnnnnnnnnnnnnnnccggggcccacaacccccagtttgatttcgaaccaaggggaaggccctgtgggattccggggccgctctcacccgggggcacccgccccccttttcccttgggcccaaaaggccccaaaaccccccgggcgcgcccggcccaaaacaaggggggcggccctcc

SEQ ID NO: 7269 - DNA, 873 bp, Diabrotica virgifera
cagatgtatgcttttgtcgtaagctccctcaatatccataaataacattgcctgtccatctgtctaattagccttcttaggtccatcttttatacctcacacaagtcattggacacttgcagctctaatctacgactggcacttatttctctacaagatctttatgaatccttaggacttaaaatatctggctcaaaatcagaaatttgttttttctctaagaaacatgaggtcccgtaaggcagttttatatcgggacagcttgagttcccaataaagaattctgtaacatacctgggaacaattttggacagaaaactgttgtggaaagatcacatccaatacactattaaaaaatcagaaaatgcaataaatattctaagagctttttgtaaaacaagttggggtgctgatcctattattttaccgatcaatggttcgtcctattctagactacagctgtcacttgtatggttctgcatctaatacacacctcaacaaaatagaagctcagaagaataaatgtttaagactttgcttaggatacctaaattctactccaataaacatcatggaatgtgaagcagttgaacctccattgcaattccgaagacaatggataagtaataaaatagttaccaaagccatatccaaggacattagctatctccacgaaataaatcagttaccgatattagaactgacccacagacattggagaacaaagaaagatcttttgcacaccaatagttatagaaaattatctaaatatcaatcggaactatatatttagtcgacttgctcccgtatataaatataaaccagatgtattatttctcgataggagtagaaactctatatatgggattcaaa

SEQ ID NO: 7270 - DNA, 518 bp, Diabrotica virgifera
  misc_feature (19)..(20): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (29)..(31): n is a, c, g, or t
  misc_feature (67)..(67): n is a, c, g, or t
cagagatttgcaatttgcnnancnacnannnactttttaccagaccccaaagccaacagcaaacaancaacccaacaaccaaagaaagaaagaaacaggaaccaacaacttttttaggcgcgcatagacgagatcacagaaggagagtttgaggccaccgaatacgagagcacataaaagtcactacaaccgaaaggagcaccaaatcatccccaaaaacagcgctagaataagacaatacctaccaatagcgccgttaagatgtgacagacatactacaggaacgaagggcgcacagagaacttggtgtaactattgtacgagcaatgagacaactccaaacgaacaggtactatggaaccagcggataagggcccggacgcacagagtacgtaaagaacgcgatcacaggaagatcgcggaagaaatgtagtggatagggaggacacgtgcgacactagcgaacagaaccggagctataatatatggaacatccccacgaacatgcatcatccagg

SEQ ID NO: 7271 - DNA, 760 bp, Diabrotica virgifera
gacaacttcatctgatgtttataccgattttcaccaagtagggtctcaagtttcgtccaataaaaatgtacttcgtaatacaaatgtaacagacaaaaattctttaaaaaacacttccaaaaatttcatagaagtagagcaacaagattcaataaacaaacaaatggattccagtcaatatcaaaaaacaagcgtcagtgaaactatacaaaatattaccgcaaaagatcttggtaaaaatgctagtactaccacaactacaacctattatgactcgaaaggaaacattattaagactgtaagcgatgttgacaatcacaatattcctggaagctcttttacagatatagataaatcacaaactttaaatttgaacgaaacttatgttaagactgaccacgtaccagcttcttctacacccaagaaaacaaaatcccctgaacgaaaacctacatctcgatcacctgcggggacagtaacagaagaaattcattctcaagacagcactgtcagatatgtcgatgaaaactatgtcgatatgcaaaaaattcgtaatagtcatttaggtactgattctaaaaaattttatggtcataccgttgattccaaaaacactatagttggaaatgtttacgatactaaggctgtgcaaaatactattgggactacaggtcacgttattatggaccaaaatatcgacacgactgatctagtatattctaatgacaaaaactatggaaaaaatggatggaatggatcg

SEQ ID NO: 7272 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7273 - DNA, 66 bp, Diabrotica virgifera
  misc_feature (26)..(63): n is a, c, g, or t
gaataaattaccttagggataacagnnnnnnnnnnnnnnnnnnnnnnnnnnnnnnnnnnnnnntgc

SEQ ID NO: 7274 - DNA, 655 bp, Diabrotica virgifera
  misc_feature (229)..(584): n is a, c, g, or t
gcggtcagcctgcacagcgtgatcgagccgaacaagctcaagcagttcaatcagcagaacagcgcgaccttccagggcatcccggcgccgggggtcagcctgggtcaggcggtggcgtttttgcaggcgcacagccaacagctgccggccagcttcagccatgactggcaggccgattcgcgccagttcattcacgaaggcaatgcgttgatgctgacgttcctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagtcgaatttggcctggggctttgtgatccgtatcgggatgctggtgggcaccttgtttaccctgtt

SEQ ID NO: 7275 - DNA, 776 bp, Diabrotica virgifera
  misc_feature (27)..(59): n is a, c, g, or t
cgtgtttctgctttggttctgacgggnnnnnnnnnnnnnnnnnnnnnnnnnnnnnnnnnatcgctagtagtgtttaattgtgttcctttttgcgattcaactacctacatttgttaaaaaggttgttgatcaacaaagtttttgagtgaaggcaacgaaaggcgttttgagttgagcgttcataaacctcagctcaattcctggtaaaggaagttcagaagtcaacatttctagaagaagacaaggcgaatctaattccctgtcaacatggtccctgccagcaaagttcaccacctttgtggatcctatcgagaaatacctgtcgcatacccggcacgaggtcggggtaagcttgcgcgagcaaatcgaggaggacttgatgacggcgacggagaaaaggcactcgttcgaaagcagtgccatagatccagtttcgtttatgtatgtggacccgtacgacgtgaatccattatccagaagctcagatttgccccccgcaacgatactagcagatataccgctcaagttcaccagttgcatcgatagacacagtgatggaatgttgggattcccagctcaggtggtgtcaccaggatgctaggacctttcatgtcgaatccagtgtttcacaacagagccagttcgcaacaggaggtggtgtgttttacgttcctccaaggagaatcaagttggaaatggaggaattcggcgacctatcgtcgttcgtttccccccacggataatatccaatgctgtagatgaactcaatactccag

SEQ ID NO: 7276 - DNA, 237 bp, Diabrotica virgifera
  misc_feature (151)..(168): n is a, c, g, or t
gggggcacaaaggggttttcttcgaatgggaactcccaccggggaaaaaatccttggaaattttccccccccaaaaaagattttcccagggagagaaaccttttaaaattcttgtattgggggcgggggattattccccatttttccccgnnnnnnnnnnnnnnnnnntggcgccccccacatccctatttctcccaaaaatatttgtggtgggtaactccccctccccccccccac

SEQ ID NO: 7277 - DNA, 746 bp, Diabrotica virgifera
cttccaccgatccgttcacgttcaatatgatggtgaatctctgcttcaaaatttatactaccatattaagaaccgaataaaacggctcactgggcgaaatagatgcgatgagttagcactctataatgccgcacgtgtccttgatagataattttggtcgccagatgtctgtcaaaaagacgtggcagaaatgccaaaaactacatgtggtaaacccgctgaccaaaactacagaatccgtttgccaaatgttttgttacaaaggaaaggatggtaaggtgcacatcgaaagaatatgctcctatgctcccacgaacggagaggctcacagtttctcatccataaacaacagctgttgtaactgtcctaaatatgcccatcctggaaagctgatcattgcagtgcaaaataacaccatcagcataagcctaaaagaattcactgaaggattctatctgccctcgtaggtcacgaaaccttactgtaagacttctttttgacatcctcttgtaatatattattgtggcgctcctctttgaaaaagagagcctgcacccccaacgacttcattcgataaaaaaaggaaaaaaacgcactactttaatgctgcctaacagtgcaactaaaaaaaccaaaaccattttgagttatgtcacttgttaatttaaaatagtggctaccttgataaaattcttcgatcgtaccataggaccccccccacaattacacggcctttgtgcttaata

SEQ ID NO: 7278 - DNA, 717 bp, Diabrotica virgifera
  misc_feature (68)..(85): n is a, c, g, or t
  misc_feature (157)..(175): n is a, c, g, or t
gcaataatttacatacacaatgttcaaaataaatacgaatataattatctacaaaacaacacttaacnnnnnnnnnnnnnnnnnntgcagtagatttttcaaaatgtacagactgtttgtcataaacttcatgtcatatcagcggcaaaataacacnnnnnnnnnnnnnnnnnnntattgtttagaatatttgcgtcaatgttgggaaaacatatggaacatttatttagtctacgaacaagtgatcgacatttttttaattccactacagttatttataagctagagctaaagattgattgtattaggcagaccatttggaacataacttctttgaatacaactgtagttagttagttaagttttacaaagtcagtaaaagagctaaggctcattatgttccttattggctttctattgcaaatctttttgggctatcttttttagatagaaagtatcaattccttttcttgagttagaatatttagtttgaaacacttgtttttatgtgttttacatgtatcttcattcgaatcccgcttctgcctgagtatgcacgatggtcgggggtcggccaagagtgagaagttgacgtggttaaatatatgacccacaatttggcagatcggtacgttcaccataccgtggaatgctatcgcttatggtagaagatcaccacttattttcatcagaggaaatatgacagcccgacactat

SEQ ID NO: 7279 - DNA, 997 bp, Diabrotica virgifera
  misc_feature (179)..(212): n is a, c, g, or t
  misc_feature (786)..(804): n is a, c, g, or t
  misc_feature (843)..(878): n is a, c, g, or t
  misc_feature (910)..(934): n is a, c, g, or t
agcctagccatcatgacagcacagatagcttagatcaaaaaactggtggagacgtaatgacggctagtactgactctatcgaattccaagcacaaaagtccgcaaaggacaacattatgacggatagtatagaaattaaaccagaggacaaaagttatatggtttccagcgattctctnnnnnnnnnnnnnnnnnnnnnnnnnnnnnnnnnnctacttatgacagattctatagatgaggatggatcaaggattggtggtgtgggagatcatagtagttcgagtacaggaaaagattttagttcatctggtaaagaggatgacattatacaagacaaagatgatatgacaggaagcattagcgtgacgagttctactgctacacacgctacttatcaatacgacactgattcggtttattcccgggagcttgactagtggtggttccaacacaatgggatcctcaactaactctattgatctagctagacagtcgactttcctatatgtgggtgctgctgtacgaaaaaactgggttgatgaatatctcaaccggaaaaaaaatactggagacgcaagattgatttccccacctttttttagcggaaccaaattgaacacccttgatggtgagggctttctcccctattgttcctagaccaaaaaaattacccccccgacagaaaaaaaagaacttttaccgcgaccacggggcgaaacccgagaaaccaaaatagacaaacacattccctcaattttttcttaagggagaagcacggattttttnnnnnnnnnnnnnnnnnnngatagcgggggcacccgacccccccccgaaaaaaaatgnnnnnnnnnnnnnnnnnnnnnnnnnnnnnnnnnnnnggcgcccgcccccccccctcttcccttgcccnnnnnnnnnnnnnnnnnnnnnnnnnacaacacgaacacacaccccccactttttcccctctctcggggggtgtgccccccgcccaacc

SEQ ID NO: 7280 - DNA, 521 bp, Diabrotica virgifera
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (484)..(515): n is a, c, g, or t
tgattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7281 - DNA, 711 bp, Diabrotica virgifera
attattgccatgtttataataataaacatggcaatggtgaagggtcgcattctaatgttttgacagttctcttacgtcagaaattttgacctacgtaatgtgcttttgtagtaaaaatactatattacgataacataaaattctgtatatttccttttccctttatttctttcttcctggctcaatacttggtttaatgacgtaacgtcatgactttctttatgtgggtttatcgcgatagggcttttctacccttacagcatctttcgtgatactgcagaacatttttgagtcccgcctgagcgacgagattggctcacagaccacaatattcatacatatgttacatctgtttgtatcagctcttcgtttcaacccccaggtttttattataactcttttgcagtcccataatagctgtgcaattccgattggaatattaatgagaatattttaagtgaacctggggtctaagatggttaaccttactgcttcccttccaaatagattgagcttcccttccaaatacactaaccaattttggaagaagaactcatagaaaagaagcaaacattttgttattaatcatgttaggattatggtttaagaggagcagtatcaattactgagcccttaggatatttagaccatctagggcagatccatagtatcatctctttaactattatccattaaaagactgttacatct

SEQ ID NO: 7282 - DNA, 486 bp, Diabrotica virgifera
gatcgccgtatgacttctatgaaaggatattccctcgctagaggaatttcagccgctatttcaaaaacatgtgtacctccaatcgaacgtgtaaagctgcttttgccagtaccactcatttcccagcaaatcgctgaggatcattgttaaaaaggaatgggagacagcttcgtacgcatcccaaagaaacagggtgctcttgtaaactaggggtggtaacaccgctaacgacttccgttattttcccaacccccagcccttataatcgccttcaaagacacatacaaagcagaaccttcctgaagcggagaagcactaaaaaaaatcaactctgcgccctacttcttaggtaacttgaactcctggggtgaccgacggagctacctcccctctggtttggataccccaatgaatttccgcccagaaccaggttgcgccgcgacttcgaaaaaggagccggggaaaaggaaatcctcaggattgaga

SEQ ID NO: 7283 - DNA, 850 bp, Diabrotica virgifera
  misc_feature (38)..(82): n is a, c, g, or t
caaattctttttttccttcatatattctagaaaacgtnnnnnnnnnnnnnnnnnnnnnnnnnnnnnnnnnnnnnnnnnnnnnaaaatgtaagagttaagaatttagaaaatatatcggttgatgtttccttgttatgtgtacttatagaataaatttattttaaacactgttgtagtgagcagatagactgtttgattcaaagtttagtgatattttacctatcagaacctagaaaaacaaagttattgtctcctgtaaattccttgagcccaaaatgttgactatacaggttgtcgccgaaaatagtgcgttcctttaaggtatggatataatacacaatttagagcaggaaagtcctataacatttttttctaaagttaaccatttccaaaaaaaaatcacattgttcgccatataagcgaacttttattttcataaaattaactaatttggcatcactgtacaagaactgtttgtgatttagtttattgacaccacaaatgtaggtcagacaggtacacctgcaaaataattgtaccaccccatgtttgaaaatccaacaaaacaagaatttgtttgtttgtttgtttaggatgaagacagggtttaatgtgaatacttatggctaaaatgctgcaactatttttgaattgtgattgtctgtttagatttttgtatacatagttgtcagatttcaatttgcatatcaaaatgtattttggttttttagcgaaacggttgcatttggaaaaaagtgttatgggacttttttgccctacatggtgcctttcaccatacctttaagggacgcactattttcggggacaccctgtatagaaaaatacattc

SEQ ID NO: 7284 - DNA, 373 bp, Diabrotica virgifera
  misc_feature (120)..(137): n is a, c, g, or t
  misc_feature (251)..(269): n is a, c, g, or t
  misc_feature (295)..(313): n is a, c, g, or t
gaaaaaatttggggtatttcaccatttttcccgggggcccccctttattccccctttttttgggggaattttttgcccttccccgggttttttgtctcccccccaaaaaagcgttgggtnnnnnnnnnnnnnnnnnntggttcgaaaaaatccgtgggggggggcgccccgacggggggggtttccttctcaaacagtggtattcccccaacgggggggtaaaaaaaaccccttggaggaggttttctctnnnnnnnnnnnnnnnnnnntctttttccctagggaaggtgatacnnnnnnnnnnnnnnnnnnnttttgcgtttttgttgtgggcggcgggggttatttttctctcccctcttttttgctgccc

SEQ ID NO: 7285 - DNA, 807 bp, Diabrotica virgifera
gcttgttgttagttatgattaatttatatctttctaatggtgaaatattactatataatattaatgattggttagtactacgaaaagattatcgtattgtcggagaaactgtaggaaacgcagtaaatgtgccttctttacctataaaaattattccagaagaagcttgtttactggtatccagaaacgttgtaactatatcagaatctcccaaggaaattgttaaaaccgaagaagatcagtgcaagatagaaaaatatgaatcaacattgttggagtcacaaattatcaactataaagaaactcgaaaacagcaaattgagcaaatagttgatcaggttatagttaaacataatgataaacgaagcagagaagaaattataaatgaaaaattggcacagtcacctccaataacaaaaagtaatatgatatggcctatacagctatctgcctccactagtatagatgaaaatgtaaaacttctaaaggcagaaaatattttaatgttaaccactttgttaaaacgatctgtttatgctgatctatggaatagaggttactatgttacacagggacataaatttggtggagactttttagtatatttgggtgacccagtatgtcatcatgcaatttttatagtaaaatgtatcaataatatgaaagatctttttccactggaattaatttctttggggagattgggaacatctgtgaagaaaagggcagtattggcatctatggaaaatgataaaatttcttatattacaatgagtttggatagatgaggaactctcacctgtacag

SEQ ID NO: 7286 - DNA, 226 bp, Diabrotica virgifera
  misc_feature (81)..(102): n is a, c, g, or t
ccaattttgttattttctccaaaaaacatttccacaaaacatggaccccgctccttgagaaaaaaaccctgaaaaatggcnnnnnnnnnnnnnnnnnnnnnnggcaaaagcaatgaacattctacaacttttccgcccacccccttttccctttttttgcggctttttggcccttcctgctttttcgtccccacaaacatcaggggaaaaccacaaatatccctaa

SEQ ID NO: 7287 - DNA, 463 bp, Diabrotica virgifera
  misc_feature (8)..(333): n is a, c, g, or t
tttaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatcccatgatgagtacctccccatctgctggagtatgatatactcccccgcgactcgaaaccatttcttctatctcatgatttgatcctttaacattctccttaaaatcataaaaaccccctcacta

SEQ ID NO: 7288 - DNA, 858 bp, Diabrotica virgifera
  misc_feature (5)..(118): n is a, c, g, or t
  misc_feature (120)..(310): n is a, c, g, or t
  misc_feature (312)..(330): n is a, c, g, or t
  misc_feature (332)..(410): n is a, c, g, or t
  misc_feature (412)..(427): n is a, c, g, or t
  misc_feature (614)..(638): n is a, c, g, or t
  misc_feature (671)..(712): n is a, c, g, or t
ttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnncaataaattaccttagggataaaagcgtaattttattggagagttccaatcgataataaagattgcgacctcgatggtggaattacagtttataattgcgggaccaactatattattaagtctggtcgatttttaaatcttacatgatctgagtcttaaccggtgggagccagggtggtttctatcnnnnnnnnnnnnnnnnnnnnnnnnngaacaaaagggaccaaaatttatataaatcacnnnnnnnnnnnnnnnnnnnnnnnnnnnnnnnnnnnnnnnnnnggcccggacgcccctaaaagaacccaagctttaagtctccggggctgcgcgactccaaatctttttctattagagtacacacaaaatcaaattccacttgccagacattttaacacggcggtgagaaggggaaaaacccggggggt

SEQ ID NO: 7289 - DNA, 94 bp, Diabrotica virgifera
  misc_feature (2)..(36): n is a, c, g, or t
cnnnnnnnnnnnnnnnnnnnnnnnnnnnnnnnnnnnggcccaggggggtaacatcgaaatggattcccccacagcgggaaaaaccctttagaaa

SEQ ID NO: 7290 - DNA, 126 bp, Diabrotica virgifera
  misc_feature (9)..(30): n is a, c, g, or t
attaaaccnnnnnnnnnnnnnnnnnnnnnngtctcccctgccactgattattttgatgggcgcggtattttgacgtgctaggtagcatatcatagttttttattgaaagtgaatgaaggttggatg

SEQ ID NO: 7291 - DNA, 58 bp, Diabrotica virgifera
  misc_feature (27)..(43): n is a, c, g, or t
cgccctctcacccgaagcactatatcnnnnnnnnnnnnnnnnnagcttgacatctgtt

SEQ ID NO: 7292 - DNA, 1357 bp, Diabrotica virgifera
  misc_feature (11)..(456): n is a, c, g, or t
  misc_feature (459)..(481): n is a, c, g, or t
  misc_feature (664)..(685): n is a, c, g, or t
  misc_feature (699)..(740): n is a, c, g, or t
  misc_feature (757)..(800): n is a, c, g, or t
  misc_feature (849)..(868): n is a, c, g, or t
  misc_feature (1119)..(1143): n is a, c, g, or t
  misc_feature (1212)..(1253): n is a, c, g, or t
  misc_feature (1301)..(1347): n is a, c, g, or t
ttttcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnattacctttagggataacagcgtaaattttattgaaaaggtcaaattgataataaagaatgccaactccaagttggattaaaagttattattggtggaacaactaatataataagtctgttccaaatttaaaaatttacatgactgaatttaaaaccggggggagcccaggtgggttcaaacnnnnnnnnnnnnnnnnnnnnnngaccgaaaggaacnnnnnnnnnnnnnnnnnnnnnnnnnnnnnnnnnnnnnnnnnncaaaccacaacacccgnnnnnnnnnnnnnnnnnnnnnnnnnnnnnnnnnnnnnnnnnnnngctctttaaaggaatccaaagtttacgtaacccgggggatggcaaagcnnnnnnnnnnnnnnnnnnnnggtccccctaaaattcaattcccctgggcccgccctttttaaaaccggcgggggacgggggaaaacccccggggggttccccaactttaatccccctttgcaccaaatcccccccttttcccccccgtggggggaaaaaagaaagaaaaggaccccccacccgctccccccctctcccccacacattttgcccaccccttaaatgggcgaaaggggaaaccccccccctgggaacgggggccattataaannnnnnnnnnnnnnnnnnnnnnnnnaaaacgccaaaggggggaacccgttataatttttttgcaaaggcgcccccaaaaacgcccccccccttnnnnnnnnnnnnnnnnnnnnnnnnnnnnnnnnnnnnnnnnnnctcccccacgtttcttccccgcgccggtttttcttctccccccccctnnnnnnnnnnnnnnnnnnnnnnnnnnnnnnnnnnnnnnnnnnnnnnncccctcccct

SEQ ID NO: 7293 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7294 - DNA, 290 bp, Diabrotica virgifera
  misc_feature (188)..(218): n is a, c, g, or t
ttaagattaatattcccatttcatctcggaaggacaaataccaggatcaattatggaaaaaggtatcgctgccagtagaatacaagaagaggatatgaatgataaagatgcgaccaatggtgataatgatttggaacttatattctaggacctgaatgttataatgtgaatgaatggtgtcgggaaannnnnnnnnnnnnnnnnnnnnnnnnnnnnnntagacataacgttgggaaggatatttgtgaaccctttcctccagaatctgggaagaaacgaacaattatttc

SEQ ID NO: 7295 - DNA, 389 bp, Diabrotica virgifera
caaaatataatttatctgtaatttctttacaaataataagatagataattaaaacaaaatgaccacacagatagatcatgaataggtgagactatgtttctctctgctagtatccttcggaggaaggaagttccttactgtcttacgaaaaaatcgtgatagtaaattcagaacacgatagaagagcgcataccatgctgctgatgctcaacacgaccctgctggtaccaaaggaaaacttttaagtaaagtggacccaagctcattggtgtatgtgctgaacaaactgcaagtccgatgagatatggtgattctcatccagaaaaaagtgaaggcccttaacgtggcgcctcaacgcattttcagagaacaagttggaaactacaaat

SEQ ID NO: 7296 - DNA, 149 bp, Diabrotica virgifera
  misc_feature (15)..(15): n is a, c, g, or t
  misc_feature (27)..(27): n is a, c, g, or t
  misc_feature (34)..(36): n is a, c, g, or t
  misc_feature (53)..(53): n is a, c, g, or t
  misc_feature (56)..(56): n is a, c, g, or t
  misc_feature (58)..(58): n is a, c, g, or t
  misc_feature (63)..(63): n is a, c, g, or t
  misc_feature (65)..(65): n is a, c, g, or t
  misc_feature (80)..(80): n is a, c, g, or t
  misc_feature (91)..(91): n is a, c, g, or t
  misc_feature (94)..(94): n is a, c, g, or t
  misc_feature (120)..(120): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (139)..(139): n is a, c, g, or t
  misc_feature (145)..(145): n is a, c, g, or t
aaattgggagatagnttgaaattggantttgtannntatggatggagtgattnttnangtagngnagatggaaaagtaanatttgaatggnagnatggtgatgaggaatgttatattaanagaatanangnttgtgttnttgatnaaaa

SEQ ID NO: 7297 - DNA, 335 bp, Diabrotica virgifera
atttgtaggtgcgtccatatccgcaccagcaaacgacattaataaagcatataggatgatcgggaaagaatttcatcaagacaaaaacccagcatgccggagacaaaattcaaagaaattaactatgccttcgaagtcttgtcagatcccaaaaagagggctctgtatgacagagtgggcctgcaaggtatgctagagggcgctcacgatggatttggtggagaacgatctattttcacacttattccttggtggtctatttgaaggattccgcggagggagggccgcgttggagactaaaaggtgaagacacggggcatcccctttcagtatcc

SEQ ID NO: 7298 - DNA, 903 bp, Diabrotica virgifera
  misc_feature (434)..(466): n is a, c, g, or t
  misc_feature (607)..(622): n is a, c, g, or t
aacttagacgataatagctccgaagaacccgaaaagaagaaacccaagactgaattgaaagaggaatataccagtcagttcgatgttgagctaggagatgctggcgactggccgctggaatggttctgtgatcaattaagtcaagacttatttagttgtagttgggaaactcgtcatggggcagctacggctctgcgagaggtcctgtctgttcacggatctggagcaggaaaggcaacctatttgtcatcgaatcagatggacctgtgccaccaaatttggctagaagatatggcaataagactgttatgcgttttggctctagacagattcggcgatttcgtatctgacgctgtgatcgctccggttagagaaacgtgtgcgcaatcgttatgcgcagtcatgaaactcatgacgtcacaatcgtgttacgnnnnnnnnnnnnnnnnnnnnnnnnnnnnnnnnnatgcggaatgggaagctaggcacggaggtctcttgggattaaaatatctacttgccgtgagagaagacatgatagacagttttctcccagaaagcttcccgtttatcctactaggactctccgatccagtcgatgacgtgnnnnnnnnnnnnnnnnctgcattaatacccgtggcagaaaaactgactgaccttgtacctgaacgtatcccagaagtcgtcacgaagctttgggacttgttgtccgagcaagacgaactggcagctgcttgtaatagtttcatggggttgctggctgcggtattaaatctgccgaagatgcaggcgttgttgccagcgcaacctttgaatgaaagtgttcccaggttgtggccgtttttgagccacggaacaagttccgtcaggaaggcaacactgcaaactttaagtacattaact

SEQ ID NO: 7299 - DNA, 1095 bp, Diabrotica virgifera
  misc_feature (68)..(89): n is a, c, g, or t
  misc_feature (695)..(717): n is a, c, g, or t
  misc_feature (882)..(927): n is a, c, g, or t
  misc_feature (965)..(992): n is a, c, g, or t
  misc_feature (1016)..(1033): n is a, c, g, or t
cctaggtgtcagtacatatacggaatgtttagatgcctaccgcactcctctaagaacatgctctaggnnnnnnnnnnnnnnnnnnnnnncaataacttacgaactgtatttgctctatttcaacagcaacacagcctagctcgtttgcatcgctgtcccgggtatttggaacattatatgttcaagctgtgtccaacgctgtccaaatatagaattttatcattctttgacgtaattttaacacgaatagttctgatagacatagttctaatttctcatgggaagtgacaaggaaatattaaaagaagcagtaacaatcttggcaaatgaagcacggaaaagaggtctagaaattaacgaagaaaaaacaaaatatctactttgctctagaagagaaaataacaggacgagagaaatcaagatggaaaactacacgtttgaaagagttcaacaattgaaatatttgggagtaattgtgaatggaaaaacaacataatagtaaagaagtaatcttagattagatttttacgtacctttaagacaattatgtacatttttaaattgttctatcgtctgactctgactagataccgcatattttatagaaacaaagcattttagtcaatttaaaaaatgcacaaaatgattttcatttgacactgtctttacttgaatctttgtttttgtacgtatcnnnnnnnnnnnnnnnnnnnnnnntattgtgattagaattgcagtattatacagggtgatcattttaatagagttgtgtcacattatcaataatttttgtttttgttgtactatttcagtatgtctgtaagtatgtaatttacttaaaagatactaattaatgataccaaatacacaaagatattatgnnnnnnnnnnnnnnnnnnnnnnnnnnnnnnnnnnnnnnnnnnnnnngaataccagggttttgaggtccttccctaatatggggnnnnnnnnnnnnnnnnnnnnnnnnnnnngttcaaaaaaattggttattcagnnnnnnnnnnnnnnnnnnggggcaaaacctttggggcgggattcctttggttggaaaacacattaaaaaaactgccccac

SEQ ID NO: 7300 - DNA, 218 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 7301 - DNA, 707 bp, Diabrotica virgifera
  misc_feature (469)..(533): n is a, c, g, or t
gcaaaacaataagggggaacctataactgccagtccggaaccatttgagtacccgccaataaaaaaacggatgttaccttttcagtgaaccacgaacttggtacctacatagaagcatggctgctgtttaatttatggttaaaaaattattttgtgactgtgttagtttatatattgttgttgttatcgctggattaaaacttcaagatgagtgatagtgaacccgcaattgcttttaaggatcttcctctaacttttaaggtgaaatatttaggtcgacatccagccaaaggtctctggggaatgaagcacacgaggaaaccagtagactacttagtatctcaggcaaaaaatcttcctcccgatgtcattctccctataatcgatttcaaagtcacccaagacggcgtcagctatgttgagtccgcaaataaaaaagtagaatcagagccagtgaagtttgctgtgnnnnnnnnnnnnnnnnnnnnnnnnnnnnnnnnnnnnnnnnnnnnnnnnnnnnnnnnnnnnnnnnnccatctactttcaggcattctctgaaggtgtccatagcagttgagtcttttggcttcgattgtgtctattatatctaaatcgatttccattttctctcctaatatccttcgttctcaccctatcaagggtagagaaccggccacatccgtcctccatagttcatttcccctggc

SEQ ID NO: 7302 - DNA, 316 bp, Diabrotica virgifera
  misc_feature (2)..(60): n is a, c, g, or t
  misc_feature (72)..(93): n is a, c, g, or t
  misc_feature (285)..(303): n is a, c, g, or t
tnnnnnnnnnnnnnnnnnnnnnnnnnnnnnnnnnnnnnnnnnnnnnnnnnnnnnnnnnnngcctttcgtacnnnnnnnnnnnnnnnnnnnnnngatagaaaccaacctgggtcacaccggtttaaactcagatcatgtaaaattttaaaagtcgaacagacttaataatatagctgctacaccaattataaactttaatccaacatcgagggggcagtatttattatagatttgaactctcccataaaattgcgcggttatccccaaggggggttattgttatannnnnnnnnnnnnnnnnnnggggggggaatct

SEQ ID NO: 7303 - DNA, 612 bp, Diabrotica virgifera
agcgtaccgcgattggattggactcgttttttgttgcatttcatcggtagctatacacgtgctgcacgcacttttggaggtggcggttcgcgtttggttgtgacactttgtgattttgatttttgctgttgtttggttttgtgcgttgtggatttttggacatagataattatcaatacgtctccagtcatcaataataaatcatgaattctaacgtgctttttgtaacgttggcgtttttctgtggcgtctttgtttgttcagacgcttgctcctgtatgccccagcacccgcaggaacatttttgcaattcagattttgtgattctggctagagtgaaaagggaacgaatactgggagacaccaaagtctataaagttcgtgttagaaaggagtacaaagtctcagataaaggagtactggcgctgaaatccggcagactgttaacacctaagtatggtgcgatgtgcggtgttgatcttgaagttggcaaactttatgtaatatcaggcaacatccttaccttaaaagcacaaattaacatgtgcggtatgagaacccaatggaatcacttgaccaaaagaacaagggaaaggtctaagggtattgtat

SEQ ID NO: 7304 - DNA, 533 bp, Diabrotica virgifera
cccacgcgtccgggttttacatcaaacacatcaacctcctctaaaaatgaatgcattcactgtagtttttgctcttggagccctagcctgcgtcaacgcaggagtagtttccttagcccatggatatgccgctccaggtgtaatagctcagtacgcactcccctacgcagctgtcctcccatctggtcatggtctcgaaggacaatacattccagacaacctagaaaagctatacgacgatggctcatacagacctcaacttagcgctctcaccctcagcccaagcccctatggtttgactccatctggatcaggattggaaggagcctacgtacatgacaatcttgacaaattgcacgatgatggatcatacaaacccgaactccaggctttgcctttgagtgttagtcctttcggtttaactccatctggatctggtttggaaggtacttacgtccatgaccacagtgagaagttgtatgatgatggttcctacagacccggcttgtatcattaaatgttagatttagatc

SEQ ID NO: 7305 - DNA, 741 bp, Diabrotica virgifera
  misc_feature (644)..(673): n is a, c, g, or t
cctgaaattattttttttgcatggaacaattttttttaggttttttggatcattacaaacagaaaagatatttagtgacttttctctaaagttgatagtttttgacatataagcgattaaaaattgaaaaattgcgaaatcggtcatttttaaccctcaaaaactatgtgaaaaactgaaaatatgaatgttgccgaggtaggtagatattcactaaacatcgattgatgaaatcccgaagagttttttgcaatacaatatcaaaaacccctttgttttttaattgccaatcaagcgtgcgttggtggcaacgttgcgctgtgtgtgtgaatattaattgtattttgctcctgcattaaacccgtttttcgcgaaatgcagagtaaatcaattacaacaaacgcataaagtgtgaagttaagtgagtaatcttcgcgctgaacgaaaaataataaactaaatattgaaattgtgctccaaattggcaaaaatcaaaggtaagcgtaacacataaacaaataaaacgtcatcgatattacgatattcgaagtggattcttgtttgattggaacgcggtgttgccaagtcgacagggaagtcctgtaagtagggaggagcgaaatagtatatagtgctcaatatannnnnnnnnnnnnnnnnnnnnnnnnnnnnngagctacactgagaaaggttaagtttcccgcggagatagtccgaacgagacctttatcgcagtaaaac

SEQ ID NO: 7306 - DNA, 693 bp, Diabrotica virgifera
gactattggagacaaacgagcgctacgacctttcattatagaaatgtatggatgtattaaaaagaacactgtgttgatcagcaatcaggggaaagaaattacaattttctatgagaaagtgtaacgaagccacaaattataaacacgaaactcccggagtttatcacaaagcaagaggagtgcgaaaagatctcgcgaatacaacaagatattgatggaaggctcagagatcgagccatgaatgcaaccatgctcattaaggaaggtggcggcggaggatcaggtgacgagagaggaggaccacaagcaaaagaagaagttgaaagacttgttcttgtgaaactagacactttcaagcttgaggacctacactcaaaagttgacaggttttctgaacaagattccattacaatgaaaaccataagagacacgaagccgtatactaactcaaactctcttagaggatagaagtttgaccaagcttgccgacttggaggcacgaacacaagcgtagcttagacaggttgagtaacaatgaagaaccaatcaacaatttggtaagcgaacacagagttactaagagaagctgcctgaacactttcaaagaatctgtacaaaaggtgtggaaagaatttgactcccaaaacatgactggatttagaaaacctttgggggactaagacaaacttacta

SEQ ID NO: 7307 - DNA, 266 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(241): n is a, c, g, or t
  misc_feature (243)..(245): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnncnnngaaaaaaatgaacaagcaaag

SEQ ID NO: 7308 - DNA, 911 bp, Diabrotica virgifera
  misc_feature (42)..(62): n is a, c, g, or t
  misc_feature (126)..(146): n is a, c, g, or t
  misc_feature (216)..(236): n is a, c, g, or t
  misc_feature (277)..(294): n is a, c, g, or t
  misc_feature (380)..(398): n is a, c, g, or t
gaatttgaaaagtcatttaaggatacacactggtgtaaagcnnnnnnnnnnnnnnnnnnnnnctaagcagtttactgtagcagacagtttgaaaaagcatttgagagtgcatactggtgaaaagcnnnnnnnnnnnnnnnnnnnnnctaagcaatttagtcaagatggagatttgaaaagacatttaaggatacactctgacgaaaagccttaccnnnnnnnnnnnnnnnnnnnnnggttttctcagacaagtcatttgaatacacatttgagattnnnnnnnnnnnnnnnnnntcatgagtgtgaaatttgtcttaagcagtttaatgaagcaggtaatttgaaaggtcatttgaggatacacactggactaaaaccannnnnnnnnnnnnnnnnnngtaagcaatttagccaagcagctcattggaaatcacatttgagaatacatactggagaaaaaccttatcagtgtgaaatttgtttgaagcgatttggtgaaccaggtcatttgaaaaggcatttgagagtgcatactggagaaaagccttataagtgtgaactttgttttactcagtttactcagtcaagcagtttgaaaactcatttgagatcacacacggaagaaaagccttagtcggcaacaccgggggggagggcggtttccgcttacggttaaaccgcgcggagccgcttttaaacgttttcaaaatgaatgcacgtctttaaatgtacacgaacatagtaaaagcaggttcgcgcgggccaaccgctttaacctgccagaccgcatttactagaatgaaaatttagttttttccgcgcggttttaatgtttactcgaatgagaatttagtttattccctctttttgtcgcgcgagttcagtgattttacaatgaatatgtaaatatg

SEQ ID NO: 7309 - DNA, 737 bp, Diabrotica virgifera
ggttacctaaagcgttcctttttagacgctgtaagcatccgacaaaagaataagctactagctacattcgcgctggcatcattgcgataagcacagtattgataatgtgagacgagacaaggattgtgtaataactattgacgactggtgtaaagatactataatgatgacgaagaacttagagcgcggtgacagctgtagtcaacgttggctcgtaagaatcatggataagaggggcataagtttcccgcgaaacgtatagatttacaatatatcacttaacggttgagtcgaagaaaagattgagcgctggaggtgtatatgatgataggaattgattgttctttgaaaagagaagaataaaatgaggaaaatgaatacagtgtcttaagctagggcccgcaaatctgtgtccccttggtactaaaagagcacatgatgatccgtaactactgctgacaaattgtacgttattaccaaagccgattgaaagtgaggatgatatctacactgctgcctacactcatatagttctcccagataacacttatgaagcacatatcgatggtgaaataagtaaaatcgagttgaacgtggaagagttgtatttgcgatctatgtattccgcccaccaaaaattaaagaaccctaaccccatttgaccacaaaaagtggcaaggacaggggtacctatttcagacccacatgacttcaaatctgaagattgggcccaagcc

SEQ ID NO: 7310 - DNA, 594 bp, Diabrotica virgifera
cttatttcgatttgactatgtgatggattgagaccttaggcagagccttaacgttgattgccgagtcaagacctgtaggcatctataaaggcgactatatacaagaattatatgcaagatatgatgatgtcagtgatgctccacctccaccatctcttcctgattggtgtacagaaagtgacgatggacaagggaatggccttgacgatttcgatgattttactgaagatgcaagaaaacgagtagcttcaacttcttcaaataatgatgatacttcaccaaaagctaaaaagggtcgcttctaggaagtcgcatttatggagggagtacctaacgttacccactttgtagaggaacaagcgacccgagattgcaaacgaatggtgcctaggatgtgtaggtgtacaccaaaatggtgttccaggaagtcatgtccgtgtccaatggatatgacaaacattactcttctaaaagaccacccctacagagtttcctgcaaagcagacggccatgaggcattatgaagcttatcaacggagaacacaatgtttatctttttgacagagatgatgaagcttattaaggcggaaggca

SEQ ID NO: 7311 - DNA, 981 bp, Diabrotica virgifera
  misc_feature (373)..(392): n is a, c, g, or t
  misc_feature (847)..(847): n is a, c, g, or t
  misc_feature (921)..(921): n is a, c, g, or t
gacaaggaaagattaaaagaagcagtaacaatcctggcaaaagacgcacggaaaagaggtgtagaaattaacgaaggaaaaaccaaatatgtactctgctctagaagagaagataactggataagagaaatcaaaatataaaactacacttttcaaagagtcgaacaatttaaatatttgggagtaatagtgaatggccaaaacaagtgaagtgaagaactaacggaacgaatactagcaatcaacaaaacgtactggagatatcataggcttattaaggacaagaacttatccagaaatacaaaactgagaatatacagagttgcaatcagaccagtagttacgtacgcagctgagacaatgtgcctcgcgnnnnnnnnnnnnnnnnnnnngagaatattcgaaaggaaaatcttcagacggattatgggcccgataagaatgatcaatggagaaatgagaaggagaatgaaccatgaactaagagacataatgaaggaagaagatatagttagatttattaaagcacagaggctaagatggctgggacacatagagagaaggaaaaacgaccgactgattaagaagatcaccaaatggaaaccagaatcttaaagacaaaggggagacccagagagagatggaaggaccaggtcatgagagatattgaaatgctggaagtgagaaactggagggaactatgcacaaatcgaaatgagtgaaagaaaattgtaacgaaagccaagtcatacaacaaattttgacaacatacaagtggaatgcggagtgattcaccgcaataagcgaatcagagagctctaagtaagagtggcaaacattccacccngaaatgaaagccctgatgatcatgatgtataaaaaatatacagtgttttaatatttgaccgacaccggtctacnagagagctcttgctatatggtgaaatataaggaaaggatccacaaaggaaaaagttttcc

SEQ ID NO: 7312 - DNA, 86 bp, Diabrotica virgifera
ttcccggggccccctatttccccttttttgggatttttctctttccttttttttgtcacccccccaaaaacgcctgggggaagaag

SEQ ID NO: 7313 - DNA, 727 bp, Diabrotica virgifera
ctgaaaccgcatgctgctggttatcgagggcctcttatcgacagctgctgatgcgacacactgtagaaacatctgctccacctgcttcctatgccactacttatacacgaatcaactacctcacagtctggacaactggcatcaacgtcagctgctgtctctgctgctaccgtggggaagcaaacagcgcagtactcggacgcgtaccagcccactgcaacagcttaccagactacctacccccaaccagctgctgcacacactacagtagctgctcaacctacaagcacaagccaaaacgatacgcatgcatgccctactattcatcacctaccatggatgtaatccgacagacacgcactgcccaacataaagctgtcggctggcaagactaccagaaaccaggtatcgccgccaaaactgcaagaccaaaggcacccccaaaacctcaacagttgcactatagtgatgtttgcaaaatcaactgtgctgacccccagacttacacagaacatttagaaggacaaaaacacgagaaaagagaagcagccactaaaatggcagtctctgctgctgttactactcaaaatcgtgctgcgaattctctaagatgtcagttatgaagatgtaacttgcaccggtaatgatgcttatgctgcccacatccgtgaggagaaacatcgcaaagtgctattgctacactgcaccataggccaagcccctacct

SEQ ID NO: 7314 - DNA, 281 bp, Diabrotica virgifera
  misc_feature (5)..(40): n is a, c, g, or t
ttttnnnnnnnnnnnnnnnnnnnnnnnnnnnnnnnnnnnncccggtatagtatagcaaaaacggcaatccgctacaatgccccaccaagtggggggataacaatttgatataaatgtttaacaaattccaggagccgctttaaagtccagcagttgccgctattttataattcccttaataataattgttaatttatccttttagaaccccccgcaaaaccttgcctcttcccgccaaataatttattacataattctttaccaacagaaaatcccccttt

SEQ ID NO: 7315 - DNA, 630 bp, Diabrotica virgifera
  misc_feature (90)..(109): n is a, c, g, or t
  misc_feature (131)..(151): n is a, c, g, or t
  misc_feature (290)..(307): n is a, c, g, or t
  misc_feature (334)..(351): n is a, c, g, or t
gtaacccacaaaaacatgttttggcggaaaacgttttttcgcttgtaatcatatttaagatcagaaatgtactttttattgttggatgannnnnnnnnnnnnnnnnnnngaggataatataatatcttaannnnnnnnnnnnnnnnnnnnnggctataaactgcgatatataatcggtttagtggaacaaggttgtaacatcactgaaattcatcaaaatgagttggttacaaccttttaacattttgtgtagaaatgtatgggaataagacaaaaacatgactgcttgnnnnnnnnnnnnnnnnnngttttcaaggagcacctatacctaccnnnnnnnnnnnnnnnnnncctacattattaacaaagataaaaaattgatttttagttttccctaaaaattccctatattctcgattaggaatataagcacacatatccgctaagttgctttttgtttctttctttactggcaaatgattcttatacaacacaggaagactaatccaaggtcgcaatacattgtttatttctcggcataatagatttgtgggatcatcactgggaattttgtaccaaaccgcttcagctattttaatccttgcttttcagtaaagctgacttgactat

SEQ ID NO: 7316 - DNA, 701 bp, Diabrotica virgifera
gaatttatgaaaaatgaaacttgtacggtggtctgtacaaagcaatactctggggataaacctgaagataatttgaaacttggtaggttaaggaaaggtataagtctgaactaccaacatcattggattgttgataatatgcctgttacaacttgttatgatgtcgacgattgtagaacaggctttcacatggggtgctattctcgaaacggaagacataattgtgtaaaagaagatgtgggaagagatgatgcttattatatttacaatcatgttaatttaacaattacatatcattctggagctaaagaagagtggggtagccaattccatgagaatgggggaagaattatatctgttaaagttgtacctaggagtattgattacaaagggaagggatgttcttcaggcgatttagaaccacttatgataccaatgaaaaatctaaagactggagaaaaattccaaattatctacacttacagtattcactttgtaaaagacaatgatgtgaaatggtctttcagatgggactacatattagaatccatgccacatactaatattccatgggttagtattttgaattcgttaagtattgtactgtttttgtctgggaatgggtgctaatgattctgttaaggacatttttataaagatattgctaagatattaatcaaattggtaatgggggaaaatgc

SEQ ID NO: 7317 - DNA, 744 bp, Diabrotica virgifera
  misc_feature (658)..(678): n is a, c, g, or t
cacttttactgaaattttacctgcccgttttggtattttaccggtgcggtggttgagagttactcaaggttttgttacgaagatccaagataccaaaatgccgactattattgtctattcctacttcattaactcgaaatcgggttgaagaagaccggctttgaccagagaaataactaaacggcaacatggggggccccaggaacgaatatcactcgcccgaggagttcccaatgaaatcacttttccgtttgaggctattactgtgaaactaaaagagggatccaagtttgacattgtcggcccacaaataacttccgctctgcgggacattccaacccaacggtattccagagttcgtgaaatcggtcaagacccttaccccaaaacgcacataacccccctcgggtggcctaaatcatgaactcctgataactaaccgctcccccccatggcaagagacctggtcctcgacatggttttggggagagaaatgttaatactggtggggcacaaaaccttattattgctggaaccgcggccatcctcaaaacccctcgacgggtaccgctatgggaattgacccacaataaaatttagaaaacgttccccccaaaaacccttcctcgccgtggcgaaagagcccaaaaataccccnnnnnnnnnnnnnnnnnnnnnttgggccgcaattatcttcttttaaccgcccccgtccgatccccccccccccccactaccctcccc

SEQ ID NO: 7318 - DNA, 144 bp, Diabrotica virgifera
cccccccttttgtccggcgggaggcggtctagttgatgtgaggtcacccctgcccccgcggactgaaaaataaaaaggctaacgcagcccttttaacttctcaaatcaaatcctacgacttatactggtatacattgggctctg

SEQ ID NO: 7319 - DNA, 960 bp, Diabrotica virgifera
  misc_feature (10)..(715): n is a, c, g, or t
  misc_feature (717)..(751): n is a, c, g, or t
  misc_feature (758)..(794): n is a, c, g, or t
  misc_feature (862)..(881): n is a, c, g, or t
ttttgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnntaacagnnnnnnnnnnnnnnnnnnnnnnnnnnnnnnnnnnnnntgcgacctcgatgttgggataaagtttataattggtgaaccagctataattaataagtccggttcgannnnnnnnnnnnnnnnnnnnctgaggttaaaaccggtggggagccacggtgggtttctatcctttaatttaattaacaatttttaatcacgaaagggcc

SEQ ID NO: 7320 - DNA, 488 bp, Diabrotica virgifera
tcccttgatcaactccatgatcccctgggatcactccatcgaatggtccgttgctaacttcgctagcaaaggaaacagatctggagagttagttgtcgacatcgatcttactaaagaagaagaccaatatcttgaggggcataccattgacggaagagttttattcccagctacaggatatttgactcttgtatggaaaactttcgccaaattgaggaacgaatattacgagcagttccccagttattctagaagatgttcaatttcacagagccacccttatgcccaaagaaggctcagttaaattcctgattaacatcttcgaaggaacaggagaattcgaactctgcgaaggaggttccggtgctgtctctggtaaaatatctgctccagaagatgtcagaacagaagtgatcacccctaccaaagcctgtagtttgaaacgagatagatgtcttaccctctggaatctccttgaatcccactaa

SEQ ID NO: 7321 - DNA, 200 bp, Diabrotica virgifera
  misc_feature (52)..(52): n is a, c, g, or t
atgcggtgacgcggaacccttatccgcacgcaaaccctcctttgtcctcagngctcaagaaagatatttctaaaaatatagtatgatattacgacatcctacaggacacagtgttttatagatttttgtaacgtaactctgacaggaagattataaaaactaaatatagcgagtgacaacagggcactattgagttcatt

SEQ ID NO: 7322 - DNA, 909 bp, Diabrotica virgifera
caccttaaagttaatacatattcacaaaaaatgaacggaacagtattttttcaaatactcataatcatgggaagaatggcttcatatagtgggtttttctttgcttggcctagtaatttggccaggtactgtagtctccttttagctcgatacacttgacccagcgatgctccaacttctttaacccccctgaaaaatatcttttctcgaggtctgcaaagtaatctgccgtggcggtgataaactccttattcgacttaaatttctgcccggtgagtgactttttcattggatacaaaaagaagtcgtactggtataaatctggagagtacgttggacggaacagcagtttgtagcccaattcgacaaatttggccatggcgatggcggaggggtgggccggagtgttgccatggtggtagagtattttttctttcccaattttgctgtgttttctgaaactcggcgtcgaatcgggcttataatgcagcatagtaaagccttgtgatcgttttgttcatttccaggaagtggatatagatcatacattgtgaatcccagaaaatgatggtcatctttccggccgattagacagtcttcgccctcctcggagaacgttccactgtaatgactgttccttggactctggtgtataccagtgaaattatgtttagtcgacggttatgaaacaacgtagagactcttttatattattgcttaaacaacgtcatacactattctgaagtgggctcccggttggggataatttgttcgaacgtcggaaaatgcgggcagccatcgaagggcccacctctttttttattgtcccaaatggtctctgctataattcgacctccccctaatctttctgtagctgtcttacctggccgcccgtcccccctccacccc

SEQ ID NO: 7323 - DNA, 341 bp, Diabrotica virgifera
  misc_feature (8)..(8): n is a, c, g, or t
  misc_feature (13)..(14): n is a, c, g, or t
  misc_feature (41)..(42): n is a, c, g, or t
  misc_feature (49)..(49): n is a, c, g, or t
  misc_feature (95)..(95): n is a, c, g, or t
  misc_feature (154)..(154): n is a, c, g, or t
  misc_feature (217)..(235): n is a, c, g, or t
  misc_feature (237)..(237): n is a, c, g, or t
  misc_feature (267)..(289): n is a, c, g, or t
ttggaagnagaannatttgatagtattgaaaatgtgaaagnnaagatgnaagataaggaaggtattgtattagattaggaaagattgatttttgnaggtaaataattggaagatggaagaaagttatgtgattataagatatagaatagagttnagtctttatttggtatttagattgagaggaggtatgtagattttagttaagagattatgtggnnnnnnnnnnnnnnnnnnngnagaaggatgtgtttttgttggggatgtgtnnnnnnnnnnnnnnnnnnnnnnnggcctccccccagatttttttttattgaggggtggggggactttgttttttg

SEQ ID NO: 7324 - DNA, 259 bp, Diabrotica virgifera
ccgattgcgtacattacttgtaacattttcttatcccttttttatatgaatattgtaattatatttttatagaactgaacattattacgtccatgtcttagacaggtcaaggttttttctgaggatccagcttcgatggataacactcaagtaatccgttgtggcatgctaaagtgttatcttatactttagaccgagcgctgcatatcattcccccaaaactgccattcatccttctcttcccactgtcatcgtcgtc

SEQ ID NO: 7325 - DNA, 542 bp, Diabrotica virgifera
  misc_feature (237)..(259): n is a, c, g, or t
  misc_feature (332)..(346): n is a, c, g, or t
  misc_feature (356)..(379): n is a, c, g, or t
  misc_feature (414)..(435): n is a, c, g, or t
  misc_feature (448)..(470): n is a, c, g, or t
gtgacaaattagagcggaattttataaaaaaaaggacccatattttagacaaaatggcctctgtaactcataagtgtgtttacgcgggatgttttgaaagaaacgatggaacaaataataatatatctttctttaaatttccactgaaagacgtagagcgtacaaaaatttggcaaaaaaactgcgggaacattgatattttattgatggatatcactgaccttatacagagggtannnnnnnnnnnnnnnnnnnnnnnggaacatatttaccaaagtggccaaagaaagttattaaggaaaaatgctgttcctctaaaatttacacagttnnnnnnnnnnnnnnntgagtactcnnnnnnnnnnnnnnnnnnnnnnnngcctaatgcgctttgtcaatgagaatactacaatnnnnnnnnnnnnnnnnnnnnnncagtggatattgnnnnnnnnnnnnnnnnnnnnnnnattaaatcaaaagagattttttttaaatatgaatgcgttgttactatcactccagaaataatgatgatgctt

SEQ ID NO: 7326 - DNA, 452 bp, Diabrotica virgifera
tttcgtccgaatttaatcttgctaaactaggactaggacctacttacaaaaatcagtattattaactatacttgagaagattgaatcattaactgatataaaattaaatgataacctaaataaacttcatctacctctagttaagagcgaggccccattactgcgttgtgttgcaacgtcgcaacggaacaacgcagacgcgatgcagatgcagatgatagacgcgacgcagcgcaacggactgatgggatgaggcttcgtcccaatgatcagttacaatgattcaacgaaaagggtgtgttctttgatgtcagtgtcgtcgcaaggcaggtgggcatacaatgcgttgttacgttgagacgtcgcaacgcaacgcagtaatggggcctggcaatgactcagtgctggttggcgtccttgcaacgtcgcaacgccaagcaatgaaacgccac

SEQ ID NO: 7327 - DNA, 634 bp, Diabrotica virgifera
  misc_feature (80)..(98): n is a, c, g, or t
  misc_feature (590)..(606): n is a, c, g, or t
ccctttttcgcccacgcgtccgtttacagtgtgtggaaaggtgtgaccttgtttgaggtgccggtgagaaaactcaatcnnnnnnnnnnnnnnnnnnnggtcttcattgtattttaagccttaattactacttattaattcactctccggtacgtgcttatagataagaaaccgattttcgattaatacagttggtaaaagacgaagattgttacaagacatagccgtgggaacaaaaggggaaaagggctgacaatatcgaaataatctggttatctacgtcataactctcctgcgaggtggataggcaaaggaccaacggtttggccaccgcgatcaccggaattgttgagcattgattttttcatgtggggctgtataaaaaaccttttgtactaagcctccaacaacaccagatgatatggaaaatataataagggaacctcttaataatatttacttacaaatgctagaaatttggctcggtcgtttgaatatcggttacaagcttgcatactccttggaagccgaaattttgaacatttactttagactaattctttaatataacatctataaattgttactannnnnnnnnnnnnnnnngtttatattttgtattagttatttattg

SEQ ID NO: 7328 - DNA, 820 bp, Diabrotica virgifera
ctcgagcggaatggactcagacacttctgaatttgctcccatcttaagactggataccgcagaaccaacaggatgcgccttattcacagaaactagtttaatagtaggagctgataagttcttcgaaattgatctggaaacttttcaggccgaggaatttctggatgcttcggatgctaaactgaaacaagctcaaagttgttacaagatgggctcctttcctttggctatcattcaagtctgcaaaaatcccaaagaatatctactatctttcaatgaattttcagtattcgtcgacgaatatggcagatcaactagacaaaatgaactgaaatcggatcacttacctttatcatttcatttcagcaaatcctatttgtatgtatgtcaattttcagctgtaggaatcctgaaaatatcagaagaaacttgcaacaacgacgaaaaaccagacattgttcgagttgaattggataaatttaagtatttaggttcaaataaacagggtatattcataaggtgtcaacaatgaaggtaagtttttaaatggcaatgaagttattcctttggacgaaagttctttggaaattgacaacttctgataactctgaagaaaggtttacttttatcagttcgattgtaccaaagttggatgggaaattgaatggtaacccaagcggggaaaataagcccaagagggttagcgttttcagaaaactgaatttgtaacggtggtcacagggtcccggacaattttcccacgccaccttaattattttttagtcctttgatttattttaccccggagcccataactccc

SEQ ID NO: 7329 - DNA, 938 bp, Diabrotica virgifera
  misc_feature (7)..(25): n is a, c, g, or t
  misc_feature (416)..(428): n is a, c, g, or t
  misc_feature (430)..(443): n is a, c, g, or t
taaaaannnnnnnnnnnnnnnnnnncaagaagaagagaaatctgacaaatccagcagcaataaacccaagcaacagtttaaaggtggcaaagttcgacagaggcctaaaaaacttaacgaagatcccacatttagtacaagtttatcaacccccattgaagatataatagaggaaacaatcaatgaagaagtagcagttaataagaaaaaaggaaaatcatccaaaaagcaaactgaagaattgccagtgaaaaaggaaaaacccacaaaagatctagatgatgacataggttattcatttttcaaagttaaaactgtttccaaaggaaatccagaagccaagcctaagaaacaagtttctgttgacctaaatgaagataacacagcagatgatataggtttctcatttttacctnnnnnnnnnnnnngnnnnnnnnnnnnnnctaagagtaatccagaaaataaagaccaagaactgactttaaacgcagtggtagatcagacactgaggaaagctaaatatgatacatcaaagccgtcaataatagaacattacaaaaagagaacaactgacaaagctttttccaaaaaggctgcaacaaaatttgaaagtccttcagtatctacaatcgtagaaaagagattgttgtatgaaagcaaacttaaaagtgaaactaaggagagcaaaaaagttacatcttctatttcctttgctagcatagtcagtaatgctactgacgccccttcaggttctgatattgaacaaaatccccagttactaaatggacctaagcctgatattcaacagcatatcctttgagtctttaaagtcagtaaaatctagtgctgagtccgtagaagtaattgatgatagcaattctggatatccaaacagtcaatcccccaattttgaaacatccaaagaaaaattaatactt

SEQ ID NO: 7330 - DNA, 933 bp, Diabrotica virgifera
  misc_feature (539)..(589): n is a, c, g, or t
  misc_feature (798)..(798): n is a, c, g, or t
  misc_feature (889)..(889): n is a, c, g, or t
aatcattgtaaaaacaatcaagattcgtaattttaatatgaaattaatatttgtagaattactacagtttataatgtgtgattggtttgaaaaaattgctaaactcttaataaactgtcattctcctattattgtgtgtttttgtgttgtatcggcactggtttaatcaccaactggccagtcaattcctattattggttaccacaataacaactctgttacaaatttaatgctactagtgtttctggttggaaaacaactgttttgtttaaataatctgcctatcattgaaaatgtcaacttcttaatgtcaactttatgtatattcaatggtacctacaaagatgtgaataatattccaaaatttcaaccagacttttgtgtgtcgtgaatataacaacatggtgttggcacatttcatatttttgtttgtgtttttccttattcataaccactccaacggacaagacgtttgtactactcctggtggaacagagggaagctgtattccagcactatcatgcgaacctttaaggacnnnnnnnnnnnnnnnnnnnnnnnnnnnnnnnnnnnnnnnnnnnnnnnnnnntgaggcttatatttgcaaagaaacacataaggtatgttgtcccaaggaaccaataatcataacagaattatcagtccggacgtccgacaatgatgaaagtccgactgaaactataactgatattactaaacataaaaactatggactattgccaactgattgtggttttgtgaaagattcttcctacgtattcgacataagagtcgtanatggagaagatgcaggtctttatgaatatccctggatgagtctactgagttttagagtacctggtaatataagaaagtttagatgtggtgnatcaattattaacatagatatatccttacagcagcccattgctt

SEQ ID NO: 7331 - DNA, 813 bp, Diabrotica virgifera
  misc_feature (34)..(58): n is a, c, g, or t
  misc_feature (337)..(359): n is a, c, g, or t
ggtagttagctgactgcgtggagctttttgctcnnnnnnnnnnnnnnnnnnnnnnnnnatattccaaatgaatatgtttcaaacgccgaagatattgcagataatgttatcaattctgcctgttagagcatatacatatagctattgggaccgtgcaagttcggaagagccacacctagtgtcatagcatcagcaacatttttagcacttttaattatattggccaattatattattcctggttactggataattgtcaaagccatagcccaaaatagaataagaagaaaaagtaagattgaggttatgttattaaaagataaacattgtacgtagnnnnnnnnnnnnnnnnnnnnnnngcagtactacaagcaaaatacaattaattaaattcactttaataattgcatgtcatgtccatattgtggagcagtatggatgtgatatgcaattatatcaatatgcaattatatgcaatatcccattttcttcaatgacagtgggtatgaaatacacgtcagtttgacaatttcgattgacagtatgaattatttaagaaatatgttaagaaagttgcaagatttctccgctactcgcgcactatcgtttctcgtatcccctccaagtacttgcacacagcgaataacaatcaagtaataattataaatattaatgatataatactacataataatcacttttgatacagcattccaatttttaataaacgttgcattcttggattttagatttccctagaagtttagcacaaatagtctattttacgactttctcccccatttggatttatcg

SEQ ID NO: 7332 - DNA, 788 bp, Diabrotica virgifera
  misc_feature (49)..(85): n is a, c, g, or t
  misc_feature (184)..(206): n is a, c, g, or t
  misc_feature (636)..(659): n is a, c, g, or t
aaaatatatttttctttataaacaatactttttagcatgtaaaaaatcnnnnnnnnnnnnnnnnnnnnnnnnnnnnnnnnnnnnnggaatcagattccagttataaattccaattgacttactgagaaggaactccaagtattcgctgatgccgaataaggtttataacaaacaactgagtatnnnnnnnnnnnnnnnnnnnnnnntctgctgtttttttttggtgtattttcttgtggcgtataaagtaagccacgcgtgtagttatgttataatttgatgcgcgagtagttaaaggttaatgttttcatttaacttgtttgcaaataaatcattatgcttgtgcagagatcctttggaaaaacaatatataaactcccatcttcattaaatattagaaattgtttactgttctatgtgttcatgacactacttggagataattggatgactttcatcttaccttcgctccttgagcgtctattcatttatagtcacatatttgatcttgaacatcgaacgccagaagatactttttactaaatcagtatcagtctacatgctgctttctttattagaattatatcttttcaatggttgagtaattaataaactaatgcgacagaaggaagtagnnnnnnnnnnnnnnnnnnnnnnnnatcagattaggatttaaaatttgtagagaaaacgaaaattgatgagatacataattatgctaattttgaatatcagtaaaatttaaatcggtaaaaacatcgggtatgaaaattatattattcatcttt

SEQ ID NO: 7333 - DNA, 944 bp, Diabrotica virgifera
  misc_feature (28)..(50): n is a, c, g, or t
  misc_feature (372)..(393): n is a, c, g, or t
  misc_feature (548)..(582): n is a, c, g, or t
  misc_feature (736)..(755): n is a, c, g, or t
  misc_feature (849)..(849): n is a, c, g, or t
agtgcctattatcggtaggtactttacnnnnnnnnnnnnnnnnnnnnnnnttcgcaaagtaccaaccaaccgacgcacttcctggtttattgtgctgatactaatgttaaagcgcttaaggtgttgcgcaaacaaattttctaattgcttttaaaattggactatttcatacaatattttgtatattatagctgcaacaattttaatgacgacgccgtttgcaattgtgaaatccgtacgaaattgaccgctactaataaagcaatttagcatttcagaaggtttttctacaattttcggatttaaaaagcgtaacggattcgactagaatagaattaatctctctctctctctctaccgttctaacggagnnnnnnnnnnnnnnnnnnnnnngatatccgacgacgatgtaaaactttcggagaaagttgaagcgttagaaaagtaggccgtgtactgaatgcattcacgttcaaccagtggcgcctcgtcaagaattatacattcgactaaataaacaatacttcaatttaactcaataatatgcnnnnnnnnnnnnnnnnnnnnnnnnnnnnnnnnnnnacttatacatttgtaatcctgtgcttaataaggaaatattcatgaaattaatttacaactttttatttttgaattacgacccgatctataaataagacactctacgttagggttatcataattgcaattatgtagagttcaaaacagttatgannnnnnnnnnnnnnnnnnnnatgtaataaaaacaaacttattttttatgataatatataaaacaatattacacaatgtttgtacagtacaatacagtacattttacacaatatngtggtgtctggctttacaatttgttccttgacatcgtctctgccttgaaaatttccatgaagtgtccttttccatctaaatctactactactact

SEQ ID NO: 7334 - DNA, 947 bp, Diabrotica virgifera
  misc_feature (696)..(724): n is a, c, g, or t
  misc_feature (786)..(786): n is a, c, g, or t
  misc_feature (867)..(867): n is a, c, g, or t
gttgcgtttagttgaagttgaaacacaataattcaatcatacacgaacgtttttattgtgtagtgacgatgactgtgctgtcggaagatatttgtgaattaattcaacaatgcttcaacgaaaaaatcgaaaattttgatatcaaaataaacgaaggaaacaaaaaaggtgagggatacattggagaaattatttttgcttcgctggaaaataaagtaaccggcaaagaagaacatttggtgataaaaaaagtatttggtagtgaaatagaaaagacgcgtgaatttttatcttcgtcgtatttaaacgaaatcttgttttacaaaaatgtgtggcctgagttaaggaagttccaggacacatttccagaaatcaaacctgtggatgtggtaccaaaatgttacggaacatctagtgttaagggaagcgaaaaagtgattttggaaaatttaaagtttaaaggttatgagatacatcccaaacggacgccgttaagcaaagaactatatgaagatatctttgctttatacggaaagtaccatgcaacctcttttgcatacaaacattaccatccggaagaatttcaaaaactgacggtggatttaaaaaataattggtgtggtttccaagaaacagaactctgtattacagctattaaacacagttttgtgggtgttaaaatgattctggagtatnnnnnnnnnnnnnnnnnnnnnnnnnnnnnggctccttatattgaaaatgctaggaagattttttctgacagtcttaactatgaagggccanattcagttttaatacatggtgattgctggagcaataacatgatgttttagtacaatgataaaaaggaactagaagatatanaactattagattttccaatgtcaagagcatcaactccctgtatttgatcttacatatacattttattcccggagcttggt

SEQ ID NO: 7335 - DNA, 187 bp, Diabrotica virgifera
tttcgtccgcaattgctccataaccttaggacacgatagagactagtactcactacatttacttgtaataaatatagcaccagcaacactaaggtacttaatagcgcttgccactcttacactaaattgctatacgggagatacgataaaagattcgcttactctaactgggcggtcactagtttcc

SEQ ID NO: 7336 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnatta

SEQ ID NO: 7337 - DNA, 1006 bp, Diabrotica virgifera
  misc_feature (839)..(856): n is a, c, g, or t
  misc_feature (858)..(870): n is a, c, g, or t
  misc_feature (964)..(964): n is a, c, g, or t
  misc_feature (973)..(973): n is a, c, g, or t
tagattaaatcaacagtttctgtaatctcaattcataaaaaataacataataacataattcttaaaggcataaattaaaacaatttattctaaaaataacaattttatgattttaattaaactcccatgcgaaaaaatccaaagatgcaagataagtcgagcaagttggcatttttatggtaccttttgtacatactaataactctatctggaaacgtaatgtaaaaaatccggcttgctacaacaaaatttcatctatattcatagaatactctatgaactcaaactactagaattatgtgatttctcaggagatctaggtatttacgacgacacaaagtaccctcaatgaaaaaagggccaattacgttgtcacctaaaaaaccagcccagacgttgactttttgacggtattgtgttttgtaaggaacacttatgtgcccattttctgtagagtaccctatggtaacagatgaattatgatggccagttaaagaaaaagaagactcatctgacaacgagattatttttatgaaatcttcgtcacgattagtgcgttccatcatgtcctcataaaacatcatccgtcgtcatattcagcagggaaaatttcttgagttttttgcaatttgtagcaatggtacttgtttctttttaaaatatttcgtacagctcagcactaataccagttactgctaaaattatcgtgctgttacaaggaaaattgatttcagctacactatacatatgacagtttcacgcttttcccgttcttcattaattgcacaagctggttgattttcatcttcatcattatccgtgcaacaaccagttttttnnnnnnnnnnnnnnnnnngnnnnnnnnnnnnngttggtacggggccttcgaaatgaaacgaaaacgtaccgcttatatcgtcagcagtacttccagaataatgccatttctaacttgaattataanttttatatnctgttttttttcaataaaacagaattttttact

SEQ ID NO: 7338 - DNA, 530 bp, Diabrotica virgifera
accttgtgtgggcaatagcaatctcaccccttcgctgctggaagccgtaaaggccctcatcgcgaaattggtcaacgccatccccactcagaacatccccaaggcctgggagggcactgctcaaggtaaggcattcattgcggggcagtatattgagcaggccagatcctcggtcgccgcaaactccttgaaccaggctgttgccctgcgcacaccggtcgctggcctgggcgccgctgcgatggtcaataaggcggacatctctccgatggagcttatggaaaccctggtcaacggtcggtttcaatcgcctgactggtacaccatgatttctggcttctctaccgaaaacctgctgcgcgagcagaacaagatgcaggccttcaagctgtggatggatcttcagtctttccagcagatggagcgtgttgaggcaatgctcgcgaccaatcttgccatggacgtgaagtccgattcggcggcacagctcgaagtggctcgaagcgccgcggcgaaggcggggcagtgat

SEQ ID NO: 7339 - DNA, 968 bp, Diabrotica virgifera
  misc_feature (753)..(753): n is a, c, g, or t
  misc_feature (860)..(860): n is a, c, g, or t
tatagttttcatatctcaactggtcttagagcaataacaaaattggcagtttgaaataaaaatttcaacaccctgtatctcggaaacaaagcatttgcggacatacgtttgtggagcaaaacgccattattttttcatgtggaattatcccttaaagtttttgatacttatttgctaacaccctgtatataagttaaatatggacataatgtgttattttgctttagtacgatgtaattacatgtgtatactcatattcttccaaaaatcgggtgtacggaaaaatggacatttgttgtttctgcatttagcgattcaaatagtctttgaatgaaaacatctgcaaatcttaacaacaaaatcaatttccaatcgagaatttttcagaacggtttggtgcttgtaaagatggtttttcagtgagtttaaaaattaaaccagaagtatcgaacgagtttatgttgtttgtatgttttatgatttgaagaaattaagcaaaagaacagaagatacaaaaaagctaacatgattgtaagaaaatttgatgttacagtagcaatgtattgcagcagtatcgttttctattcatgttgattaggaaatcttttattaatagacgatttctgcatggaaattcgtgttaacttaaattttacatactggttttaatatccacatgatatattcttgaggtgtttcgctgaaacgtcagctttctctgaagtattaagttgtagaaatatgtcatttcgntgagttatagttatttctttaacccaatgtgaaaaagcctcaccaatgcttagatatttttggagcccaccgtattttggattgctctttatactattttatattgncaaaaaaatttttgttctttcgtttcattttttgtgtttggaaaccctcttttagatatacagatgggtagcataaatattcttacgactcagctaatgtttcagcaa

SEQ ID NO: 7340 - DNA, 257 bp, Diabrotica virgifera
  misc_feature (180)..(180): n is a, c, g, or t
cagttaacgaagtatcagatgtgtccaaaattttaaaagttttgatatctccacaggcaactgacctgcaatagccatatatgacaaatattttgagagtatatttgacaaaatttcttactgtgatttgaatatggtcataatggatggcttggtgtcaacgttgcgacaagatgttanagtagaattacaattactggatatatgtagagcttttagtatagaaggtcaaaatgacattgttagaagtactgctt

SEQ ID NO: 7341 - DNA, 155 bp, Diabrotica virgifera
aagaagaacaagcaacagttacgaacattaaggtatcattttctgctgactgtatgctctgtattgacgacttgaatctggacgtagaagaactgctaagtacagacgaaataggaaacttgggaatagtcagtcctaggataagacatttatct

SEQ ID NO: 7342 - DNA, 986 bp, Diabrotica virgifera
  misc_feature (247)..(265): n is a, c, g, or t
  misc_feature (658)..(682): n is a, c, g, or t
  misc_feature (745)..(782): n is a, c, g, or t
gctatttggattagttcgagatttttaaaaatcagtttctatttttgtcatggtttcaacaagagaaacgttgatttcgaaataaaccagaagcaccgcggcggatccacctaggggatgggagaatttctccaccccaacaatatctagcattatagaaaaacaatgttgaaatgtaaacaacatttgtatcaaaagtattccgatggtgggtgttaacggaatcaattaaaaataagtgtaaacnnnnnnnnnnnnnnnnnnngttaaaaagcgtgcttatgcatctcgtaagagggttgtttattgttttggagcagcgagggtgcgtctgaactgcctgcctgctgtgacgataatgcagagaccacaacacggtcatcattttgtggttttacaatatggctagaaaaggtgataaattactacatctggcgttttaaaagctcagaacctttctgtagttttaagaaacgtcttcgaatgcatttccaaagtgcgttgacatcaggtctgataaggtaattcatttatggggaattcagtttgttaaactgaacacaccaaaaacatatggttagggatacatttcgtttcgtaaaactttttagcatctggtttgtatattaaatgtgaattttatatgaccgttttaagnnnnnnnnnnnnnnnnnnnnnnnnngcaaaaatagtaattaaagcgtgtcgccacaaaagtaataacagataataagaagttatctcnnnnnnnnnnnnnnnnnnnnnnnnnnnnnnnnnnnnnntgcaatacttttttcatagatttgcataatgattatgcagtcttgctatgaacagaaaattcgagtctttttcagacttggtctcgtggaacattttttgtatttaaattcgttgtttttgacctatagaagcctaaagcagttttcaaattatctttgaaaaataaaattaggtaattagatgtgcctgggaatttttaaatc

SEQ ID NO: 7343 - DNA, 872 bp, Diabrotica virgifera
  misc_feature (250)..(277): n is a, c, g, or t
cacaaccactacatgcaacatttttgaaacaattaaaaactatctttttatgtaaatgcaacaaataaacaaagaaaattagtaataaattttacaaaaaaacacacaaacacaaaatacaatattttgtgaagacaattaaacagtacttttgtatgtaaatgtaacaatgtaacaaataaagaacgaaacataatttatcagtaacacattttgcaaaaaaacatgtttgaaaaaattagaagctacnnnnnnnnnnnnnnnnnnnnnnnnnnnntacataaggtgctcaaaattatctcctaacacatttatgtacgcctaaaaacgatcattgaatgagctacttactctacggagcatttgtaaattaacacatcgaaatcaggggcgtcatttgataggggcagggggcatttgccccccctagccctgaaaatgactgaaatttacaaaaaataaatcaattttcatcattacatcatatataatgtattgtatatataatgcttgcccccccccccaatcaaaagttcaaatgacgctcctgatcgaaatacactttgtattctatttttcatctcatcccttgttgttggaggtattttataaacttcattattaacgtaaccccaaagaaatcagtccagtttattaaattctggtgatttgggtggccacgctactggtccattgaaaaatgaaaatatctcgaaaactggtgaatttggacatagggaatgttatctaagaatggaagtgcggtagtggtacttttcaatagtgatataaaatacaggggtgttccatttaaaattgctgagaaaataatgtacttgcgttttgactcaccctgtatttgatataaagaa

SEQ ID NO: 7344 - DNA, 752 bp, Diabrotica virgifera
  misc_feature (136)..(588): n is a, c, g, or t
tttcgtccgtttttggccatcatatttagccttatagctagtgttagtggatctgtattcagaattcaattagggaatcaagtagaggtggatcctgaagaaatccatgtaacttttgaagatgtaaaaggagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttagattctatgtagaagataccgttcctacacctgactatactgggtggaaatgaaatattggggcttataacttagaataagagatttggctaaggatatataaactaaaattgtttacccaattggaactgcgggatttacaggagtagaatctggaaa

SEQ ID NO: 7345 - DNA, 914 bp, Diabrotica virgifera
cttttgttattgattcatcattgacaattagttgttagggccgacgtcttgtttactaaccacaagtaactttgtctttgtcgcatttatgttaagtccgttattggagcattcgctagtgactcgatctataaggaattgaagatcttcgatattttcagccatgatcgcggtgtcgtctgcatatctgatgttgttaatagtttctcccccgattctaactccacattgtccttccaaggcttcattaaaaattatttctgagtatacgttaaacaaagttggggataacacacaaccctgtctgacacctctttgaatgcaaattttgtctgtttctttgccgtctaccagaatagaagcttcttgattccaatatagatgttataaaagtctcagatctttatcgtctattccaatcatttctagatattcaaacaacctattatgttgaactctatcaaacgccttctcaaaatctataaagcagacgtaaattggtttctgtacttcccatgatcgttgaagtaatgttaacattgagaacaaagcttcccttgttcccaatccttctctgaaaccgaattgtttgtttcccattgtctcttcacatttctgcttgattctattaagaattatcttaagaagtagcttgagagagtggctcatgagactaattagtctaaagtctttacatgatgatgtattaggcttttttgggagtggaataaatgtagactctaaccatatctgtggcatcatgccagtctcgtatatatggttataaatgtttgttagttgtgagacattgtcgtcatccagaagtttgagccagtctgatggtatttggtcagggcctggagaattcccatttttgctcctgtttgatggctttctctacttccgcttttaaa

SEQ ID NO: 7346 - DNA, 292 bp, Diabrotica virgifera
ggaagattgaggaggagacgacgacatagtatgaatattacgaatatgaaaccactttctctgttacggagacatccaagctagatcgtttcgatggacctcctagaactacaatcttagcattgtcgccgagcggaggacagaaggaggaagacaaaaagtatgtcggcaccaatcacggaaaagctgatcttgttgtagagagagtacacgtcgataagctaaatgatggtacagcagaggttagtggtccagcgagagcagaccactgagagaggcattgaggacagtc

SEQ ID NO: 7347 - DNA, 754 bp, Diabrotica virgifera
  misc_feature (111)..(128): n is a, c, g, or t
  misc_feature (141)..(170): n is a, c, g, or t
  misc_feature (252)..(375): n is a, c, g, or t
  misc_feature (547)..(578): n is a, c, g, or t
  misc_feature (705)..(732): n is a, c, g, or t
taaatgccaagaaatgtataagatctgttatatactgaatgaaatgtaacatcagattctcaataagaaataaaaacaagttataccaattatcatcaatagaatttgtannnnnnnnnnnnnnnnnnccaacaaatttcnnnnnnnnnnnnnnnnnnnnnnnnnnnnnngttgtactgtaatattgtcaagagaaaattttaatggtgttttatttgtatgttaggtttaagttataaataaaccatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttgggggcccccattttaaatccccgtttattgccccgcaaaacccctttaaaagcccccccaaattgaaccccaaaggcccttcttttaacccccttttttaagggaaaaccctgggaaaaccccatttataccccttttaaaccccccccctttcccccccttttnnnnnnnnnnnnnnnnnnnnnnnnnnnnnnnntcccaaaacttttcccaaacttataggaaaatagaaacccccctgaaccccccctttaacggcgccttttggggggggttggggggggggtaacccctaaattttccaaaccctttacgcccccctnnnnnnnnnnnnnnnnnnnnnnnnnnnnttcttttttccccgtttttccc

SEQ ID NO: 7348 - DNA, 984 bp, Diabrotica virgifera
  misc_feature (55)..(959): n is a, c, g, or t
gtctgggtggtgcgattttatatccagaaaatatctaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcatggcccaaatcactgctgc

SEQ ID NO: 7349 - DNA, 795 bp, Diabrotica virgifera
gcccccctttgcaccgggtctgcgctagatgtatgctgatcatctgactgcttatagtgtagcgcacgatcacaaactagatgatactgttatgatagacgattctaactacgaatcaatttttcctacctaagatcaataacatgtgaccactacatcttgcgactatataccaggatgcattcttaacgccaatatctgtcattatggatacgaaaattacctgaagagcgaggcactgaatcgtgagttgattgctgatatcgacaagacatgatttatatctatgctcacgtgtgtattgcatacatggaaccgctcccaaccaactattgaagatattcgcacctacacaatgcatccatgggtcttggagactataaatgaaccgcgatctacattaactaatctgagcgcatacattgtcacatgtaccaggtattatatactagaccgctttggtcactactacttaatgcagcttaatcctagtgtgcaagtaaaccatacatggacagacatggggactgaagctaaatgaacgcctcttcaactacggattgacagtgatataagcactacattatattaatgatatcagagtaatggagaaagaatctctcgcgcagaatgagaggaatcgattttgatttacccagacacaactcacaaacctgtggagatgtcatagctgaaaaagttacctcaaaaaaccacgatgaatgtatcacaccagctgtggtaaccgtcaagaacttaatttccgatcgtcaagaaagttttctgcttatttct

SEQ ID NO: 7350 - DNA, 404 bp, Diabrotica virgifera
  misc_feature (372)..(399): n is a, c, g, or t
taacgtaaaaaattgcaaaattgctacaaaaatgcaactaagaaggttgttaaccagcccagtaatcagaggatgtacccgaagaaacgctcaccatggtgatcatgccgttcaatccagctacaatgatctgcctcagcctcaaggtagttggaagaccaacttcgatgctaaccaacgcaaatacaatgcccatttagcccttggagtcggagtcttaacaggtactattgtttttggaaaagctactggtttattggagttctacaacgaattccctgaacgcccagccgacattgcatcctacaagtaaactagtttattaagtggtaatagtaacaagtgtatagttaaaaatgcttagtattgtannnnnnnnnnnnnnnnnnnnnnnnnnnnttact

SEQ ID NO: 7351 - DNA, 1204 bp, Diabrotica virgifera
  misc_feature (540)..(664): n is a, c, g, or t
  misc_feature (674)..(755): n is a, c, g, or t
  misc_feature (899)..(945): n is a, c, g, or t
  misc_feature (1003)..(1024): n is a, c, g, or t
  misc_feature (1073)..(1115): n is a, c, g, or t
  misc_feature (1132)..(1162): n is a, c, g, or t
tgccatgttagacgcagacagatctggaaaactgtgtttccaagaatttaaggaattatggggagctataaggcaatggaagaacgtctggctgatgtacgacaccgacaagtctggaacatttagtggctttgaattgagagacgctctaaactccgcaggattcagactaaacaataaggttttgaatattctaatgcacagatatggtaacaaaaatggagagttggagtttgaagattttatgatgtgtgccattaaattaaagtcaatgatggatcattttaagaagaagcaacagagtggaagcaacaatgccacattttcgatagatgagtggttggaaagcactctttattcttaaacataattttttgttatacttttctacaacgtttattaagcattcctatagctttttgtcaatatttttggaatatatacttgttaaaattaatatattattcgttaaaagtgtcttacaattttacatgattatatacgtatctattatacattttcttgttaaaatttgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaatatnnnnnnnnnnnnnnnnnnnnnnnnnnnnnnnnnnnnnnnnnnnnnnnnnnnnnnnnnnnnnnnnnnnnnnnnnnnnnnnnnnaacggggggggagggcgaaaaaatttcctttttaaagggcaccaaaaaaatattctcccgggggccgtttttaaaacagggagggggaaaaaacccggggggaccccactattattccttgtgaaaccccccccccttttcccnnnnnnnnnnnnnnnnnnnnnnnnnnnnnnnnnnnnnnnnnnnnnnnaattccccccccctgtgagggaagagggcagcccccccctgtccggccccttatatannnnnnnnnnnnnnnnnnnnnnaaaacccaagggggaatcctcatatttttttcgagcccctctaaacccnnnnnnnnnnnnnnnnnnnnnnnnnnnnnnnnnnnnnnnnnnntttctgcgtgttttttnnnnnnnnnnnnnnnnnnnnnnnnnnnnnnnttccctcttttgggtggtctcctatttatttgttgttttttc

SEQ ID NO: 7352 - DNA, 831 bp, Diabrotica virgifera
  misc_feature (250)..(269): n is a, c, g, or t
ctcctctatcctttccatttagcacctgaaagagtcgtgttctgttacgaactgcctgaaaaagtaccttgtccaggtcgccctatgctttgcgaacgacgtattttacgtgcttaccaaaggttcgcctcgtatttaagactactcccaagtactttatttgctttctacctctaggacaaaaactatatcctctgatccttaagatcatatttcagatttctcggccgctagtcttgctttccatccnnnnnnnnnnnnnnnnnnnngttccctctatgcatgtcaaccagtttttgttgtgctccaccaagtcatccgcatggctactgcctgtacaccaatgcccaggtcggcctccaaaatctcgttatatagaacagtccaaagcaatggccccactcccgtcgtgctcctcatagagctactcctcgcaatgttgaaatatctatctgtgaagtagttcctgaccaaggtctgcagttagggagatattcctaagtcgcccagtactctgataataattttccagctgacaatattaaagacatttcttatatcgcgcaagaaagccaccgtccatctgctcctacatatggatatctccctcttgatcctgtttatggcttctaccgcagatttgaacccacactggctatcggatgccacctttctccatcatcttcctctccagcctcatcttcataagaatctcaaggtattctggtataaagtttgtataccccaggctcctgtattcctttcccggtttcgggatagtttgagatttgccgttttcagatctcctgggaaactcttggcttcttatca

SEQ ID NO: 7353 - DNA, 702 bp, Diabrotica virgifera
  misc_feature (197)..(215): n is a, c, g, or t
ctacaaattcacacaaatctcttatagtttttaccggctgaccacttatactctcccccatttcaactgtccataacttccaaacggctaaatacagaaatatgcggttttcgctgaaatgccttattcaataaaagttttgtccgaatggattgaatttttcatatcgcccccaaacacgaaaaaaaaatggcggnnnnnnnnnnnnnnnnnnnttgttgactctttcccaatggaacacacagtatatttttctgtcagttgaaagaaaggtcattcacctatccagcgatataaagtttttcaaaatcggctgtcaaatcactgagtaatcaattattaaaacgagaggtgcaacgtggatatcacatacctaaacatcataactaagcaaattgatattatgttatgtgattttcacattgcatctctcattttaaaaattaatttctcagtcatccgacaaccgacttaaaaaaatttatatcattgattaggtaaatgactgttttttcaaatttttaggtaaaggtctattttctattttgcttttaaataaaaaatggcggatttttgaaaaagaaacgttgttgaccttttttattacaccaagtatattctattgtaacttgtaaaaacgggcatcctcagatcctgcgatacaaaaatgttttaaaatcgggtgcaagagtactgaccaac

SEQ ID NO: 7354 - DNA, 943 bp, Diabrotica virgifera
  misc_feature (840)..(840): n is a, c, g, or t
gctcttcgctcgaggttgcgtatcaactgctgaagaaggtctagcagcagctcacaaaatcggttttcctgttatgatcaaggcttcagaaggtggtggtggtaaaggtatcagaaaagtagaacatgctgacgattttgctgcagcttttagacaggtacaaacagaaattccaggttctcccatttttgtgatgaaattggccaaatgcgcaaggcatttggaagtacaattgattgctgatatgtacggcaatgctatctctctattcggacgtgattgctccatccaaagaaggcatcagaaaatcattgaagaagctccagctgttatagccgaaccgtcagtttttgaggctatggaaaaagcggctgtaagattagcaaaaatggtcggttacgtctcagcaggtaccgtagaatatttgtacgatccctctggtcaatactacttcctggagctgaatcctagactgcaagtagagcatccttgtacagagatggtgtctgatgttaatttgccagctgctcaacttcagattgccatgggtttaccactacattatattaaggatatcagattaatgtacggagaatcgccgtggggaatgagtgaaatcgattttgatcaacccagacacaaaccacaaccctggggacatgtcatcgctgccagaattacctcagaaaaccccgatgaaggtttcaaacccagctctggtaccgttcaagaacttaatttccgttcgtcaaagaaacgtttggggttatttctccgtagctgcttcaggaggtctgcacgaatttgccgatttcccagttcggtcattgtttctcttgnggagaaaacagagaacagccagagagaaattggttatcgcccctcaagagctgtcaatcagaggagacttcagaacgactggtgagtacttgattacactttt

SEQ ID NO: 7355 - DNA, 773 bp, Diabrotica virgifera
  misc_feature (115)..(133): n is a, c, g, or t
ccgtcaggttctagaatacaaaaggaatgacctaacacttttagcataagtaacccgtgaatactgcgtgagtaaaatattgagatagatctttataccattgattaatggcgtnnnnnnnnnnnnnnnnnnnggaatgattattattagaaagaaaaaggaccatagttaaccgtattgtatcgcacatagtgatcataaaggactacatttccaaatatctacataacaacaaaagcatgtctatgcatacctatcagaagagaattcattatttctgatatcagagttctttgattagttttatatgatcacgaggtcttttcgacgcacctgcggcgacatggagcactaccaccgcttaaccaacgaacagcaataaagcttattgaaaacattatattcaacctgagctaactttttgatgagtagatcctgcaataacaaaaccttctcctacaacttaatcactcatttacaacttcaccaatataaccaacaactgaatcaaaaaagagagcttctaattatattcttaattattacatacacatatttacaaaaagtttcgtctttgtattcaagtggacttccgcatagtgctagatcttttcttgttcccctactggagaagcgatcatgcaaccaccgttaccatggggtactagttaaaaatcttgcgaatacataatttaatgactactatgaaaatattccatttatattttttacccacagaacaatttgttaatattaccgaattcagtagatct

SEQ ID NO: 7356 - DNA, 907 bp, Diabrotica virgifera
  misc_feature (170)..(194): n is a, c, g, or t
  misc_feature (442)..(459): n is a, c, g, or t
  misc_feature (720)..(737): n is a, c, g, or t
  misc_feature (819)..(836): n is a, c, g, or t
gtttttgaaacctctcaatctctaggcgaatgctctaccgatcagctaccaccgtttttgtattcagtcgatcatttctcggacataattacaatcacggtgacagatacattaattgaaaataaacattttcaataatacttattaggaggaagacaaatccacagacnnnnnnnnnnnnnnnnnnnnnnnnnctaaaaacactaatattatattcttttcacccacaccttatttgcgctacataacttaaaagacgtagcgactaataccatactgtcggtgttcgcatgcgccagggaatgtaaaaatttaccctcgggtctaaagatataacttcaaaaactaagcgtgtgggaaaaaaattaatataccattttatttgccctttgtctaatttatataatctttgctacagtttttaaaaaccgtataaagggtnnnnnnnnnnnnnnnnnnaaattttttagacctgttttttttctagtttgagtaaatcagcttattaggtggtaatagataggagtatgtatagtttctcatgactcaccatgcaaaagactatcgaaatcaaattctaacaactcttgaacaaattttaatttatatgagtaaaaaattcgtagaacatatagaatacctatgaaaaaataaaaatccgtacaccatgttaaaaacggatgatctgacaacaaccaaaataatatgtaaaaaacaacnnnnnnnnnnnnnnnnnnatgatcctattagcctttcctgaaatgatttaagcattctagattgtccattacattgaatgtttagtaacataatatgttnnnnnnnnnnnnnnnnnncacaatgtaactggattttttttggataacgctcaggtagaagacgttttgcatatctataaacgcagtct

SEQ ID NO: 7357 - DNA, 551 bp, Diabrotica virgifera
cttattatctgtgtttttctgtctagtgagcagtgataatccacataagacaacatgctgcgactacgatgttggagatattatcactagagatgagatgcgtaatagatcaaggtttcaatggaactgaaatgaacgaactgaaaacgccgtactacccatcaactgtctcacgtctccctcgaggcaactgatgcatctggcagtatgctgcatattgtccaaatgataaattccctgctaagggagggttctgtctatccatgatacaaaagaccaaactgccacacagacagatgttcttgcaggtgcttttaaaaaattatgaggatattgtcgaagcctatgaccttcatcagtttgctgaaagaactcactacctgattcgagctagagacggcaacagattatactaggctcatacggaattctctgtctctgcatgtatacgaggcgctagggacattgattgtctgcagagacagtcatggattttacaacttccaaggcatatattattgttttctcctttaatagtggtattaacgata

SEQ ID NO: 7358 - DNA, 230 bp, Diabrotica virgifera
  misc_feature (48)..(75): n is a, c, g, or t
  misc_feature (95)..(108): n is a, c, g, or t
  misc_feature (111)..(133): n is a, c, g, or t
  misc_feature (141)..(163): n is a, c, g, or t
  misc_feature (193)..(224): n is a, c, g, or t
ttctgtgtccggaataaattaccttgagggataacagcggaattttannnnnnnnnnnnnnnnnnnnnnnnnnnntgcgacctcgatgttggatnnnnnnnnnnnnnnggnnnnnnnnnnnnnnnnnnnnnnntggtcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7359 - DNA, 761 bp, Diabrotica virgifera
atcaatgtccaagaagcatgtatctgtgatcatatagtatagttttggattctccgatactcactacgggaaagtatatcccaagatctgataggaacaggtcgaaatgctaatgaattacataattgctctgacgaagcgaagatagacacatgaacaacaaaaataggaggaggaggtacatgtagaaactgatagcactgctagtatttgctggacgtgtatatcttgaatacactccagcaaggggctatccggttactggtttgtgtatataatatcagagggtagtgggccaagatttgcttactatgagactctatctcgatacttatctgaatatattattcaagcgaagtagatgctctcgcaaaatatcgagtcctctacagcacgctgagactttaaaaactatgactgctgcgatctatgttaccagaccttctcctcgaccatttgatcatactcgatactcaaactgatgtgtatccccaatgactcttcgcgacaactctgtgagctactttatcgcgctacatcttctgatggacttgatcatgagatctatatctgctacgttctacactagttctacaactgcctctccactcatgcacgagactgtgttcgatgccatgacttatagtcccatgaagtttatcgatatctatactgccgacagagtagctcaatatattgtccaatgataatcactgccttatatgcacttttaccattgactatcatggatactgttcaca

SEQ ID NO: 7360 - DNA, 245 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggctggttnnnnnnnnnnnnnnnnnnnnnnnnnnnnnnnngaaaggnnnnnnnnnnnnnnnnnnnnnnnnnnnnnnnnnnnnnattatcaag

SEQ ID NO: 7361 - DNA, 965 bp, Diabrotica virgifera
caggcattgtcccggaatctcggttcctgccctcgttcgccctttcacttggaacccacctttcccgtcagcagatggatttgtaggacttgagactataaatccgacagatattctttcggatgatggcaatgaggatgaagaggataaatactatatgtaactgtgaaagagctcgaataatgttgatccatctcctccaaaaagggagaggaaggcagctcggatctaaaggtgccatcgtcttggaccagagtatggatgaccataattcttctagagagccactgactatcgatgaacgaggacgccgactatagtgataatgactgtgaacctcctgtcgttgatgtaccttctcctattgcagatgatccccctgtaccctcgtggggtgataaagatgaagtacaaaccccttcttcttcacatgacaatcttgatctgaatgtggaaagtgacatgccttgggcttatttattaataccgtctcctgatacggctaccggtgaaacgaccgttccccttgaacgaggcctaccgacagatcctttagatttcttccccttatatcacaccacaaccaacgaatctcccccagacgatctaaaaacaaacgcatccctttacggaccagacttaaagattcaaaagacctccacgccgagaaacttcataaagtaagaagtctcagactaaggagaataccacacttaattgtaccgacttaccagtaacgaaagatatagaaaaatataataatccgctcgactattttgcttttgagaataatctgctccctgcttatgtattgaagagacgatcgttagtagatacagagatgcgagatgcatcgacaagtgacgttatatggaactgcaaaatttgttgtatagaacacgattgcaaagatgcttgtgggatcgctatgagatgcataaaatagtagcagatcaattgcaaga

SEQ ID NO: 7362 - DNA, 761 bp, Diabrotica virgifera
  misc_feature (2)..(24): n is a, c, g, or t
  misc_feature (250)..(270): n is a, c, g, or t
  misc_feature (349)..(368): n is a, c, g, or t
  misc_feature (433)..(481): n is a, c, g, or t
  misc_feature (621)..(641): n is a, c, g, or t
cnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 7363 - DNA, 962 bp, Diabrotica virgifera
  misc_feature (952)..(952): n is a, c, g, or t
atcgtagtgatttttcatttttacgtttgaattttttcaactttattgtgcaaaatgttcggttttggacttttgttaactgtttgtgtggtttttggacaatctcatggttcggctatacctatgtgggaatacttaagtaagcaggaaaaagtaagtaccgatttgttttaacagacatcaatagtacgttaggaaaggtacctaccacctaatttgtaccaatttcttttttgtaattcgattttttgtgattagatctgttttaaaacatactagtcgatacgcagtgaatttttgctctaaaaatagatctcaagttacaattttaaatttagaattaattttgtgccaacagtatctaataaatatctattttaacagaaaatgctttttatcaaaatatttctaataataaaatgcaaaaatttttagttcctttacgttgcatctctattgaagatatacatacctacataaagttagagaattcaacaattttcaggcacaattccagtaaattcgaaatagtatctaaacagttatttgatattatgtttttttcaatattgttataatatatttagtgattttctaaatgcaggtactacctacaactgcaataaccaatttttttaagatattaggtacttttctattattttctacttattctttcttggtttatataagtattttcgcaggaaacgtagtttctaaaatttgcaaataaaatatagatttacttaaaactttgtttccttttgagtaaattgttcagttaacattgaaataaacaatcaatctttatttgataacatctgagtttacaaagtaaaaactttttgttgtaaaatataaatgatatttatacctttgccttagtccatatacttcaaataactttataatgagatcttgaaacgaatgctgaaaataccttgaatagcangaaaactaac

SEQ ID NO: 7364 - DNA, 1117 bp, Diabrotica virgifera
  misc_feature (4)..(818): n is a, c, g, or t
  misc_feature (983)..(983): n is a, c, g, or t
  misc_feature (989)..(1019): n is a, c, g, or t
  misc_feature (1028)..(1091): n is a, c, g, or t
tgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttcagggataacagcgtaattttattggagagttacaatcgataataaagattgcgacctcgatgttcgataaagtttataataggtgtagcagctatatgattaagtctgctcgacttttaagattttacatgatctgagtttaaaccgagtgagccacgntgggtnnnnnnnnnnnnnnnnnnnnnnnnnnnnnnngaaagaacnnnnnnnnnnnnnnnnnnnnnnnnnnnnnnnnnnnnnnnnnnnnnnnnnnnnnnnnnnnnnnnnggccagtttttaagggaatatgaatg

SEQ ID NO: 7365 - DNA, 975 bp, Diabrotica virgifera
cgcattacctcttcagaataagcgttaaataatagaggtgttattagtcttaaatctctttcatctaggtttttagtttttagaatttccatgagtcggtcatgttttattttatcaaacgctttattgtagtctataaaacagacgtaaagagaacggttaacatccaaacatctctgtgtcagcacgttgaaggagaataatgcctctctggtgcccattccattgcggaacccatattgagtgtcactaatatccagctccagtttagagtgtactctggcgtggataattttcagcagaattttcaaggtatgtgacattaagcttatggttcggtagtcactgcattctttggcattcactttttttggcaaacacacaaatgctgatgtcaacatttctctagggatgattcccgtagtatagatagcgttgaacagttctactattatgtccaggtttttctcgttgaccaactttatcagctcgctaggtaattcatctggaccagcagatttattggttttcatagagtttattgcctgactaacctctgatttggatatctctgggcctacatctccggtttggctatctacggatgtactactacgaatgtttctttggtatattttaataacaaactcaccacaaatataacaaaaactgtcaacagagttcttacaaccacgattagacatcttaccgaacacttatactggaaaccagaaagtgaggttaggtaaaacaaaacatgaactgtgaatagatggtagtatattatgtatttcagtagtatttccaactcttctacatcttaaagaaaatttgaaagattattttctaaatctggttaagaagtggaagaaggtattacgagacactcagaaagggctacagttaccagcaagtcttactatcagattagtttttacaaaactggggtaaaataataagtttaactttcaaaat

SEQ ID NO: 7366 - DNA, 208 bp, Diabrotica virgifera
ttggtccccccaaaaacccctgggtgaaaggaaaaaagaagtctgaaaaataaggttgggtggaccaaagtggggttaacttcccaacttgggatctccaaccacacggttaaaatactcctttgagaaagttattctcccccccaaaaaaaaggtgttttcaaaaggggggaaatctttttttaaaagttcttgctttttggggggg

SEQ ID NO: 7367 - DNA, 775 bp, Diabrotica virgifera
  misc_feature (140)..(176): n is a, c, g, or t
  misc_feature (271)..(288): n is a, c, g, or t
ggatattgcaaataacgtactttcgttttgatttctccgaatctaaactattcgcgttaagtgtattatacattgacctatacctgttgtaatcaatatgtacaataatagtagtacaaacggcaattcaataagttttnnnnnnnnnnnnnnnnnnnnnnnnnnnnnnnnnnnnngtgcatatgtagataaatagaatttttaaagttatacctaccgattgtggcaaataaatacgttgaaacccacacagaaacaaatcctgtatagnnnnnnnnnnnnnnnnnncaacgttttttaaaacacacaaggtccttattaaaagccaagacattctcagaataaattagtgacaatcttccacttctcaatcgctagacaaaattggcgttttgattttccattatgttaaaattttcctaagacagtttaatgtgcagatttactacataaaatagtagacccagttttaactgaacataacgatcaagaaactgacattcaaaataaagttactcctgttcgaaatgtcactaattcgttccgaaagagtcacctggcttttgcaacatgaactatgctttgtagaatggctaaaaatttccttaggtgttgatgtgggtgccaaggtttcatggtacgttttatgtacttaagttttctatttgtagtaatgactattcattttttcaataaataccacgtgttgtgaatcactgtaatatataaattaccattgtgttctttaaaatgttacagtaaatggtggcgtttc

SEQ ID NO: 7368 - DNA, 807 bp, Diabrotica virgifera
  misc_feature (4)..(21): n is a, c, g, or t
cgcnnnnnnnnnnnnnnnnnngccggagatggcatatatcctacctttgcattttgtttcattctgttaagccggctatcgccgtaagggattctctcttacatatgctgtagtctccaagcaaatgactgtcatagattatcttacctcggccgtgcacaaataagcggatagaactcagaggctgtatatttcaggtggagacttagctcaaaacgatggagattataaagtaaccagaggactttggcaaatgaatggagacaaatgattcattgacacaccaatgatctgaaatgtgtattctctcggaactgctgaccgttagctgttatggaatggtaatgaggcctattaacgaattcacgagattctaactttgcgtatgcaatcgattgattacatcatctattctgatggtaataccttactacatgtcagtatgtacgggtgaatggaccatttgagttcagaggacctaacggagcggcttctgtcgcagctgcccagcattctcaaagttttggagcttggcacgcccattgttcaggattgacggttatttctccataccattccgaagatagcaaaggactattaaaagcaatcatcgcagatccagatccagcagagttcctacaaaacgcattattatgacggtgttccgtatccgatggccgctgaccccttgagccaagatgtcgtactacctataggataggccaatactgaaaaggcagtaaatcttataacctttgtagctctctccaaggctgtagaattgtgtctcgtcgctgctaaacaatt

SEQ ID NO: 7369 - DNA, 906 bp, Diabrotica virgifera
gggagataaaaccaaattggaaaattatagacccatcagtttactaccgacattttcaaaaattttcgaaatagcaatgtgcacaagacttatagcctttttcaatgatgaccacctaattgctgaatcacaacatggatatctcaagggaaggtctgttgaaacagctacatacgaattcgtggataagattttgaatggatgggagaacggggagatttccttgggaatgttcctggacttatcaaaagcgtttgacagcatagatcatcatattttgatcaacaaactagaaagatatggaattcgtggccctgctcgggactggataagagattacctcactgacagacgacaaaaagttattataactcgagaaggacaacagttttcttcagaagaagggaatttacaacttggtattgctcagggcagtgtcatgggaccacttctttttgttttctacattaacaatcttggtagcgaaatactgagcagtgagtctcaccttgtaaattttgcagatgatgcaaacttattaacattagcatcaacgtttgaggatcttctgagtatttcttcagatcacttaaaaacagctcagaattggttcttaaaaaataaattggttttaaatactgagaagactaactgtgtttgttttcacacaaagcaaaataatgagataattccagaggagattgagttggatgatcaaactgttgaattatcaacaaatacaaaattcttgggtatttacatagatcaacatctaaattggtcagagcatctgtgtgttgttcgcaagagaatcaacatggcatgttattcattacgagtaatgtctaagtattttgaatttacaacacccttaagacaagtttatttttgcaaaacatcctactc

SEQ ID NO: 7370 - DNA, 951 bp, Diabrotica virgifera
  misc_feature (43)..(69): n is a, c, g, or t
ttgtcgtccggtaataagtgagtaataaaaacctcaactatcnnnnnnnnnnnnnnnnnnnnnnnnnnngtaatgcccatgcatcataatagggctgtagaaaaaaaataagtgtcgtacttagctgacaccacttttctctagttaaaatggacaaatgcgttataaaattatattagttttattgcacatggagcttggattagcattttcaaacgttaaaatagacaaaaattgcttttgggtggaattgatcagaaaataatgaaataaccgtgtaacatttttgttcctggagtctttatttttgcagatatgtgtacgatatgagaatgtagaacagtcggggtaaaaataacctacattgcaaaaacggtgtgtagcactccgggagtgaccgaagggtgaagcgtagcttccacgtccacgtcttttatcgtccacgtacggagcgatggatctataattactcaattaaaattaaggaaaagtcaatacaaagatattcctatatagaaggactttgaacataatatatatccaacagattagtcgtaaaaacatattgtgcaataaatgtgttctttccttaaacattattttcataccgataatgaaaaaagcacttagtgccaaatatggggatcagatagatctcccatattatgttaactacaagctgtcaggcctgtaagcaacaggatgttgctcttcggttgtcttttatgaaactatcttatacatatatctcgactatatatggatcaaatattagtgagtgtagtaattcttacatttaacaattttataatgaatatgtcaactatgacttttaaaacaactttgtattgcaagtcagtagactttcttccataaaattgtacagaattagatatctttgtatagaaatggcattgtgctttatctcaatgttaaatatttttcagcctt

SEQ ID NO: 7371 - DNA, 198 bp, Diabrotica virgifera
  misc_feature (7)..(32): n is a, c, g, or t
  misc_feature (39)..(39): n is a, c, g, or t
  misc_feature (57)..(95): n is a, c, g, or t
  misc_feature (97)..(190): n is a, c, g, or t
tatttannnnnnnnnnnnnnnnnnnnnnnnnnagcttanatttttttaaagacgagnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 7372 - DNA, 414 bp, Diabrotica virgifera
  misc_feature (10)..(27): n is a, c, g, or t
  misc_feature (35)..(113): n is a, c, g, or t
  misc_feature (116)..(204): n is a, c, g, or t
  misc_feature (222)..(239): n is a, c, g, or t
  misc_feature (338)..(356): n is a, c, g, or t
  misc_feature (379)..(397): n is a, c, g, or t
gtaaaaagcnnnnnnnnnnnnnnnnnncgagaaannnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaggggataaacgcnnnnnnnnnnnnnnnnnngttccaaacccaaaataaaaaattgcgacccccgagggtggaattaaaagtttaaaatttggggggggcacgcttaattttttaaaacctgggtccccnnnnnnnnnnnnnnnnnnnccaggtgcccgggggctttaaannnnnnnnnnnnnnnnnnnggggggctgggcctcct

SEQ ID NO: 7373 - DNA, 423 bp, Diabrotica virgifera
tttttgccgaggaaaacgagactgactacgctatcttctcagtttattgaggtgaagtaagtgatggattctgatatatggtaagaccactacatggccggcctgggggaaaaagaatgttttgaggtaattaaggaacttaagtaagtaatagaagtgcgggctcaaagatgtcgcaaagcgtgcggagataactaaaaaaaagacacgtgtgttgccaagaagcaaagcagagactgattgtgtagaggtgacgatgaacgtacctagtgtggaggcgcggtaaacgaggctgtgagtatcaaccagggcagtctagtgtttgatgtaggtttggcagaattgggtaaagttggagtctgcagaggtcaagatcatagacgacgcgaaggaatggttggttgtctgaggaggcgtcggggt

SEQ ID NO: 7374 - DNA, 75 bp, Diabrotica virgifera
gtcctcttttttggtccggacaatgagaacaaatagatatgacgctgttttttttttatggtcttgttgcaaact

SEQ ID NO: 7375 - DNA, 955 bp, Diabrotica virgifera
  misc_feature (841)..(841): n is a, c, g, or t
  misc_feature (853)..(853): n is a, c, g, or t
  misc_feature (908)..(908): n is a, c, g, or t
gtcatttatactcagagattgaactgttttataaaaattttctgttcccttcggcagtggtttgtgctgagttcgtgaaaacttatgcgtgaagtggtttttctactcagctgatccaaaagttttggaatatttttcagacaaaaatcggggcagaatggttttgaagatttgcgaaggtatgtcaaacaaggtggtgatttttgcaaagaattatcgcagattctacatgaaagagctgaagctgaaacccaatacgccaaaagcctttcaaaactgagcaccaagctgtctcgcgcttgtcgagaaggagttggtggcttaaacgaatcgtggaaagctgtagctttagaactagagacgaaagctgaagctcaccggttacttggtgtggccctgttagaagaaactgccaagcctttaaagaatctcactgaaagccaacataggataaggaaacagtcggagtcttcggtcgacaaggcatccaaattgttgtctgactggagagccagcgaggcaaaaggtaaaaagcatagtcattcctgtgccagggaaaacgaaagctgcaagatgctgccgttttggatactaccaaatacggaaaacaaacgatttccaaaagttctagtctaattcatttggctcaaatgaaacaacattccacagataaggaaaacgcaaaattggaaggtaaaaaacgaaaagcagaggatgctgtaaagaaatccgacatcgagtattattcactttgcgtgagagctgagagagcaagacttgaatgggaatcagcagtattacgtggtgcaagtaccttccaagcactagaagaagaacgctntaataaccttanatccgtccttagctcttacttacatcatatcagaaatttggggcccagattattngaggcatccgaagggcttaaggtcctgttaatcaagctgatcctacc

SEQ ID NO: 7376 - DNA, 723 bp, Diabrotica virgifera
  misc_feature (273)..(301): n is a, c, g, or t
aacaaaaagagcacttatctggacactgtctaatgtgtatgatcttgctgcatactctatatttccctcgcctatctctgccgttataatttacggagtgctccataagccggatattcaactacgggaaatgcacacatcatacatagtgtatcataaagcgtgatcatacgacttgcgaccttatcataaagactccaaataatcgatatatacctactctctctcttgttttcgccacttgattgttccatgcttttataatagttgctnnnnnnnnnnnnnnnnnnnnnnnnnnnnnctactgctgttctaatctccgctcgcatcatgtaccgcgcgagctactgtcacgcgcgcaaatgaagactgggccataccctgcgtcgcttcccgcttaggctgtgtggcaccttcctccaattaacttcccttcttaactgttgtattagttcttgatctgatgattattgctagtgctactatcgtagatatatactagtatttgatagacgcggcaaacgacgagctatacataattttaattttcaatgtatcctgatatatctacacacattgaatttacacagaagaataaagatgaatgagtattcaacatcgcaaattattagtattatgctatataataccatatttatttacactaaataatacataataaggtgcatcgaccaaataacagttagcacatgtctatatcta

SEQ ID NO: 7377 - DNA, 927 bp, Diabrotica virgifera
  misc_feature (728)..(752): n is a, c, g, or t
tggggctgtacttcctttggagagttgcttgccttccctttttttgcatttcggactcgaatcaattgggttttttcttagtttgtcgtcgtcagtgcaatattctatatcttcattgtgctgtgttttttcttcctctattttcttttgtagtgtatctatttggattttcatttgttggatgatcatgtttagattttctctttcttgttttcctgtaaccaggcgttgtataacagctgctcattttgacttcttacttgattctcagtaaagagcacttgattttgttgaacaagtaatacctcacttgatgttgtcggttgggaaagcatattctctttttctatatttcagtacacccatctcacactatggttcgagagtgcctggactattccaggccatatattttatgaaatatttaacaggttaactatgtatttatttgtcaatataaaacttttgtatcttatcacaggagaattttaattttgctagtaaaaactttcaaactttaataacaatcggtaataaaatagatatcttacctaattactgtaattatgccaacaggtggaggaaagagcttagtttaccacttaccagctcttgtaaataataatgttacattggttgtttctccacttatatctttaattgaagatcaattaatggcattgcaacagttaggaataaatgcaaatactctaaattctggttcttcnnnnnnnnnnnnnnnnnnnnnnnnnactgatatggactcaaacaatccaaaactaagacttttgtatgtaactccagaatgggtagctaaaagcaaaacgttcatgacccatttgcaaaagtgttatggtaaaggacatttggttcgtattgtgatagatgaagtacactgctgttctacttggggtcatgattttcgtc

SEQ ID NO: 7378 - DNA, 632 bp, Diabrotica virgifera
  misc_feature (33)..(55): n is a, c, g, or t
atttaatttctttagtaacattttaagaattcnnnnnnnnnnnnnnnnnnnnnnngtgaagctaaaaaacatattattctaatttcgcactaggtataaccttgggagatttctttaatttccctttttcactactaatactccagcactttataaattttcactaaacataccagaagaaccacaagatacctttgtgtcattaacgtcttggggcaaggggatcataatagttactggctgtgggcgaggaacaccccttttaattggtcgtcgagaaaaaggaacatgacggatggaatggaaacatggacttaactgatcctatggagcatcggcatgagcaatcacaagtatgtaccagcctcagaacgagaggaggaggtcgaagtgtcttgacatgatcacatcgagtaagaggcataatagtgaaaacaatacgccttaaatgtatttactaaggatgatgcggattccttccacgtgtgagactccaatgctagccctcggaatccaggcgaggagaatatgatacctgtacttagcggaaccgctgggcatgtggtccgggtagctgccactgacgaaggaacactatctgtgctcttgtcctgtacatcacacacatgctc

SEQ ID NO: 7379 - DNA, 748 bp, Diabrotica virgifera
  misc_feature (436)..(483): n is a, c, g, or t
  misc_feature (492)..(510): n is a, c, g, or t
  misc_feature (537)..(660): n is a, c, g, or t
cggacgcgtgggctatgtggatttttcaatatatcttgtgtgtttttttcttcgtctatttacctatatccgtcaaggctagtgaacgtgtagaaactcaccgacaatgtcaggctaatacaaaaacaaaactttcagatgatatagttcataaacttcacacaggagaagaagtaaatgatccaattttaggtaaacacatgctctgcatgtttacaaagatgcttataatgaacgcagatggagatataaatgcggaagtgctgaggacaaaagcaaacagagctttgaaagatgagaataaacttaatgcgttggtcaaaagatgtagcatcaaggagccaggaagtgccgaagatgctgccataaaattacttaagtgtgttgaaatagacgtcccagtgattaagcaccaatacacgtaataatgacattnnnnnnnnnnnnnnnnnnnnnnnnnnnnnnnnnnnnnnnnnnnnnnnngtcagctgnnnnnnnnnnnnnnnnnnngttgttgatgatttggaagttgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaggaccaaattttactaccgggggtttggaacgtaaaattttttttaaagggcccccaaattcaatttccggggccgccttt

SEQ ID NO: 7380 - DNA, 736 bp, Diabrotica virgifera
gccccccccttgtgcggtgtctttaggaatcatataaataatgttagcgtttttggaaataggatttgtgactgttgccgtcttcgcgtggccgccagctcctcctagagtgatagaagaaggatatgtgtctcatgcctgttgtgtcagacaagtccaaatgacaattgggaagaggattctaccaactatccttcaacagtattccacaaacttactcttcttcatggagcagagattctgaagtccatggatacagctaaaagtacttctataactcaggaccagttggtttgtataatacatcttcgtattccttacttttaatttactctgccgtaggattatctgctgtaggattatcagaaggtcttactcatctgctcattattcagatggattagtcggaggatattcatctgatctttcttctgaaaatctcctttatggtggtctatgctctggtgctgtatctagaaattattacgtcaattttcgattctgaatgttattaaggtatatctgctactgctgtatcgttgagtacgtggtgataagagtagctatatagcacttgcatatcctatggaacgtcatttggatgacaatctgaactcggttacattgttttctcctgagtgatactcaagctatgacttttttgtgtttcctctagagggtcgcctgcccaattgtttattttcaatgtacgctgtattttgtgcgtggtaaggaa

SEQ ID NO: 7381 - DNA, 702 bp, Diabrotica virgifera
  misc_feature (308)..(325): n is a, c, g, or t
  misc_feature (450)..(472): n is a, c, g, or t
acatggtggagaaaatcggcataattctaaaactgaaccttctcatagctcgagtaatgaaaccatcggtgatgaggatccttacactagtgaagaggaagagcaagaagacagctctgattaccgcaaaggaggttaccatcctgtcagaattggcgacctctttctttccaggtatcatgtaactagaaaattaggttggggtcatttctcgactgtgtggttgtgttgggatctcgaggagaagagatttgttgccctaaagattgtcaagtcagcagatcacttcacagaaactgctcttgatnnnnnnnnnnnnnnnnnntcagttagagagtctgatccaacagatccaaaacgtaataaaactgttcaacttttaaatgattttaagatcagcgggatcaatggggtacacgtttgtatggtctttgaagtgctaggtcatcnnnnnnnnnnnnnnnnnnnnnnntccaattatagaggaattccattagcaaatgtgcgcactataatgaaacaagttttagaaggtctggattacctccacagcaaatgcagaatcatccacacggatattaaacctgaaaatgtactactctgtatatcggaggatgcgattagaacattggcttgtaaagcagccgaactctcccagctaggcataaaattaccaacttccttaatcagtacagctcccgt

SEQ ID NO: 7382 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (173)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctttagnnnnnnnnnnnnnnnnnnnnngaaagg

SEQ ID NO: 7383 - DNA, 760 bp, Diabrotica virgifera
ccccccccctttggacggctggaagttgtaggaagcccgttttcgccgtcctttataggcgaagtcaaccagagggttaggcgcaagcgatcaaataacaaagtacggactagctaacactgctcctctctgtgcggagtccgacaggcccacataaataatcgagatcaaagaagacacgccgaaagatgtaaggattggatcagaagacagagccctgatgctccaaggggcagaagtacttggagatggcgaggaagacacccaggaggcgaaggggcgtgatgaaaatatcgaacaatactaggggattacataacattacagaggaggggggtactcaacccagaggactagagctgaaagaaaaattccagaatattaaagctatactagtgcaggatgtagcacataagacaaatgagaacgctggcgatggaattacaacactgcgatcgatgagcccggacgattgacaaggaacgatttgataacttaagaagaagtgccaaccctgtgcgaatgcgcaaagggattatctcgggtgatgaagaaagcagtaaatcccgtaagtcactctctaaacctgtgccctcaccagcagaaattcgtccagctgctactatctgctgcaaaagtggaagactcatttggtcttttaattgcagaatgccatgaagaagagctggctaagggaagtgttatcactggtaacgaagggtagaccctttctgttgaattacaaattttttgaaggtat

SEQ ID NO: 7384 - DNA, 998 bp, Diabrotica virgifera
  misc_feature (18)..(35): n is a, c, g, or t
  misc_feature (590)..(616): n is a, c, g, or t
  misc_feature (627)..(647): n is a, c, g, or t
  misc_feature (654)..(673): n is a, c, g, or t
  misc_feature (818)..(838): n is a, c, g, or t
  misc_feature (878)..(896): n is a, c, g, or t
  misc_feature (899)..(919): n is a, c, g, or t
  misc_feature (923)..(942): n is a, c, g, or t
agttgtctgaaatcgaannnnnnnnnnnnnnnnnncaatgtttaaaaagttcgatgaaaaagaaagcatttctggagttttgcagttaaaatcgtctgtccaaaaagccatcagagccaaacttattgaatcctatccacatctagaaaattatatagacgctattttacccaagaaagattctcttagaatagttaaatgccatgatcatatagaaattgtagtcaactcaagtggagatttgttatttttccgccaaagggagagccaatggatgcctacattaaaacttctgcacaagtatcctttctttttaccaatgcaacaagttgataaaggtgccataagatttgttttaagtggagcaaatattatgtgtccaggtttgacttcacctggagcaaaaatgactgaagtttctaaggatactatagtggctataatggctgaaggtaaagagcatgccttggctattggacgaacttctttatccacagaggacatagccaaagtgaacaaaggagttggtgtggaaaattgtcattacctaaatgatggactctggcaaatgaaacccgttaaataagttnnnnnnnnnnnnnnnnnnnnnnnnnnnccattaaagannnnnnnnnnnnnnnnnnnnngataccnnnnnnnnnnnnnnnnnnnncataattgtaaactaaaaaagaatacaaaaaagaccaagaaaccaaaacaggtcacacaacgagacaacagacatcaaaaacaacttgtaaaaattaaaacattaaccataaaaaaataatgaaacaatactgggggggggcccnnnnnnnnnnnnnnnnnnnnnaagccggggggaggggaaataaaatttcttttatatgagnnnnnnnnnnnnnnnnnnnccnnnnnnnnnnnnnnnnnnnnngcgnnnnnnnnnnnnnnnnnnnnggggggtcaaacaaaaataaattctctttgggaaaaaccccccccctttctccccc

SEQ ID NO: 7385 - DNA, 767 bp, Diabrotica virgifera
  misc_feature (103)..(121): n is a, c, g, or t
  misc_feature (529)..(549): n is a, c, g, or t
gttcgtgcgagcacttcttcgagtgagtaggcagagtaggactttgctggtctcctcctgactacccaaggcaatctaaaatctgcaaagttccttttagccnnnnnnnnnnnnnnnnnnnccaaatgcctgacaaagaagttccaaaccaaaaaggtcgcaaagaagcacctgaagccaccaaacgtaccaaaaaggatgcaaaagctgaaggtgaatatgctccagtatccaaaagagggagaggaaggccataagggaaccgcaaagaaggctgaaaagaaggaaaccaaagccaaatcaaatggagtgagcgagcgaggtaggaggaaaaaggaatagaaagaagaatctgctgaatagataaaatggagacaaaatcaatgaaaatgaagaataggaagaagatgatgaataaattgttcgaatacatttcctttgcttttaaactattttttatacttaatgcttaatatttacggatttactttcagtatccatacttttatgtttatttaacagtacacannnnnnnnnnnnnnnnnnnnnctgatttgaatttgatattactacgaatccaattgcaggaaaatgatgcgatagcctctcattatttatttgtagttttttaactcatatttatatatcatcagaccatgtaagtcactcacactgaatgggatttccggaattgctgcatttatgtactcgattactactttatactgaaatacattgtgtatatataaaatgaaaacagaaggcca

SEQ ID NO: 7386 - DNA, 949 bp, Diabrotica virgifera
  misc_feature (83)..(103): n is a, c, g, or t
  misc_feature (275)..(298): n is a, c, g, or t
  misc_feature (930)..(930): n is a, c, g, or t
ttgccggttattagcgcgcttatcactatatatacataatatataatatacaagtgtgttaatttttaaatagggaacttgcnnnnnnnnnnnnnnnnnnnnnaaacggtatcaatcacaacagaacataatttagaacctgtatcaaagataaaaaagttttgtttgtctttcgtttggcccctaaagacgactaaaaattcaaaccagccttataccagccaccccaaaacgcgtcgtgacgtcacagggttgtatgtttacattctacaccnnnnnnnnnnnnnnnnnnnnnnnngacattataaacgtcagtaaaaaatacggttatgtgacgttaaaagtgtttttgatcgtttgaactattcatagaaaatttgtacttttacaaaatggttttattttcaatagtaaaccttctttccttttcttcaaaaactgtatcaaactccaatctcaacaaactggtatatattattacaacgacatacgataaatgtcattagaatataaatatttttcctttattccccgacgacgtgctgaaaaaatacccaagtaggtggaggccaataaactaaagaaatagaagaagaatatacgtaaatataaccataaacagaaccacatagctaagctctgtgacgtcacgggtcgtttgaactattttaagctaaagaagactttaaatttgtacttctaagttattatgagtttttgaagcgtgaaattttgtaaatctcatttttatacaaaactgaacattattatgtaatcaaaaaaaatgtgcaagttccctattaggcataggtactgacaactctgaatccccactttcaggattcacatttgtgattcgacagctgatactttgacaattagtaaatattgtagctgggtttcattcgatgaaataattcaattgcattncttctttgctttctatcat

SEQ ID NO: 7387 - DNA, 810 bp, Diabrotica virgifera
agtacgggcttccactcatatcacctgagaggagtctttgcgtaggaaggagttgtaacatatcacgtactctctctcacttacaacattcaaaaagaatctactctccattgggcactaccgcttatagggtgatagtacatctttgatgctgcttttgctggtagaaaacatcacccttgaagatgaaccttcggataccattgaaaacaacttccagaagaattcacgacgagaaagggataccaccagaacaactataatcactatgtgctggaaagtgtatggaacaaagccctgctctcgctaagtactgcactcaaaaagaatctactctccattagcatacttcttcgtataggtcggaatgcaaaatctttgtgtaaaacttgatctggaaagaccactctgcccgataacccaactctgtcaaatactattgaagacgtcccaggtgaatactcagagaggagaacggataccaccagatcaacaaatgatagtctttgaatgacaaagcactccggacatagactgactctctcatactacaacattcaatacaatctactactccattggtacttcgttttataggtggagagacaatcactattaaagtatagctggagaaatcccgcacttgcattagacctgcagatactatatatacgtctcagcaaactgcaggagatgaagtgtagctgccgatcacctatcttaatcttcactgagaactatgtgcaagatagacgtactctctcagactacaacgtatcatgagcaatctactctccatcctgctacttc

SEQ ID NO: 7388 - DNA, 961 bp, Diabrotica virgifera
  misc_feature (219)..(238): n is a, c, g, or t
  misc_feature (266)..(294): n is a, c, g, or t
  misc_feature (332)..(352): n is a, c, g, or t
  misc_feature (478)..(495): n is a, c, g, or t
  misc_feature (675)..(697): n is a, c, g, or t
  misc_feature (736)..(756): n is a, c, g, or t
  misc_feature (880)..(880): n is a, c, g, or t
  misc_feature (883)..(900): n is a, c, g, or t
  misc_feature (932)..(932): n is a, c, g, or t
attttgggaattcaattaaagactttaactgacaaattttaaaatgttacaaggttctagtcacgtatttagtctggacgtgcactttatagcacttgtcgcagaaagcatctaacccccaaacacgtatggtgatgtcctatttgcagaaaatgcactataatatacgatagtaattatttattgtcctctttcaggtgaaaacaggctttttgtaannnnnnnnnnnnnnnnnnnntaataggttaaaatgtacagtagacacnnnnnnnnnnnnnnnnnnnnnnnnnnnnnctatcaatccttgttgtaacatatggtaaggctgttcnnnnnnnnnnnnnnnnnnnnnaacatgtttttgaaaagttttgggcacggctcaagtattttattgtttaaatttaagatgaagtacgaatgggcgcgcccgaatccgacaagatattgtatagccccgtattcgttgtcaaaccannnnnnnnnnnnnnnnnngttaatttcggcgttagagttcaagaaggaagtagattttttttatacttatagtaaatatattatgggatatttaaagactggccgattggcttaccagacttacgtcccgcagatcttaaccggcgatgagtattcgaggtttgtttctggtcagattcgggcacgtcgtactgtacnnnnnnnnnnnnnnnnnnnnnnnctatcaatccttgttgtaacatatgggtaaggctgttcnnnnnnnnnnnnnnnnnnnnnaacatgtttttgaaaagttttgggcacggctcaagtattttattgtttaaatttaagatgaagtacgaatgggcgcgcccgaatcccgacagatattgtatagcccccgtattcgttgtcaaanccnnnnnnnnnnnnnnnnnngttaatttcgggcgtagagttcaagaaggaangtagatttttttatacttatagtaaatat

SEQ ID NO: 7389 - DNA, 52 bp, Diabrotica virgifera
tccggcgccgcccctttatttccccctttttttgccggaatttttgcctttc

SEQ ID NO: 7390 - DNA, 100 bp, Diabrotica virgifera
agattctacagtccaacatctgtatacggtttctcctcttacaaaaacgtgacatgtttgtccctgtcaactaaatcacaacataattcttctcttcctt

SEQ ID NO: 7391 - DNA, 849 bp, Diabrotica virgifera
  misc_feature (181)..(198): n is a, c, g, or t
  misc_feature (707)..(755): n is a, c, g, or t
ataataaagtcaacgatgacggatctttcacctttgtatatgaagctgccgatgggagtttcaaagaggaaactagaggcactgactgtgtagtaagaggaaagtatggctacgtagaccctgatggcaacaagagagaattcacctatgtatcaggaaacccatgcgatcctaatgcccnnnnnnnnnnnnnnnnnncggaaaacgaagccgacaacgaaaacattcctgctaattatccctcacgtcctatccaaccgcaatatcgtagacctccagtaacagctgcacccaagcctgctgtgactctcttccagaataactatgcccaagaagaagaagaaccagagcctgagcagcttttaagagtgacaccacaaccacagcctgtgcgtcgcccaacctacatttcacgcccacaatacgtgccacagacaacacccacagcagaagagcgtcccaattaccgtcaacaagtactttccagcacaacgccatcttctgtaatctacagaaccagcgctcatcctattagcatcactcccagaccagtaactactaccaccaaacgaccacaacttccagcaaccacttatagaccacagctgcttcaagttagtgttacgccaagacccaattctctattgtattctaaacagttacaatccactttacagcccactgccttccctgaaaagaacgacttnnnnnnnnnnnnnnnnnnnnnnnnnnnnnnnnnnnnnnnnnnnnnnnnnacgccaacaccttttactgtaaaaccgactacacctaagcctaaacctgcaggaaatccaggtcaggtttactctactgccttaatttatgatc

SEQ ID NO: 7392 - DNA, 499 bp, Diabrotica virgifera
  misc_feature (5)..(24): n is a, c, g, or t
  misc_feature (26)..(111): n is a, c, g, or t
  misc_feature (219)..(250): n is a, c, g, or t
ccccnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnncaacgccccaaaaaaaggggctgggggaaacacccgggggggaaaaaaggtcttgggccccctaaaaaaaagggggggatgtcttagggttcctataggagaccaggnnnnnnnnnnnnnnnnnnnnnnnnnnnnnnnngaggaggggggccaccccgggggagaggggataaacggggggggttttagaggggggggggggtcaacagggccacttttttacttgtggctagatagcgggaaaaaaccatcacattgagggaggagtaagaggagggggagacaaatgaggggcagagaacccacacgagcccccccattggtgaaaaaaatgcggggggggaccaccacagaccacttgaggcgtcctgtggggaaaagggagcac

SEQ ID NO: 7393 - DNA, 98 bp, Diabrotica virgifera
  misc_feature (2)..(96): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 7394 - DNA, 546 bp, Diabrotica virgifera
cgggccccccctcccgcgacccacgggtaaaagctggatcactatttaatctgctcagtctgaggtgattctacttcctactaggtgttctgttaatatataataaagtatcaattcggagatgctacctcacaccatagaagcacggatcttgatccagatcaagcatacctgttgcaagtcgctatgcctcaaacaatctgtatccaacctgccggttgttatggcataagagaatgactgatggacgagtatcacacaggatcgtcaccttcttgcaacgctggagattaccttcaaacatgtacctagagctggatttgtacaatcaaaaccaacaactccagaagacctacaaacacggacatcactgacaagagttccgccacagaaaacttcaactctagtgaataaaataccccagaataactatgtctagaggccactatacaaccgctaaagaaagatagacttggcaccggcaccgaatcacgcaccttgagatgtcccatgagactggacttcatggcctcttgcttttccact

SEQ ID NO: 7395 - DNA, 572 bp, Diabrotica virgifera
ttccgggcgacgcacgaaaatgaagagactagctatgcgccttttttgcgtattgatgattgatcatcccacgttgttttttagtactgcgagataaaggtagtatgtgatcattgcttttttacacataagagaaaacgaacactttctcgtaaggagtgttaactatgtataggctgattaagcaatattgaacagaaagaaaaacgttactcgtgttgtaaaaaacgaagacacacacatcgatgatggaagagaggtcgacacccgtatagatatggaggatagtacatcaattaatgtccatatcgttacgttcattaatgtaccaacgatgcactctgaaaaaatcgatacatacagaactaacaatactaagctgtagagggaaacttactttctattcttgaataacctattaactaagactactagagtcgataccccccgagaatatattctatattttagtctatctctagcttcccattattatcaatgaactagtacataccagcaagtaaatgactcaacccacaaacaagatgagaacactatcagtaaaccaatat

SEQ ID NO: 7396 - DNA, 349 bp, Diabrotica virgifera
  misc_feature (33)..(52): n is a, c, g, or t
  misc_feature (54)..(66): n is a, c, g, or t
gcctcatacaatggcacgcaacctgacggacgnnnnnnnnnnnnnnnnnnnngnnnnnnnnnnnnncacgaccggatcgtcgcctgcttgcaaggtgcagaatacttcatacatgtacctagagctggattatgtacaatcggaaccaactgcaccagaggacgaacgatccgggacatccacgacagatgttccgcacagaacaattgatctatggagaagaaaatgccatgtatacctatgtctacaggccaccacacatctgcgagaggagagagattacttggcattggacccaatactcactttggatgcctcaagaactggacttcaaggcctcttgcttttc

SEQ ID NO: 7397 - DNA, 953 bp, Diabrotica virgifera
  misc_feature (35)..(77): n is a, c, g, or t
  misc_feature (653)..(684): n is a, c, g, or t
  misc_feature (842)..(842): n is a, c, g, or t
agaaaagcaaagaaaaatagatgaatcggaaccgnnnnnnnnnnnnnnnnnnnnnnnnnnnnnnnnnnnnnnnnnnnaaggtttcaccaattggaataaacacgatttcaaccaattcatcaaagtcaacgagaaatatggtagggacgatattgagaacatcgctaagtatgttaaaggcaaaacgcctgaagaagttatggaatattctgcggtgttttgggaaagatgccatgaattacaggatattgataatataatggctcagattgagagaggagaaactgaaatacaaagaagacttagtattaagaaagcacttgatgctaaaatggcaagatatcgtgaaccattccatcagctgagaatttcttacggcaccaacaaaaacaaaaactacaaggaagacgaggacaggtttttggtatgtatgttgcacaagttgggtttcgataaagaaaacgtctatgaagagttgagagcagctgtacaagcatcagaacaattcagagattcgctcttaaaatggagaactgctacggagctgcaaaggagatgcaacacattgataacgttaatagaaagagaaaatgctgaattggaggaaagagaaaaaattaacaagaagaaagaagtttccaaatcttcaaatnnnnnnnnnnnnnnnnnnnnnnnnnnnnnnnnatcttcacagaaacggaagaaagacacttctgctggtggtatacaaaaaatagaaaaaattgataaggagaaaaaagtttccaaatcttcaaatcttggaggtatccctgcccaaatcagctcgaaatcatcacagaaactgaaggaagacacttccnaaatactgtatattgcattaaaaaatataaagagaaaataaattatgtgttcgaatacttatcttctttttcatgattatgtaggtattcctgcccaatcagctcgaaatc

SEQ ID NO: 7398 - DNA, 873 bp, Diabrotica virgifera
  misc_feature (795)..(795): n is a, c, g, or t
  misc_feature (812)..(812): n is a, c, g, or t
aaagatgctgtcgatattttctccatttgaacaagatcagttgctgtgtctcctctacgaaccactgagtattatagaaattttgattatgaataccaaattggacaaattagcttcagttttgaacatagttaagttagaaatatctcaaagcgagtttgacacagcagttatatctatcaaagaaatagacgagttattacgaacttatggagaaaaaactcttgacttccgaataattactcagccaaaccctcgactgttacgaacacctgaatttaagctcatgcagtcgttagattcgttgaatttggggccctacaataaaaatttcgtaatgcccgatgaagttcccatcaaagatgattggatacctaataatgaagttctggagtgtatgtgttgtcagaagatcgtgttttccatgttcaatcgaagacatcactgtaggagatgtggtagagttatttgctataactgctcgttgcatagaatgttggttccaacctatgatgacattttagtccgcgtttgtttggactgttacagacaaactgtaggagagagcgaaacatcagaactaaatgattcactttcactcaaatcggcagtatatgatttttggattttaacagatgacgatgcacataacacaatagtcagagaagaattttcttacgaacacgctcctaacgtgtcactgtgcttgtcccttatgaaataccattcgaagacaaccgaataccctaagttcctattagatcaatgtagcataatggtaaaattacttcaacncagtcaagaacctatcncagaaatcgactatcttctgggtataaaaatgataaagtcattagcaatggcagcaaaaat

SEQ ID NO: 7399 - DNA, 734 bp, Diabrotica virgifera
  misc_feature (356)..(356): n is a, c, g, or t
  misc_feature (546)..(565): n is a, c, g, or t
ccaggacctcccgattcgatgaggccaaccgtctccgatacatgaaagaccgcaccgtctaacatacattcgcaaaaatcctgactatctacgcaaacatgatatccttgccccactcttccctgcattcaccaaagatcctatactagaaaatccacatactaacctcctacaactacgaatcctattgttgtctccaaagaggaggatcataagcgaagactaatctatagatgattgttcgagcgcaatgtcaaccaaaaacaatgtatgttatatgttgagcgatatcgccccatcaccacacataaagctccttttagccattgaggaccaatcggaacctcacatatagnaatctctcattcgcaggcctacttcaataccactattggagtagattatagaaaaacgccaactccaccaagaagtatcattatctgcagagtatgttgacctaaatgacgactagcttgatcttcttttagaacatctatataccaatgacacaaatttgaaactaatttacctggaacacattgctcnnnnnnnnnnnnnnnnnnnnactgtacttatgatgagggcaaatggaaaagacgaacctccagatgagaactccgttgataaactcgtaaaagatgatgattcaattaatttgaaaatccacttagctcatccatactctagatatcgcttcaccatacctgaatttcaacacatcgcttcttaatatt

SEQ ID NO: 7400 - DNA, 857 bp, Diabrotica virgifera
ctcttcggaattctcaacagtgtatacggctcccaaactattctaggaagatgtcgaaaattcaaatcaacaacccttatcgtattggtcggctagccctccatacctgtctagactatcgaccggaagaccctcctggcagctatcccttccttgatgtacactacatgtgatactcgtactgatattattctacccactgacggtactcttgacgacaccacatagtagacacttcctaacatgatgctgatgatatcttttcctgacaccaacaacgaaaccctcttgctattccttggaaactggctgcgggaaaacatgatgcaaagtctaccggacagtgcccccgatcgaagaggaccaaacctctctctgtatgcgtggataagaaagaaatgatctgccttccgtctgctgatgctcctatggatgcctgagaagctgacttctaggcctacgatcgatgtgatctcattctcccctccgatatttgcactatcttctggctcgctcccctcaacaacgtcatcttcaacaacttctattgcgccgaaggcaatatgtgccccagcaatatctatctggacactcccttctttgacatcgaatgctcactaaccattgtcttgagccaaatctacagaccacaacttggacaatctccattgcaaccggtagtcgcctaaacatgatgacttaggaaactgcagagccagtatacgcaagctcctcgaataatgtctttaacgtgtcaactgtctcgaataacatcttctccaaacatagattgatcaaccaagaattgactgcaatcaccgacagaagacaaccagtcactgaagatgctcactatc

SEQ ID NO: 7401 - DNA, 351 bp, Diabrotica virgifera
  misc_feature (82)..(99): n is a, c, g, or t
  misc_feature (270)..(339): n is a, c, g, or t
caacaacttggacaaggcagaccagtaccactaaatcaataccaagacattgataccaaccaaatcttaaacctcatctacnnnnnnnnnnnnnnnnnnggtagtgcttacccactaaaccaatacttggttagccaaagacaagttaattccagcaatcgaccaaatgtacaaccagatggaagacactcctcctagagatttatgcgtagagttggaattctgtaattaatttgtttgttagaatattataataaaaactcaaaattnnnnnnnnnnnnnnnnnnnnnnnnnnnnnnnnnnnnnnnnnnnnnnnnnnnnnnnnnnnnnnnnnnnnnncaaaaaatcaaa

SEQ ID NO: 7402 - DNA, 701 bp, Diabrotica virgifera
  misc_feature (355)..(355): n is a, c, g, or t
tttgtggcggagaggcgcgggcgagaagagcgccaggggaacagtttttgagcggcggcgccccaacgaaccaccgaggagcacagaaagggagaggaagaagaccaaacgggacaaaccaactccagagaagaacagagccaagagagaaacaccccaaagcgagagagacacagcagcgagacccaacaaagaaagagacgagagacgacgaacggacggagaaaaaacacaggacagccgaagaacaacacagccaaacccccgacagacacgaacaccggaaacaaagcacacgcaggcgccagagccgaagaaaccggggcccaacaagaaaaagcacggaaggcccgangaagcccccaccaaagacgacaggacaccgaagaaggaagcaccggagcgaaagcgaagacagaagaccgagaggaccaggggcaaacgaagacagcaccggaggagaagaggcagagaaaaccgcgacaacggcgcggagcagagaacgcgggacccaaccaaggaagacgaacaagcccgcgacagcgaggacagacacagacaaacggaaggagagagcgaaacaccagaacgaaaggacccacagacacgcaaaccggcagcaaacgagcggcggagcgcaacagaagacgacgcacataacacaaaaggcagagaagaacaaacacacgaacacgcaccca

SEQ ID NO: 7403 - DNA, 791 bp, Diabrotica virgifera
  misc_feature (468)..(487): n is a, c, g, or t
ctccttttttaatttggctaaatatacttatcattttacataaaagacgttgttttcgtacttaaataaacttttatgtttaaattttcgaacggaacgcgtctaatttaaacgattaccctgaacggtgaatcacttggctcgtgggtcgatgaagaacgcagctaattgcgcgtcaacttgtgaactgcaggacacatgaacatcgacatttcgaacgcacattgcggtcctcggatactcgttcccggaccactcctggctgagggtcgtatctatttcaaagactgctcggttttcttatataggaaaacgtcagagcgtgttggatgttatcgtgtgtgtatatgttttttatgtatatatgcgacatcttaaaatacgaaagtaacgtatacaatccaattggaaattattacgtattttgtacacaacaattcgtttacaaacagaattaatattcacacnnnnnnnnnnnnnnnnnnnnttgactggtgaaaactaattgtttgcacgatcgtcgtgtccgagaaaaacttcttttgaagatgacgtctgatctgtgcctagtttcaacgcctgtttataacgaatgtatgtatgtgggtgaattttgttgtgaggaacgtgtgattgcgtacaagattttaaatttagatttatcgacctcagagcaggtgagactacccgctgaatttaagcatattactaaccggaggaaaagaaactaaactaggatttccttagtatttgcgagcgaacaagggaaaagcccagcaccgaattcccgt

SEQ ID NO: 7404 - DNA, 600 bp, Diabrotica virgifera
tgtgtatgtatgtgtggaatatgttagatgctgtttgatatatggaaaggtacgagataatttgatttgatgatgtagaatttatcgagtgtaggatactgttatgatgttggtgtttttggtcacgtcgaatgatattatttctatatactacatgaaatgtataggcacttatgacgataagagataactcgttccgaagagagattttctttttacaatcggataggtttggatatgattatcaatcgaagagtttttattaatggatagagatgtgtgctttgagaattgatgtaggaatctgtgggtatattgcggcaattgatcatggtctggaacagtggaataaagtgaaagcattacttaggagtacttattcgaattgggaggttagaggggcctatagattgtgaactggaggtaccgatatgcaagtgaagctcttgactatttcatctgtgtagtatgtggtgttgtgaagattatatgatattgcgactttttttatctttacattactaaagtagtcaagggaaagaaagtactatcgcccgtttacccccctcttatataagagttaactggactaacatttta

SEQ ID NO: 7405 - DNA, 979 bp, Diabrotica virgifera
  misc_feature (956)..(973): n is a, c, g, or t
ggtaaatggcatgttaaagacttaaaaccttttgtatgtgatgaagataatatgtcatccccttagtcctgatcccctattccctgttccccctgtattgttcttcagttcccttagtcttgataagaagttgatattctctttgattttggtatgtcgtcttttggtccctgttgttgtcgtatacccccttgtatgaatttgttgtgatttggcccttgttgttgttgtataccccttttttagtcttattttattttggtctagttgaagtgagtatattccctgtgagacgtttaacataaagttaccgatctcgacttgagacaaatgttaagattacgttgtctcattgaggtatttagaatggagattctaaatcctcatttttgctgaaccgttgccaacaaaattccctgaaactcgctaggcgtttagtggagtttaggcagatgcctatctgctgagcctagagctcaaatgatttttttagttctcgaaaaccgctcgcggttaggcaacgaggtgacaaggctgtgcctgccctgatatttcacttgtgttactgttgtggatgtcagcgaggtccacacagggcacaatgttagcttcttccccaaggcacagaaactcttgtcacctacagttcattttagagtcattacacatttcagtctactcgactttaaagagtctggcgattgatggtacgctagcccaatccctaacgtttgtttgtttaatttaatccccactagccatcatctaaaaaaattttgatgtgattgtttagcctcactcaaggagtcatggttgatttttgttttggtttatcgaaaactggatagctatccgagctttctctttttcggaggaggctgtgtagcgtttaaaaaaccagtgaaaatatgatctttagatttgtatagattttacaatccctctctaagaagtcnnnnnnnnnnnnnnnnnnttttac

SEQ ID NO: 7406 - DNA, 412 bp, Diabrotica virgifera
taccccgatgaggaaccaggtcgaacgagcgtggagaccaagcgaggaggtcggatcgcctagggtagagcccaagtcgatgagctaattgacaggatgggagacaatcacgcggcgaatgcggtcaaggcggtcaatgacccccactttgctatgcccgatgacgcgaacgtggaggatattgatattagaggggaccctatggcggaccggtagggaaattagaccgaaatggatatgctcctcgtggttgacgacccccacgtggctttttccgtcgaatggatcgtgtaggcctgcgacgagacaggactacggttgccaggagagccacgatcagggtggcgagctacacggtcaagaaggtggaccacgtggacctcgtggatgacgctgcggtagacttgaccca

SEQ ID NO: 7407 - DNA, 998 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(433): n is a, c, g, or t
  misc_feature (481)..(507): n is a, c, g, or t
  misc_feature (614)..(661): n is a, c, g, or t
  misc_feature (685)..(702): n is a, c, g, or t
  misc_feature (712)..(735): n is a, c, g, or t
  misc_feature (775)..(830): n is a, c, g, or t
  misc_feature (836)..(857): n is a, c, g, or t
  misc_feature (869)..(884): n is a, c, g, or t
  misc_feature (886)..(978): n is a, c, g, or t
  misc_feature (983)..(996): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactaaggggggggggccccaaaaaaaacttcccttttctcaggggnnnnnnnnnnnnnnnnnnnnnnnnnnnggcgccccaaaatatatttcgcgggggctgtttaaaaaaacgggggggggaaaaaccccgggggtcacccccttttttcgcgtggcgaccccccccccctctccccnnnnnnnnnnnnnnnnnnnnnnnnnnnnnnnnnnnnnnnnnnnnnnnnggggcccccaccaaagggggggannnnnnnnnnnnnnnnnngccccataannnnnnnnnnnnnnnnnnnnnnnnaaaaccaaaagaaacccccactctttccacccgaccaaannnnnnnnnnnnnnnnnnnnnnnnnnnnnnnnnnnnnnnnnnnnnnnnnnnnnnnncccccnnnnnnnnnnnnnnnnnnnnnnttcctttttttnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgnnnnnnnnnnnnnntc

SEQ ID NO: 7408 - DNA, 983 bp, Diabrotica virgifera
  misc_feature (715)..(735): n is a, c, g, or t
  misc_feature (826)..(826): n is a, c, g, or t
  misc_feature (840)..(852): n is a, c, g, or t
  misc_feature (854)..(866): n is a, c, g, or t
  misc_feature (884)..(884): n is a, c, g, or t
ggattctgcttcatcacatttgaatctgaacaagtagtgaatgagttactcaagcaacccaaacaaaccattaaagacaaagaggtcgatgtaaagaaagccacacccaaaccagaccaaatgggcggccccatgatgggcatgcgcggtatgcgaggcggaggcagaggcggtccaatgaggggaggtcgcggtggccgaggcggctacggaaaccaaggaaactggaaccaagcctatggtggctatggttatggccaaggatacggctatgatggctacagccaaggttatgactactacggcagtggctatgggggttatggaggttatgattactcaaactatggcggcggtaactacgaccagggatatggttatgacggaggatatggtggtggtggcggaaccggacgcaatgttaacactcgtggaaaaggtggagccggcggataccaatctggtggtgctggcggaggccccaaacaaagaggagctggtcaacgcaaccaaaggttccaaccctatcagaagtgaggctggttaatatcataagagaatagttcgtgattcaaacattttccgtaataagtcatctcatcctcaactgaattttccaatcattccatttcatcgcggcgcttggaaaatatacccgacaacgtacaaaatttttatgttacaagtccaacataaaagtcaactatccagtcgnnnnnnnnnnnnnnnnnnnnntgataaatcggttaggaaatgttaaaacaaattgatggtcttcaaattatgaatttatatataaatgatacattgagttttgagttagtcnaagatattttctcnnnnnnnnnnnnngnnnnnnnnnnnnnaactctagtatgatgtanacgtaagttttaagtttatatgtataacttgtatgagtgaaaggaggcgttgtgtacttccatgtatgacaaaatttaataaaacgataaattttgtgt

SEQ ID NO: 7409 - DNA, 332 bp, Diabrotica virgifera
  misc_feature (185)..(207): n is a, c, g, or t
ccctttccgcataaactggcgactatcctattggaagagaaaagcagtatcacaaatagagcctgagtttctagagggcaacacaaaagatgtcaaccgaatggaaatccataatagcgtcgtttttcacaaatttcacgagtattgtcaaaaacaacggtaacaaatttggggggaaatacccnnnnnnnnnnnnnnnnnnnnnnnatacggatctggaattggaaaaattcaagctacacgtctcgattttggccattttgtcaatcacgctattttcaataatgaaaaaagccattctattatctgggaatctctttctacttgaagga

SEQ ID NO: 7410 - DNA, 415 bp, Diabrotica virgifera
  misc_feature (9)..(188): n is a, c, g, or t
  misc_feature (375)..(405): n is a, c, g, or t
aaagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaaatacccttaaggataccagcgtaattcttattggagagttccaatcgaatattaaagatggcgaccctcgatgttgggataaaagttataatgggtgtaccagtatattatcaagtctgttcaactttttaaatttaacttgatcggagttaaacccgtggggagccagggtggttctcnnnnnnnnnnnnnnnnnnnnnnnnnnnnnnnaaaaaggacc

SEQ ID NO: 7411 - DNA, 939 bp, Diabrotica virgifera
  misc_feature (529)..(560): n is a, c, g, or t
  misc_feature (892)..(892): n is a, c, g, or t
gtttatagaatttcttctatgttggaatttttcggattcatttgttttaaaatgaatccgacgattgtagtgatatggttgttttaggcactagcatgaatctgagttgttgctgattaaaaccatagatgtaatgtaccattgccatatatactataactttatgtattaccccgacaagccatcagtattgtttatgtatgaaatcgtccatcaattagacagaatatgtatcagtcgatcaatattgatttctaaattatttattactctggtttaatcttttacaaaatccaacaagtgactatgtcaattagcgttaagtaactttaattgtctatgtagctcttctattccatttcaaaaaaactttcaaaaggatttcaaaaacatattggtcctaaaaattccctcttttgtttgtttttagttaatatttgcgcacataacaatctgcatagacatatagcgttaagacttcaactgaaccgtctgtgatcgataaaatatttgattttaacaatatttnnnnnnnnnnnnnnnnnnnnnnnnnnnnnnnncaaataatgttgttctaattccatttaatgtaaatatcgatgtttttgttgtcataaaattaagaaaaatattgttggatttagtaaaatgattgtgttcaattttgaaatcgattttcgctcgtattgctactcataatgaatattaaggaattcacattctttcatgacttattcgaaatttcttttgctcaattatcttaagttttattctatttcgcatctttgtacggtatttcgtgcctacattaaaaaagtttcttggaggcgacagaacgggcgcggagagactaatgtgtacaagtctacacaaatatctgaaaccgccacgntcagacagatcgaaaacgtggttacgcgacgttgtcagatcatcatg

SEQ ID NO: 7412 - DNA, 886 bp, Diabrotica virgifera
  misc_feature (225)..(243): n is a, c, g, or t
  misc_feature (736)..(736): n is a, c, g, or t
caaaaatatagaaataacaagtggagtacgacaagtcactattcaatgtcgctatagaaggaacaataagagctacagaaataaaaggtgcgattataacatcgatgtcgcaacttatggcgtatgctgacgacaaagcattaattagcagaaacctaaacagtttaaaggaagaatttacgaagttatgcaaagaagcatccaaaagaggtttagaaataaatnnnnnnnnnnnnnnnnnnngtaatatgctcaagaaaaaaacccagttaatatcataagcttaaatatcggtgaatatgaatttgaaaaagtagaacattttaaatatcttgggagtctcagttaatgaaactaatggtagaagtatcgaaattaatgaaagaatccaggcaggaaacagaacctactggaaatacagtaacttcatcaaagataagaagcttactcagaatacaaaactgaaaatttacaaagcagcaattagaccagtaatcacatatggtgctgaagtaatgtgtctgacacagaaagaggaagaaagattgaggatcctagaaaggaaaataattcggaggatagcaggaccactaaatttaggtaataataaatttagaaaactcatgaaccacgaagtaagagaacttctgaaaggagaagacatcgtcagatttatcaaggcacagagactcggatggatgggacatatagaaaggaggaatccagaagccgtatncagaaaattgccaaatggagacctgtatcaggcagaccacgaggaagacccaaaactagatgggaggatcagatagtggaggaccttaaagaagatgggagtcagagaataggtaaccagaagcaaaaacaggaacgaatggagggaaat

SEQ ID NO: 7413 - DNA, 490 bp, Diabrotica virgifera
  misc_feature (420)..(438): n is a, c, g, or t
  misc_feature (461)..(480): n is a, c, g, or t
ttgaaactaagtgcacaatatgtcaaataatacagcccccgacagttgggaatctcaagccgattctacatcgacgaataattcgccacaacatactgcagatgtgacagctacgttttccacgttgaatgttaacgctgtcgaatttgtgccttcattttccttttccaaaggaccagaaaaagacgagggctcttcccccacgaattccccaggatctaatagttcacccccacataatcttataaatggaaacgttcctgatgaatctacagagcgtggggaaggcgagggaacaccacccatttctcccgcagacagcgacgcggcccctggcggggaaggcggcacctgggagggcgtgggagatgaaaaaaaaacttccgtttttgcttcccccgctaccacccctggaagggnnnnnnnnnnnnnnnnnnncctcgcagggaagttccctctannnnnnnnnnnnnnnnnnnnctaaaaagaa

SEQ ID NO: 7414 - DNA, 201 bp, Diabrotica virgifera
  misc_feature (7)..(44): n is a, c, g, or t
  misc_feature (79)..(96): n is a, c, g, or t
  misc_feature (109)..(130): n is a, c, g, or t
  misc_feature (160)..(188): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnaagcctgttcgannnnnnnnnnnnnnnnnnnnnnaagttaaaccggtgggaagcaggtgggttnnnnnnnnnnnnnnnnnnnnnnnnnnnnngaccaaaaggacc

SEQ ID NO: 7415 - DNA, 100 bp, Diabrotica virgifera
aacggaaaatcagtacagttgttgatcgacaattggtcattagtactctacacagccagactattccagtagcctttcaaatgctagtaatactctgtat

SEQ ID NO: 7416 - DNA, 279 bp, Diabrotica virgifera
  misc_feature (23)..(38): n is a, c, g, or t
cgtttgcgcgaaagtaagataannnnnnnnnnnnnnnncccccctacacaaagaaaaatcaggttgtatccgtagagataattaaaggagttccagaggtctattcttcagccctaattccccatggatgtcatcgtggattgcgtgaagcagcacatactacgaagataacacaaatcgcagtttgtgtgctagctaaaaactgagacgcacctctgtagaaaacactagccacggcatcatgataagaagatcaaataccacttataacggacgaca

SEQ ID NO: 7417 - DNA, 732 bp, Diabrotica virgifera
  misc_feature (291)..(308): n is a, c, g, or t
ctcgtatgtaaatctttccaagctcctccattgattcccagtacgtcactaatatctaatattatgcagaatttttggtgctggtcaccattttatggtttcttttgcgctctgtttcatacgagtcgtatgtatatcatttttgatttaagtatatccaacatactgatgaatttcctcttaatgtcttacagtacatgtgtccttctattatcctaatactagaaccaagggaaatgtaggtgctatatctgttaggtttcacacattctttgctggtcatgatgaccnnnnnnnnnnnnnnnnnntcagtttttaatctgctactgcttacctttctctactcgccttctaatcactgcattgtctgctaaacactgcactaatatagtactatccgaatatttttaaagattattcctttaggttacatctgaaaaggcgcatgctcgtttttcatagatattactatcaccgtaaccttaaagggattcaatagaaatacttgtgattttgcacatcttttcaatcttactcttacagtgattaacttcttttgccgaatcctcgaattctcatttcatatgtattgatttattcgaaaaagatatttgcagaatattgaatttatttactactactaatcctattattcatcaaaagactgcattaacttgaacataaaatgaaaaaagatcgtagaaatatgctcttttctagaatatcgtccag

SEQ ID NO: 7418 - DNA, 1004 bp, Diabrotica virgifera
  misc_feature (745)..(745): n is a, c, g, or t
  misc_feature (834)..(834): n is a, c, g, or t
  misc_feature (875)..(875): n is a, c, g, or t
  misc_feature (878)..(878): n is a, c, g, or t
aaaacttaaaattcgcattatttgaaatgttgttatttaatttttcatgtttaataaagctttagtttttcagtgtcgtttgttttggcgcattgtacttagcctccgaaagacaaacgaaaattttggaaaagtggtgatttagttctgaacgtagtctccttttagcttaatatacttgacgcagcattgcatcgacttcgttaacccgtctgaaaaagacgttttcttgaggtcttcaaaactggcttccatagcggtgataaactacgcattcgacatatatttctgcccgtcgagttcctttttcaagtttggaaacaaaaggaagtcatacagggccgaatctggagaatacggtggatgagatagaaggtcgtagccacattcgaccagtttggccatggcgatggtggaggtgtgagccggggcgttgtcatggtggaagagtacttttttcttcccaatcagggctgttttttctgcaattcggtgtcgaatcggcccaataatgcggcggcgtattaaagccctgtgaccgttttgcctttttccaagaagttgatataaatcacacattgttgatcccaggatacacataccgataggacaatcttagcatttttcgagcacgttcgcgggggtgaggttcactgtatggactattccttggtctctagtgactaccggtagagccatgtttcgtcgagcgactacgaactcccccacactagctagattttantgagttcagttttatagtagaattaaaagcgactacgaactgtcccatgctacctaggcacttagataaatatttttgtgaacatatantagttttttattttactttactgtattcaaaaaggaacccnaanttccaagcatgagcgaaaattttaatgattaaataattaactataccatataatcgataaagtttattataatctatattaactatatacataacaaaaactacagtaaacataatgtttattcta

SEQ ID NO: 7419 - DNA, 999 bp, Diabrotica virgifera
  misc_feature (255)..(273): n is a, c, g, or t
  misc_feature (288)..(310): n is a, c, g, or t
  misc_feature (462)..(484): n is a, c, g, or t
atgatacaatttactattcatgcttcattcattcatgctattctttagagcattccacagtgatctgttaaaatctagacgtcacacgaagaactggaattttccaagagtatcgaacaacaaaatatccaaatgtaacctcaaaatagtatcattcgcttatacaaaacaatgctataatatgatccttgctacataaactcactaatcacagttaaggggggaggggtatggtttgacatcagcatttcgagnnnnnnnnnnnnnnnnnnntgaatctatattagnnnnnnnnnnnnnnnnnnnnnnnagattcagtagagataggcgttacctcacgaaatatctaaagaaagtctgcaaaatttcaggtggatcggtaaaatagttttggagttacaatatccaccacctttgaaaaaagcagttttgagaaaaatgcgttcaaagttttgaaaactnnnnnnnnnnnnnnnnnnnnnnntgtcaaatcgtaaagtaatgcacaccgaaatatgtttttgcatcgcggagtaatttacaaaaggggaacagctgttgaacgtttctaactacgctcaagcacgctgtagcgaagctgccgcaaagcgagtcgaaggtagggatatttacttgctgtatctctggtaattttactccaatcaatctgaaattttcggagagtagtcttgaagttaattttaaaatttcaaaccgtttcaacctccccccttaatcacaaaaccttcaactgtgttattcacttcacttcaaatcgagttatacctataacactctactggaaagattcatactctatgtgttgtcacgttctagtatttcataaatattattaaaagcgcttaaaatttcagctagatggacgaaatttacttttttagatccctagtttttcaaattttacgtgctatattttttctgcgtacgatatacctcctcgcacattataggtactggagggaaaggttaacatcccta

SEQ ID NO: 7420 - DNA, 607 bp, Diabrotica virgifera
ccttgtccggattgcaccggtagaaaccgcgcttctcgatggcatttagacggcgatccgtgctacagaagagcggacacaatatagatgaaaaatacgaaaatgaagatgtacgactatgtgtcttctgaaggtgccattatagatattcataaacttgctcaaaacccagtaactgtcgccgtctccctgcaaaggtcacaaggtccaacagaaactgtaagaaaggatgaaccaagaaacggaaaacgacatgggtgagggaatgcgcgaaggagaaatgagcttaggaggcatccagactgctgcgcaaggtgatcttgtctgttgatgagagagagataggggatggagagatcttctatagtttgttgtacaaaatgcataaaatgaggtagtatgaagaaatcaaaaaaatagtcgagaacggagtagtgaacgggtagcatcgaggtggaacatcgactaccacattggctctctgcgaggactctcaagagatggtaagtgcatatgacgatcaatacgatagtcccctctcagagacatgttaaataatgaagtgcgaggaaagggatgcaatcaacggtggctgaacatagcaaca

SEQ ID NO: 7421 - DNA, 862 bp, Diabrotica virgifera
caacagtggtctctgagttagccgcggaagctgcaggattaaaaatgtatcttaatgagacattcaccaccctccgtctaagggaccttgacgtctggtccaaacatctagccaattggccaaaaagagcccctctttgcgttcacgctgagtctcagacgacagcagcaattattcttttagctagtctccaaaatagaccagtccatatatgtcacgttgccagaaaggaggaaatactgctcattaaggcggcgaaggaaaaaggattaaaagttacatgtgaagtgtgtcctcatcatctgtttctttcaactaatgatatagagaaaattggagtaaccaagagtcaggttagaccagttttggtatccccagaagaccagcaggctctttgggataatctcagcattatcgactgttttgccacagatcatgcacctcacacgattgaagaaaagcttagtgagaaagctcccccaggcttcccaggactagaaacaattttaccccttctacttaacgcagtcaatgaaggcaggatcactttagaggacgttattaataagttccacaaaaatcctaaaagaatatttaatttgcccgaacagcataacacgtacgttgaggtagatatggaagaagaatggactattcccgaagctatgagttacagtaaggccaagtggacaccatttgcaggaagaaaaataaaaggcgctgttcatagagtggttcttcgtggagaagtagcctatgttgagggacaagttttaagtgcaaccaaggcctttggtcaaaatgttagagaatgggataaaagattgtataccacttcccgcgacatgagccgacccttcct

SEQ ID NO: 7422 - DNA, 956 bp, Diabrotica virgifera
  misc_feature (241)..(258): n is a, c, g, or t
  misc_feature (783)..(783): n is a, c, g, or t
  misc_feature (807)..(807): n is a, c, g, or t
  misc_feature (834)..(834): n is a, c, g, or t
  misc_feature (839)..(839): n is a, c, g, or t
  misc_feature (931)..(931): n is a, c, g, or t
gagtggagagaatttatagtgtatgttaaaatgttagacaaagaaaacatgaggaatttacttacagagtcttacgaagggtcccttccagtattcagccacaaaacttacgctgagtttctagctgcaaagtggctaagcgagcattttaatcagaatacgcggtttgatgttaaaatcatttataaaaatttatatacagagcaattggtaacggcaagatggttccttgatacgatgnnnnnnnnnnnnnnnnnncatactaaaaatattcagttacctaccattggttgttgcacgtatttgtccgataatattggacgaaatcagatacattataccatgagctacgggaagacatttgatattcacactcaaattgaaaatccagaacaaactactattattcgccgaagtaatgaactgcttttaaaggtatcccaatcagaaccaaccaagcttaatcaagatgagccagatataaatctttctgctaacaatttacttggagtttctaataaaagctacgatataaacctatatgttggccttaaccagtttcataatacaacaacatacttcagtgatgaagagcctgtaaaatttgtcctgtattttgacatcaacaacgttaattcttctaacatatctactatttacaaattgttgttcaatgaatgtgatgatcttcttggaaaatccgcagtggaatatgcaattttggcaggaactttaataaatatcgaaaaagtgctaggttacaatatcgtatataccacagtntgatttttccaatctaggcgacgnaaagtatttcatggtatattattctgncatanatggattcagtaggataattaaaaagcttctgaccatagacaatctttaagaatgatgtaataatgataaaagactataatacagagatgangttactacacttagcaatcaaatat

SEQ ID NO: 7423 - DNA, 866 bp, Diabrotica virgifera
atttgttgtacatgcggcttctttatctgacatttcacaaccatcgaaaagctactttcgaccaatccatctctttccccccactttttcttgcattatatggcgaactacatgtaatttacggtcttcgtaattatcgtatggacaaaacattcttatatttatacctagtcctatttactttctgaacttttattttagaattattttttgcttttttgctgggattttttatctgattttttggaattctttaccctgtctttggtcacccctaacggatggcgccctggtgcattgcatactttgcctgatgccagcgagggccgtgtatttaggcatctatgtcttggccaacaataacctaaaaagatcaaatgtcaatttcgttcttctactcactctactgataaccaaagtgtaaacgattattgctataatgtgcttatagacacttatacactatcttggtgtacatcatgggtttctataaatacttactagagtatcgacacgaggctatcaccctttcaatgaagcatcaaagaccaaggagaatcgctagcagagctttgttacgacagcctatgcataaacctctacaatgacaatttgcacagttcttttgacatgcgtcagacaaaagctagcgaaaagtactggatttgcatctagctgtaaaacactgaaaccgtctgttctctatcgtgtagcatcttagtgtgcaacttgcattaagaactaattttacaatttcttaagttgtaattattggatttcggcctagtatacgctattttctatgtttattattcgagaacttgtatatgaattatgatcttttatttcttcttgccgcatgatct

SEQ ID NO: 7424 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7425 - DNA, 440 bp, Diabrotica virgifera
  misc_feature (18)..(35): n is a, c, g, or t
  misc_feature (46)..(104): n is a, c, g, or t
  misc_feature (125)..(144): n is a, c, g, or t
  misc_feature (146)..(196): n is a, c, g, or t
  misc_feature (198)..(227): n is a, c, g, or t
  misc_feature (231)..(260): n is a, c, g, or t
ccctaaagggaagggaannnnnnnnnnnnnnnnnncagtatttccnnnnnnnnnnnnnnnnnnnnnnnnnnnnnnnnnnnnnnnnnnnnnnnnnnnnnnnnnnngcctatagaggtttataatcnnnnnnnnnnnnnnnnnnnncnnnnnnnnnnnnnnnnnnnnnnnnnnnnnnnnnnnnnnnnnnnnnnnnnnncnnnnnnnnnnnnnnnnnnnnnnnnnnnnnntacnnnnnnnnnnnnnnnnnnnnnnnnnnnnnncaataaattacgcaacggataacagggcaattttattggtgagtctcacatcgatgataaagattgcgaccacgatgttggattaaaaattataaatggtgtaataggtataatcattaattccgctctacttttgaaaatatacatgatctaaggttaaaccggtgtgacccaggcggg

SEQ ID NO: 7426 - DNA, 909 bp, Diabrotica virgifera
  misc_feature (58)..(81): n is a, c, g, or t
  misc_feature (94)..(111): n is a, c, g, or t
  misc_feature (145)..(167): n is a, c, g, or t
  misc_feature (393)..(413): n is a, c, g, or t
  misc_feature (492)..(511): n is a, c, g, or t
  misc_feature (576)..(624): n is a, c, g, or t
  misc_feature (764)..(784): n is a, c, g, or t
  misc_feature (808)..(808): n is a, c, g, or t
  misc_feature (904)..(904): n is a, c, g, or t
atcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaanaagattaagacctttaagaataacttctttcattgaatgactacaatttaaccctccagctgaacacagatattctgaattgccaatattatcatncaatt

SEQ ID NO: 7427 - DNA, 59 bp, Diabrotica virgifera
  misc_feature (18)..(37): n is a, c, g, or t
gctacaacaaaaatcccnnnnnnnnnnnnnnnnnnnnttgaaaaataatgtgggtgccc

SEQ ID NO: 7428 - DNA, 397 bp, Diabrotica virgifera
cgcccggcaaattactagacgacattcgacatgtggggaggatcaaattgaccgtaatagctcgcaggaaggagaagcggtagtgctctaaggtcaccttaatctggagtagacggcccatcgttttagaatttcatgactggaaggaccacccacgagatcaagatctaatggctggtatagagatcccggcaagagctaagagcggtgagaaagagtaggcagggatcagatcttcctcgaccccaaacatccgccaagagaacggacgagggagaacatccggtaacaagaaatacatatgcgtctagtcggtcgacaccgacactacagggggccgctgatagacagagccgtagtcgcagaatcaatttcttttcttccccaccgtccacac

SEQ ID NO: 7429 - DNA, 853 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(833): n is a, c, g, or t
  misc_feature (842)..(842): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnntattttaangctcatcccta

SEQ ID NO: 7430 - DNA, 909 bp, Diabrotica virgifera
attagatataatcaaagtcgctttatattaatttcttcacaaatgtgatataaaatacctatcatgtaaagtccctaaattttgttgttggttttttgtatttgagcataactttataagcaaaattgataattaacgacgttgtataactgtaaaatatacaccatattcttggccaaatagtacaggatgtgccagtttttattctttatgaatattgcagagtctgtgttaaaaattgtgtttagtattgcttataaaaaagatttatttactacctgttcttcttgtctccatcctcatcattgtccattgttttggtccctccactaattattattcttggactggagctttacgtccattctgtaggcgacattccactaaccttgtaagtcggaaattctttgtagattcgtagagttttgctgcagccgttgatggttaactgtgtcataggcgacagttaggtctactaacgttacacctgttattttttccgttaaaaaccaaaatcaatatgttggatgagattaagggtttaatgatttattcattcttgcttgttctggaataattttagtctccatagattcggcggtcaagttcagtgtcacactttgaaaaggtcacacagaagagagacaggtctaaaactctttgtatctgccggacacttccctggttttaatagtgctaccactttagctttcctccaggttttggagatatgtaatgtacggatacagcaattcatcatttttaggagccacttaacggtttcggtcccaagttctttatttgttctattcgtatatcatcccagcaagccgttttattatcttttagttggtgaatcacgcctctactctcctcccagacaagagagtacctagaacatctctttct

SEQ ID NO: 7431 - DNA, 415 bp, Diabrotica virgifera
tggagaagtatcgtgctgtggcgtcttcctcgcggatgtggaggtggatactatcagaaggtccgctacacttgagagagcactagaccctcatacatgtgggtacatgcctacttcatctgacgctatctccggcaatcaacgacgtaatcatgagcgaggttgggcacaggaatgatagaggagagagttagggatactgtagattgactatctacagggactgtatagtgatggtaaatggacatgctgatgaataggatagtctccactccgagacgttttagttaaagcagtgcgaggatagcgctacatatcaagtttggtgatacttgcacctatccagtcgaagaagtcagtctagaaagatgatcccgcaaaaataggggtgtagaaaggaagatatcgggataat

SEQ ID NO: 7432 - DNA, 575 bp, Diabrotica virgifera
  misc_feature (19)..(34): n is a, c, g, or t
  misc_feature (360)..(380): n is a, c, g, or t
cgcgcccccgcgcccgcgnnnnnnnnnnnnnnnnagacattctgcattaaaaatatgagagatattaataaaagatagaaagtcaaaatgataagagaatatcatataataataagctgaccagctcattttgtatgcgatgtaattgatggcaaataacttaagcctcgtctataaattatcgacatcacgtagaagagctagggaaatataattattcctgtaagaaaatgatttcgcacaataattctacgatgcaatgttggtcactttaacacatgtctaaatttttgagggatatcagtctggtgatttattccaccacgtatctgtaattggagattttccaggtatgtactnnnnnnnnnnnnnnnnnnnnncctaagacataaaatggtattagaatctgcccttaaaataataatgaagattgaagatgtgcatattctacaatgaggaggcacttacggttatctgatattcttcttaccgagtataagtagaagatcagaatataatattatggatgctgtacatttactggtgctgccaatgtttctgttaatgaattgcat

SEQ ID NO: 7433 - DNA, 791 bp, Diabrotica virgifera
ggaagtgcttctctgttcttgatgtgcactctgcgccgctcgatcaattctccttggtagaagcacaccagtcacataagatggagctggatctctcgtcaactctagatgatactgactcggattcctctcgagggataccaatcctacataccttaaggtacgctctcagagaaccgaacactcgaaccctgatgtgccatggtgaggatccgctgtcatatgttctaagctagccatcgacgaaccctcgcatgaagtctctgtttacgatgactacaactcctctgatattcttactgatatttttcaacatgactgaaagaacgcttgacgatttcaactactatagcctgcttgacgcgattcagatggtactcgcctttgaagcctccggccaaaccatcgacaatgtgattaaatccggggatggtgaataccgcatggtacgaatcaatgacattgatcgctcttcctcgagcactcatcctcctgcactatgctggacaagaatggaatgatatgcttcttggacttttgactgaatatggatactctataacctgcgctcttgaccgaggattggtgagagataattctccactcatatgttatgtaactcttctcttacaaatccaaatgcaaccatctgtctcaactacgttcattgagacacagacatatttgcccgacgatatctatctgcacattcccttcttgagaatcagatgaacactaactatctcttgagcctcctccacggacatcgactcggatgatctccatggaac

SEQ ID NO: 7434 - DNA, 664 bp, Diabrotica virgifera
  misc_feature (18)..(58): n is a, c, g, or t
  misc_feature (73)..(149): n is a, c, g, or t
  misc_feature (159)..(185): n is a, c, g, or t
  misc_feature (195)..(263): n is a, c, g, or t
  misc_feature (266)..(288): n is a, c, g, or t
  misc_feature (312)..(363): n is a, c, g, or t
  misc_feature (365)..(511): n is a, c, g, or t
  misc_feature (528)..(587): n is a, c, g, or t
  misc_feature (591)..(624): n is a, c, g, or t
  misc_feature (630)..(653): n is a, c, g, or t
ccccccccccgcgggccnnnnnnnnnnnnnnnnnnnnnnnnnnnnnnnnnnnnnnnnncgccccaccacccgnnnnnnnnnnnnnnnnnnnnnnnnnnnnnnnnnnnnnnnnnnnnnnnnnnnnnnnnnnnnnnnnnnnnnnnnnnnnncacaataatnnnnnnnnnnnnnnnnnnnnnnnnnnntattgggggnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnngtgccccccccctttgttgggcgnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcctccccccgnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnncaaccnnnnnnnnnnnnnnnnnnnnnnnngtgggggggag

SEQ ID NO: 7435 - DNA, 896 bp, Diabrotica virgifera
ggactattatttacagtaagccacattttaaaggttccgatttttatcaacatctgggttgggtacttttttcttttaggtcatttttaggttatacattttaaattacttgtttgttgtatttcaccaatttcactcacttttacttcatttgaaaagtgtgtatcttgctatggcaaaaaatattgatttcactaaacttaacaagattatagtcaatactggaaatttattatccattaatgatattataaaaaaacctaatcagaatacttcagaagagctggtggaagccataaactttactttgaaggaatttggtaataatggtagcttacagttacaacctgatcaacaagttgttataagcagaccacaggacaaccttaaaataagtgagcatgaactgtctgatttaaaaattggtttcaaggttttcttgaatactgatgatcaagtattacttactgaagctattgaaaaagctctatcattgttgaaagttaaggcgattaacgacgttatcgtaacttttaaacaaaaaccatccgaagataaaaaagatgatttaaatacaattcagagtgcttggaaagtgttggaagacttaatagaaacacagcaaattaaacaaataggaattgccgacgtggaagaaaatactttcaaatcgttataccagtgggctaaagtcaaacccagtattatccaaatcaacttagcaacttgttgtgttgtaccgccgtcattgcagacgttttgcaaagaacatgatatcaaactgttaacacacagtgatgcagttgatattctacctgcacagtctatccaaaatatatttgacaaacccattgctgcttcaatgggccttaaggtttttaatacatgtgaaatgc

SEQ ID NO: 7436 - DNA, 230 bp, Diabrotica virgifera
  misc_feature (2)..(156): n is a, c, g, or t
  misc_feature (170)..(201): n is a, c, g, or t
  misc_feature (206)..(223): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggtgattaccnnnnnnnnnnnnnnnnnnnnnnnnnnnnnnnncaccnnnnnnnnnnnnnnnnnncattttt

SEQ ID NO: 7437 - DNA, 934 bp, Diabrotica virgifera
  misc_feature (568)..(585): n is a, c, g, or t
  misc_feature (849)..(849): n is a, c, g, or t
  misc_feature (855)..(855): n is a, c, g, or t
agagcagtcccctgttgaatctacccaacccaatcaattaactcctcaagaattagagaaacaagaggaggcaaaacttaaagccaaattcaacattccttcaggtggaggaccaggtttaaaagcaagtggacactcagccttcttacaaaagcgtctgtcaaagggacagaaattttttgattctggagattatcaaatggcaaaacaaaagtttggcaatatttctaacaaagcaggacttcagttgcccggccctatatcgtttgtaggcacaggtgatgccatcccgactcctgaaacagttcctataagaaaaacttccatagttcaaccttcaaaatttactaatattagttagaatagactgatgctgtatatctgtagcctttaaagttggttatgtattataagaataattttgttgccccaatgaacagtcattttatacaataattaaactaaaacgtgctgctttatttgtaataatgaaatatttgttaacattcaaattttagataatagctagaactaatttgttttgttatattcatggaatatattacgnnnnnnnnnnnnnnnnnncttgtgactaattttacaaatcgtgatgaccatttcagtagtaatgtgttagaaaagatatacctaataaaaaataactgtattatatcaatagtcttttatatttaacagattaactatgtcttatattatgtttattcagaaaaatgtatttgttatattttggtggttcatcaaaatataataatttaagagatagcttggttttagctgttatttaaaatctggattctacactagttaatcaagaaagcaatttgaaangtaaanatacaatgtatgttttattaataaataatctcttaatcttaaaaagaaacattaatagttaatatacgtaagatgctga

SEQ ID NO: 7438 - DNA, 759 bp, Diabrotica virgifera
  misc_feature (364)..(488): n is a, c, g, or t
  misc_feature (649)..(668): n is a, c, g, or t
gacaaatcaatccaacttacaaaaatgttcaaattcttcgttttcttgttcgtcatcttggctgtagctttcgctgcaccaaaggctcaaccagtaccacaagtgttggctgcttacagcgcaccagcagtggttagcagttactcatacccatacgctgctgccagttatgctgcaccagttgcttactctggatatggatctttggcttattctgcaccattggcttactattaattgaattgaggattttgccctggatttacaatattgttttttaagaccatttactacaaagcatcttttaatttttgtgtagttgtataacgttataatattatagtttgacaaataaattcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagaaccaaattttacaaccggggggtggaaacccaaaacttttttaaaagggcccccaaaataaatttccgggcccgctttttaaaaacgcgggaaggggaaaaccccggggttccccaatttaatcccctttgaacacctccccctttcccccatnnnnnnnnnnnnnnnnnnnnccccccccaacccccttccccaaaatttgccccccttaatgggaaaagggaaccccccttgaaccggccattaaacccggggggggggggg

SEQ ID NO: 7439 - DNA, 233 bp, Diabrotica virgifera
  misc_feature (7)..(44): n is a, c, g, or t
  misc_feature (64)..(77): n is a, c, g, or t
  misc_feature (80)..(95): n is a, c, g, or t
  misc_feature (111)..(133): n is a, c, g, or t
  misc_feature (181)..(181): n is a, c, g, or t
  misc_feature (197)..(197): n is a, c, g, or t
  misc_feature (221)..(221): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnattaagtctgttcgannnnnnnnnnnnnnnnnnnnnnnagtttaaaccggtgtgagaccaggttggtttctatctttaatttattnaatatatttagtacgnaaggaccaatatataaaataattnttatatttagat

SEQ ID NO: 7440 - DNA, 840 bp, Diabrotica virgifera
  misc_feature (13)..(27): n is a, c, g, or t
  misc_feature (31)..(66): n is a, c, g, or t
  misc_feature (101)..(133): n is a, c, g, or t
  misc_feature (136)..(166): n is a, c, g, or t
  misc_feature (169)..(181): n is a, c, g, or t
  misc_feature (189)..(236): n is a, c, g, or t
  misc_feature (246)..(295): n is a, c, g, or t
  misc_feature (315)..(378): n is a, c, g, or t
  misc_feature (408)..(437): n is a, c, g, or t
  misc_feature (441)..(472): n is a, c, g, or t
  misc_feature (509)..(586): n is a, c, g, or t
  misc_feature (603)..(640): n is a, c, g, or t
  misc_feature (667)..(797): n is a, c, g, or t
ggggggggggggnnnnnnnnnnnnnnnttannnnnnnnnnnnnnnnnnnnnnnnnnnnnnnnnnnnaaaaaccccccttctataaaaaaaaaacatgtgtnnnnnnnnnnnnnnnnnnnnnnnnnnnnnnnnnacnnnnnnnnnnnnnnnnnnnnnnnnnnnnnnntgnnnnnnnnnnnnncccctccnnnnnnnnnnnnnnnnnnnnnnnnnnnnnnnnnnnnnnnnnnnnnnnngtttgaaaannnnnnnnnnnnnnnnnnnnnnnnnnnnnnnnnnnnnnnnnnnnnnnnnnaccccccccttttcttttcnnnnnnnnnnnnnnnnnnnnnnnnnnnnnnnnnnnnnnnnnnnnnnnnnnnnnnnnnnnnnnnncggtttttttaaaaaagaagtttgttcccnnnnnnnnnnnnnnnnnnnnnnnnnnnnnnggannnnnnnnnnnnnnnnnnnnnnnnnnnnnnnntctttttttccacacaaaaaaaaccgcgggggggtgnnnnnnnnnnnnnnnnnnnnnnnnnnnnnnnnnnnnnnnnnnnnnnnnnnnnnnnnnnnnnnnnnnnnnnnnnnnnnnagaaccacaacctctcnnnnnnnnnnnnnnnnnnnnnnnnnnnnnnnnnnnnnncaaacccactgcggcggggtgttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagaatggggggggtgtttcttctcccccccccacaccccc

SEQ ID NO: 7441 - DNA, 920 bp, Diabrotica virgifera
  misc_feature (787)..(787): n is a, c, g, or t
  misc_feature (822)..(822): n is a, c, g, or t
  misc_feature (861)..(862): n is a, c, g, or t
  misc_feature (885)..(885): n is a, c, g, or t
aagtaaccaagtacaaatttagatggaatatctgtagaggtttgcaataatttaaataatacagtaaatatagttcgggtagcattaaaactgatcattttcttttgcttttgtgtccgtcataatatggtggcttaaaagaaacattaatattcgtcttcataccttatcattctctttgctttatccctatgcggggtcggcttccctaattgcatttctccacacaattctatcttgggtcatatcaatgttaatcccctttaccaacatgtcctgccttatcgtctcctcccaggtcttctctggtcttcctctcctactccttccaggaatctgcacttcagctatttttcgtattgggtgattaacgactcgacgttgaacatgaccaaaccatcttaacctatgctctctcattttggcatcaattggtgccacacctagacttcccctaatatactcatttctaattttatccttctttgtgactcaatttatccatgtaagcattcttatttccgccacatgcattcgttgttcctctttctttttcactgcccaacattcagttccgtgcatcacagccggtcttatggctgttttatagaattatcccttcagcttcattggaatttttctgtcacacaacacaccactcgcttctttccacttcatccatccagccctaattctactgcatgcatctccatctatttctccattactctgtaatactgatcctaggtacttaaaactattacttttcacaatcatttcaccatcncaagataccattttatttgtagtaactccatcttntaatgaacattccaaatactctgtttttgtcctactaanngtttaacccttttcctccagagnctgtctccactgttccagtttttggtctaagtctc

SEQ ID NO: 7442 - DNA, 68 bp, Diabrotica virgifera
gccggttgacagacgtctgggtggtgcgattttatatccagaaaatatcaaatagctgctcttcaaag

SEQ ID NO: 7443 - DNA, 457 bp, Diabrotica virgifera
agaagatgaaggtacaatacttgtaattcattagttttgctctatatttgatctaccaagactaccttgctaaaaacgaaagaatcagacagaatggaacggaatctctctcctactaaatatgaaacaatctctataacaacaggatcgttgtcgaatccagaatgggaaaaattgatatcaaaggggcaaaagggacaatccaaatgtgctctactaccgaaccacttacatttggatgaccaaactaccgttcaaccttcggtgaggtatacgtccacttaaaatgcctcgaggatgataatcttatggtgatatgcttatgatatgaatgaatgctagaaaagaccaaagactcacacactatcattcagaatgaaacagccaattatatctcgcattattgactatgccgtatattatgttataccatatatgcgatcgatcactatatgga

SEQ ID NO: 7444 - DNA, 938 bp, Diabrotica virgifera
  misc_feature (878)..(878): n is a, c, g, or t
  misc_feature (898)..(898): n is a, c, g, or t
  misc_feature (911)..(912): n is a, c, g, or t
caagtgagtaattaagactgaatagtgcagtgaacaccggcaacatgccgtcaatacataagaagaaagcttttgatattaatgatctagaatcagtagcacgaatctctcatataccaattgtagaatcaggatggagttatgccgaaggagtctatatgaaaattaagagatcaaattcgttgatacactggactttggacactgccgagcaatcggctcagtcagtgtacgaagctgcttcaccggcaatgattctactaaaaggacctttgtcgtctctagatcaaattgtttgcaaaagtctagatattgttgaacaaactgtaccttctatcaatttaccgccagaaatgatttactggaacacgaaacagtacgttcaagaagtcggaacgaagatagctcagcctgttttaaagagagccgattcagtgaagcagattggaaacagtgtattatccagcaaatacactgccatagctgctgatactttggacggcgctttagttgtagctgagaagtacgtcgataaatatttgccggctcaggatgatcaagcttcagaagaagtttctgttcctgttactgaggatggtcctaaaggaaaagcgattagcacaattcatcacgctgacaggttttcaagaaagcttagaagacgcttgactcaaagaacaatcgccgaagtcaaagccctaaaacaccaaagtgccgaagcagtacacgtacttacatatgttctagaactgattgctactgatcctgtcctggcttaccaaaaaggaaaagagttgtgggctagtttgagccaagacgaaccggagaaccaggcaaggccagaaaatctcgagcagttgattgtactcttgaccagngaatctgccagaaagagtgntcatctaattaannttctcagcaccttgcttagcacactt

SEQ ID NO: 7445 - DNA, 717 bp, Diabrotica virgifera
  misc_feature (2)..(28): n is a, c, g, or t
  misc_feature (230)..(281): n is a, c, g, or t
  misc_feature (344)..(393): n is a, c, g, or t
  misc_feature (659)..(659): n is a, c, g, or t
  misc_feature (671)..(688): n is a, c, g, or t
annnnnnnnnnnnnnnnnnnnnnnnnnncaataacatattgtataaagactaaaagacgaataatttgaaaatccaaataatcaataaattgaaataatatccaacaaatacgctaatgtcactgtcacaataagatatcaactacatgccatattggtgattcgtgaataattccatgcgtgttgaaaagttaagagtggaaggattatatatatatatgtgtatgtannnnnnnnnnnnnnnnnnnnnnnnnnnnnnnnnnnnnnnnnnnnnnnnnnnnacaaggagaggttaacgcgagttaatagatatcggcatggcttccatcttatgcatattttgnnnnnnnnnnnnnnnnnnnnnnnnnnnnnnnnnnnnnnnnnnnnnnnnnnaccagttaaatgtaaaatgtatataattttggccataaaggaataaaagagactatcttttaaagcaaaaatgcaagcaaccgtatagctaatagaataagataggtttgcaggcatacttatcaggttgttcactattagctttttataaaatctatattctctttcattcctttatatttaacttgtctttaaagtaaataatcttttacttcattttacctaaaataaatctgtattatcaattaaagtaatctgcaacatcngcggaaatatcnnnnnnnnnnnnnnnnnngaacactaaaactataaataatataaccc

SEQ ID NO: 7446 - DNA, 911 bp, Diabrotica virgifera
  misc_feature (532)..(552): n is a, c, g, or t
  misc_feature (831)..(855): n is a, c, g, or t
cctgggccgacttatccttggtccatacagtatagcagtcactacgaagcaagtgtgattcgcgcggccctgtaagtaaaataagcgtgaatcgtatatgattcgcgcggcattcaacgtgttaatataagtatagtgttctgttgtgcaaccataatactaaatttaaacatgccacaagaaaacagttctaaaaccttgctaatttgtagtacttttttatggcttttctaatttttagttatctgaatcacttcctcagtgttgcttcttgctactattgctatatgatcagcgaacaacagacattgttgctttttatgatatataattcctttcctatctatattggcctcctgcagcatgttttccaggaaaagagatataaccgttaaatgctttaatggctataaataatatcttgaacagtttctaatattaatagctttcgtctagttcagcaagaaaatctgttctcttgtgctttttccttgtctaaaacccgcttgatattgaccaattatatcttacnnnnnnnnnnnnnnnnnnnnngcatttccaatattttgtattcgacaattagcaatgttatgcctctctaatttttgcattcgctcatctccttttttgtaaatgggatatattcttgcttttagcgattcttttggtaattatgctttattccatactttttcttacatgatcatgtaatgttaatctacagcaccttcgccaaaaaatgttctctactgcatttattcgattctgcattttcttacttatcgtccaggcttctgagccgtgtgtaactgtactttcaatcagtgttgnnnnnnnnnnnnnnnnnnnnnnnnnctactcatagtaatgagtttatctgactgtgatggctcttcctctacctaattttt

SEQ ID NO: 7447 - DNA, 930 bp, Diabrotica virgifera
  misc_feature (894)..(894): n is a, c, g, or t
gtagctcataccactgttccaggagatgtagaggtttgtgttaccgctccaacagtagtgcaaacacaagtcagtagaacagttgatttgtcttctccaacaatagaaaatactgataaacaaatcagtcaactttgtacaaatatacacgatgctttgcaggcagctactaatatagatcgaacaatagaacaaactaacagaatgtttgtaactagtttgaccgaaacagatcggattatttcttctaaaaaacatgtatcatatctaactgatgactcagacaacatcgaagtatctatcatcccttcagaccaaggaatgttaaggaaaccaaaagatgatcaattaaaaccaaacaacgaatcagaatcgatcaataggaaatttgtaagaagttgggtagaaacggaagaaaggacgtcttcacttccagcaagaaaacttgtcactagcttgataatcgatacaccctcaaacgaaaagcaacaagtgcaatattcccaaatcatagcacctacaccattcaaaataacaaaacaaatttcccaaacatctgaacctcgttcacctaccactccaaccagacgaattgctcgacctcaagtccctcccccaccagtacccatcgctaaactagcttcacctccccaaattcaagccaagaaaattccacccccagtacctgccaagatttctaaattgaaccctgctcgcagtgaaaatgatttattagaccctgttggttctgtcaaaaaaagcaaccagtccgctagacctgtttcttttgtattttctgataaaaaggatttgggattcgttagcggaatttagggaagtatggtactgtggcaaagcctccacaatctccccaacacatgctccccagcagtncgtgagcgatagaaagaaatttttcgaaatcgcgat

SEQ ID NO: 7448 - DNA, 1023 bp, Diabrotica virgifera
  misc_feature (220)..(239): n is a, c, g, or t
  misc_feature (997)..(997): n is a, c, g, or t
aactaacaaaatttgtctcgtctcgaacatcgttcgaccgcggcagtgttcgatataccgtgcgtaaagacaggtttgttttctagagtaacactttcgagtgtagttgagtgtacactacactggttagtggcaaacgaaaattacaggtgtaccactaaacaaagaaacgttatagtgtaaatagttaatcgttgagttacttggttaggttagaaannnnnnnnnnnnnnnnnnnncaaattaaaatttgtaggtaatatacttcttaaaattactaaatgctttttgaagatattagatttaaattaaactaaaaagaaaaagatagtctgttgtaaacaaacgcatctgacagctaaaaattgtcaaactagtttggatgttactgcgcaatacgagtgtagcgagtgtaaggaacatacctagcgttttatcaaataccatagactatatatatatgtgtatatatgtgtatatatgtgtatatatgtatatatgtgtatatatgtatatatacaactattgatatttatacattcttcgtgaggcaattcccgattaaaacctaatatagagagcaggtcgaatgcagtaaaatctccgaaataaatggtataaacaaacattcaattgaggaacggaacaataccgatttgatttaaaatattttaatgtacttatgctgaaatttactaaaaaatttttaatagtgaccaaattccactcaaatcaacagctttctggtttgtttataccacttctagtagtttaaatttattccacctaaggtcagatactttgtttttttatcgcaattgactgcagacccatcctaacacataagtctcagaatttttctcgatcatatcggaattgtcatcactttatgtattttttttagtactatgctcgataggatttatttttattttagcatactttaaaatgggtttttgagcatttggtcgacggatgtttacaataattgatttgncatgacagatcgcaagtacacctaaa

SEQ ID NO: 7449 - DNA, 268 bp, Diabrotica virgifera
gggctctccctggcaagcatcgaaaacccagaaggtgcggatgtgtgactattacgatgcaatatatcatactagtggccaagtgagaagacgggcatggtcaacattgacagcgcaagcacaagcggacacacggccctatcacgagatggtaaaatcatatgcataaacaacggaagagggagctaacgctctgcaggatccatctttaaccgccgatgcaggcatgatgttaactcccaaaataagacgcacaaattcagttgat

SEQ ID NO: 7450 - DNA, 484 bp, Diabrotica virgifera
cccttttccgcggccatccctagtaaccagtgaccggctgctgcacacttttcaagacactggtactggacgtgacagcatgagtagctggaaatgtgagactaatacgagctctcaaggtccccagattgccattcctagaatgcctgacaacccaaaaactgccgacgacaccctcagaaggacaaacgccccaaccacaactctgtgaaaagctgaagacaccacccgcaccgaacttgccttattccaacctccaaggtgtcaacgaccaaagggtccccgaagcggaggctcttgctgatcttgtccggcgttatgacgatatggtacatgaccagaccttctatagcaagctgaacacccttccacatttgctactagctgacctatcaacacactagccttggatgttgtaggaaagtgcgatcgccaccgcgcacgaggcgctagcgagattgtcgtctctggcgcacgactctcc

SEQ ID NO: 7451 - DNA, 847 bp, Diabrotica virgifera
  misc_feature (19)..(36): n is a, c, g, or t
  misc_feature (70)..(92): n is a, c, g, or t
  misc_feature (318)..(338): n is a, c, g, or t
  misc_feature (417)..(436): n is a, c, g, or t
  misc_feature (501)..(549): n is a, c, g, or t
  misc_feature (689)..(709): n is a, c, g, or t
  misc_feature (763)..(763): n is a, c, g, or t
cggacgcgtgggctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttncattgatgactacaatttaaccctccagctgaacacagatattctgaattgccaatattatcatccaatttaggtaaccatacg

SEQ ID NO: 7452 - DNA, 335 bp, Diabrotica virgifera
  misc_feature (15)..(36): n is a, c, g, or t
  misc_feature (41)..(136): n is a, c, g, or t
  misc_feature (143)..(180): n is a, c, g, or t
  misc_feature (200)..(213): n is a, c, g, or t
  misc_feature (216)..(238): n is a, c, g, or t
  misc_feature (246)..(268): n is a, c, g, or t
  misc_feature (298)..(329): n is a, c, g, or t
aatttaatcaccccnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7453 - DNA, 782 bp, Diabrotica virgifera
  misc_feature (155)..(176): n is a, c, g, or t
  misc_feature (193)..(212): n is a, c, g, or t
  misc_feature (218)..(252): n is a, c, g, or t
  misc_feature (259)..(289): n is a, c, g, or t
  misc_feature (313)..(328): n is a, c, g, or t
  misc_feature (330)..(342): n is a, c, g, or t
  misc_feature (370)..(412): n is a, c, g, or t
  misc_feature (414)..(429): n is a, c, g, or t
  misc_feature (484)..(504): n is a, c, g, or t
  misc_feature (506)..(520): n is a, c, g, or t
  misc_feature (529)..(547): n is a, c, g, or t
  misc_feature (553)..(577): n is a, c, g, or t
  misc_feature (584)..(606): n is a, c, g, or t
  misc_feature (624)..(645): n is a, c, g, or t
  misc_feature (647)..(659): n is a, c, g, or t
  misc_feature (661)..(689): n is a, c, g, or t
  misc_feature (692)..(711): n is a, c, g, or t
  misc_feature (718)..(742): n is a, c, g, or t
  misc_feature (755)..(779): n is a, c, g, or t
tatgaaggaaaaattttgcagcatgacataaggtctcaagacatttcatgcacgttacttaaaagtaccagcaaaaagaatttgctacagattgacgccgcatttatcaactagggggttctatagaaccttgagaattttgatttactaattgnnnnnnnnnnnnnnnnnnnnnncaaatgtagaaaagctnnnnnnnnnnnnnnnnnnnnggaagnnnnnnnnnnnnnnnnnnnnnnnnnnnnnnnnnnnatattgnnnnnnnnnnnnnnnnnnnnnnnnnnnnnnnaacttaaatttatttatacacagnnnnnnnnnnnnnnnngnnnnnnnnnnnnngaacatacaaaatttttaggcatgatgnnnnnnnnnnnnnnnnnnnnnnnnnnnnnnnnnnnnnnnnnnncnnnnnnnnnnnnnnnngtattgtaaactatgatattattgattttgatttattaacatattcatttttaannnnnnnnnnnnnnnnnnnnngnnnnnnnnnnnnnnnaatttagcnnnnnnnnnnnnnnnnnnncttacnnnnnnnnnnnnnnnnnnnnnnnnntaggcannnnnnnnnnnnnnnnnnnnnnnattttctcctgtttatgnnnnnnnnnnnnnnnnnnnnnncnnnnnnnnnnnnnannnnnnnnnnnnnnnnnnnnnnnnnnnnnaannnnnnnnnnnnnnnnnnnnacataannnnnnnnnnnnnnnnnnnnnnnnncaatgtagggtannnnnnnnnnnnnnnnnnnnnnnnnatg

SEQ ID NO: 7454 - DNA, 871 bp, Diabrotica virgifera
  misc_feature (648)..(680): n is a, c, g, or t
  misc_feature (840)..(840): n is a, c, g, or t
ttaaatcatcaactgaacatactgaacgtaccccgtatatccttactctctaaatatctgtctttcattacagaacatgcttacccatctttctgtacttggtcgtcatttcaaaggtcgttttcaatgacagtgacacttcgcctctcaaaggatttagagtggtggaaaattaatttcgctataaaaggcaattacagggctgataatagctatctatttccagactttaatattctcttggggtgagtagtttgtgacatactgtaccattcataaccttttatttttcgtttctatacctaatctcgactctccacgtgtattaatatcttaattttaaatatttcatttcatctattgatatgcttttagtaatcagatagtttaactattagtaattaattccatttaatttaatcttgtcatctgctactctttttgattatttcttaaaagaatggcagactcggcacattttggtttttaacttcttgattgccacttatacgcattactcttctagtttttgggaataaaaccacttttctccctccgggagcttcaagaatcctcaaatcgccggcgatacaagaacgaggaacataacatctagactgcaaccaaatcatctagactgcaacgacnnnnnnnnnnnnnnnnnnnnnnnnnnnnnnnnnacaacaccagagccagttgcagaacctacagcagtaccattcgacatcaagaagttaccatcgaaccaaacaccaaaagccatgcataagtataatccagaattgtttttggcataatttgaatattttgttaatgcatttaataagtcaagattaggancagacgaacacacaccttgagagactgagct

SEQ ID NO: 7455 - DNA, 909 bp, Diabrotica virgifera
  misc_feature (346)..(371): n is a, c, g, or t
  misc_feature (380)..(419): n is a, c, g, or t
  misc_feature (558)..(579): n is a, c, g, or t
  misc_feature (799)..(799): n is a, c, g, or t
  misc_feature (840)..(862): n is a, c, g, or t
  misc_feature (865)..(877): n is a, c, g, or t
  misc_feature (892)..(893): n is a, c, g, or t
atcggttcgacttttgtacaggaatatagaggtatttgagaccggtcaatcagaacgaggtgcaaaggagatagcatgtagttttacttgccctctctcttgcgatactcatcacgcgctcagatcatgaaggctgcctctagttagtatctgctggaagaaacttactaattgagtttactgaaaatattcttaatgactttctagtaatttgctgtgaaggaatcgagtaaaattgaccaatttcaaatatcttaataaaatatggaagtgacttcttcccagtgtgggtaatttttggatggcattaagcagtaaaaagtagatatagaaattaatcatttgnnnnnnnnnnnnnnnnnnnnnnnnnncaacattannnnnnnnnnnnnnnnnnnnnnnnnnnnnnnnnnnnnnnnagtgtatactttacatatatgcatatgattgtggtttattgagtagtcgatatcacgttttagtacataatttggttaaaaaaaataggataaatgataattttaatggtaatgttataaataataccatgaccatgannnnnnnnnnnnnnnnnnnnnnaactgttccctcgaaatttaattcagaaagcatggtagctgaagttggatagagctaaggtttttaaaagtatgtaacagaaaaggcgtgggctgatttaataaagagatacttggctttttgtttcgatcgatctcttattttttgttacttttatatatacttttggatataatgtcaggtaattagaagcaataaaaaatatcagattttagataanatggcggacagattttaagatacttaaataaaaaaacaatnnnnnnnnnnnnnnnnnnnnnnncgnnnnnnnnnnnnntctaatacatactannatacttaatatgagta

SEQ ID NO: 7456 - DNA, 827 bp, Diabrotica virgifera
  misc_feature (746)..(746): n is a, c, g, or t
  misc_feature (787)..(787): n is a, c, g, or t
  misc_feature (808)..(808): n is a, c, g, or t
cgaaaaacaacagtcacaagattatgacgtagtttctggtactcgctacataggagatggaggagtatccggatgggattttaaaagaaaactagtgtctcgtggagcaaacttcctaactcagcttttattaagacccggtgcgtctgatctaacaggatcattccgtctctacaaaaaagatgttcttgaaaaacttatcaacagttgtgtgtctaaaggttatgtctttcagatggaaatgatagttagagccagggagttaaactactcagtgggtgaagtgccaattactttcgtagatagagtctatggggaatcgaagttaggagggtcagaaattgttcagtttgttagagcattgttgtatctttttgctactacatagaaattattattagtgcaattcacaaaccatacatactctagacgttccacgaccatgttaatctttcggatcgaattaacgccatctgttgattgggaagacaactaaattgacaaattatagttttacctgggaatttcaaactataaatttttgcgggatttttgatgatatttcgcaggaaattaaaacaacagaaagacaattcaatgttttacaaaatcttaaattctctctaaagttatgctagtaggtagtgttgtaatcgtggctaaaataccaatataaacaaaaatcatagttttactgaaaacttcaaatattccaatttgtttccaaaatgctaaacactactgcncagtgtcatgtgaaaacactgttttttaggaagcacagggncaaatcgaaagaaaacgctgngttggaataaacaattgtc

SEQ ID NO: 7457 - DNA, 946 bp, Diabrotica virgifera
  misc_feature (27)..(51): n is a, c, g, or t
  misc_feature (885)..(885): n is a, c, g, or t
  misc_feature (912)..(912): n is a, c, g, or t
gtggttgaataaaacttttgtttgtgnnnnnnnnnnnnnnnnnnnnnnnnntcttagcgaaaatgtctgataggcctgaagaatcaccaatgccgacacctcgttcaaatgtgtcatctcctggtccagatctggccccatttgaagatgaaggtgctttacttggagatattaattctgatattgaagaggaagatggagaagaattgtttggcgataatatggaaaacgattatcgtgctatgccacatctagatcgttatgatgaccgtgtattagacgaggatgattatgaccaaatgtcagttggggaacgacttgctgctgaagaagaactgcgaagaagagatagggagctgggtataattcgaagagatgatcgagaacttttttatgatcaagatgatgatgaagaggatcccaggcaaagaagacgtaaagaagcagaaaaagccgctgctggggaagaggctgatgctgaaatgattgaatcaattgaaaatttagaagataccaaaggttatacaattaaagaatgggttgttatgattggtccaagaactgaaattgcaaatagatttaaaaacttcttgagaacatgtactaacagtaaaggtcaatatgtctacaaggataaaattagaagaatgtgtgagaataatcagtctagttttaatgttgagtttcccagtttggctcacaaggaacatgtattggcttattttttgcctgaagcaccatttcagatgatagaagtttttgatgaagtcgctaaggatatagttctttcaatgtatccaagttatgacagagtaactaacgaaattcatgttagaatttctgatttaccactgatttgagaactccgtacttttaggaaacttncatgtaatcaacttgtaagaactttangtgtagtactgcaactacaggtgtctaccccact

SEQ ID NO: 7458 - DNA, 971 bp, Diabrotica virgifera
  misc_feature (563)..(577): n is a, c, g, or t
  misc_feature (619)..(642): n is a, c, g, or t
  misc_feature (717)..(734): n is a, c, g, or t
  misc_feature (766)..(784): n is a, c, g, or t
  misc_feature (862)..(862): n is a, c, g, or t
  misc_feature (929)..(929): n is a, c, g, or t
  misc_feature (950)..(951): n is a, c, g, or t
aaacaagacttacaagagttaactggatctgataagggaagcattcatattaaaaaggcgtctgctaaatggttgaagtcacaatacgagaacaatttagagaacattgacatggatgtggcagctggtagtgtagctgctgttgttggatccgtaggaagcggaaagacaactttgttgcacataattatgaaagagctcgaattagaaagtggatatgttaatgtcactggaaaaatttcgtatgcttctcaagagccttggttatttggaggtagtattaggcaaaatatcctatttggagaaacatatgaccaactcaaatacaacgaagtagttcgtgtatgtgcactagaaagggactttactctattcccttatggtgatcgaaccttagcgggtgaacgaggtgttaccttaagtggaggacaaagagctagaataaacttagctagggcagtttacaaagacgctgatatctacttactagatgatcctttatccgctgtggatacacacgttggtaaacatatatttgaagaatgtatttgtgaataccttgnnnnnnnnnnnnnnntactggtcactcatcaactacagtatttaaaaagtattcagnnnnnnnnnnnnnnnnnnnnnnnncaaatagctgtctccgggtcctataataatataaaagattctaatacacattatagtgaactgttgcatgatatnnnnnnnnnnnnnnnnnngataagaaggaagtctaaggttgttcaaacannnnnnnnnnnnnnnnnnngagaagcaggtcctgtattacaaagagaaggtaaaagtacaggaattatttctggacgtgtttatcgacagtatgctncagctggtggacatatctttaaggctttttctatattattcctccttatacttagccaagcttttgntaagcgtatgtcaatactttnngtactttctgggtcatattc

SEQ ID NO: 7459 - DNA, 73 bp, Diabrotica virgifera
  misc_feature (8)..(66): n is a, c, g, or t
gtttatannnnnnnnnnnnnnnnnnnnnnnnnnnnnnnnnnnnnnnnnnnnnnnnnnnnnnnnnnngggtgat

SEQ ID NO: 7460 - DNA, 921 bp, Diabrotica virgifera
  misc_feature (526)..(544): n is a, c, g, or t
  misc_feature (584)..(601): n is a, c, g, or t
taaccaccttcgatgtaaaaaagagcatctacgacctagcctgtgataatttcgacacacaaatagcagttgtggagaaccaaggattatacaactcagtgcaagagtccgccgtcagagtctacgacgtaggccgaagaagagacgacgaagatgagcaggaagaagacgaagaggacagtatggaagggagcgacgattcagaaaatgacgatggagatggcgacaacaacgataacgacgataacaatgatgatgatgacggcgacgataacgataacgacagcgacgcagagagttggacgagtctgtcaagcggtgggtcaggagacaatttagattttggcgccttactcgcgtcactgtgagccctatagaagttctggaaatgtttctatttttcctcgttatatctgtatgagggaggtgattttttgataaacgtaaaatgagtgattttgtattgtatatatgatgtaatcattgagacctaaaagttttgagcgttttgcaaattccgtacagnnnnnnnnnnnnnnnnnnngatttaaacttattttttgtatttataaaaacaattttgnnnnnnnnnnnnnnnnnnattttcaatctggttataaaacagagcataggtaatcaatattattgttatattgcttcatcttatgcaatattatcaatatgttgcatgatattttatattttgtaatattttcataaatatttgcacaataattgaaattgtgtaatactattgtgcatttattgcacaatgatgtatatgagagctgtattctaaccagctcttacgacagtagttcttatatagttattgtgtcacttatcatgcatagtgagagtattttgttgcacattaatggatcgtgtgcaataatgattcatatgttctacaataatcga

SEQ ID NO: 7461 - DNA, 85 bp, Diabrotica virgifera
  misc_feature (2)..(2): n is a, c, g, or t
gntcttctttctttagtcgcattcagcgctgctctacaacacttcttggtagaacgctctggtcaaagagatggactggtactct

SEQ ID NO: 7462 - DNA, 822 bp, Diabrotica virgifera
gggcatgacgctaccatcgtggggggatcgattatccgtcggaggcttcgaccgacagatggacattgtgatagaagacgaccatgtcagagaaaggaatcaacttcttacccagagccggccccactaatgaaaacaaaaaaggtacccctcccccctgacttgtcaattgcaggctatccccagggtctaaaagagaagtgcagccttgatttgaatttgaacactttccccagattgcgatctgggagtgtttaagaggtgtagagatagttgatgaagggatcttatgacctgcatcgtattgttgttcgaaaaggaactgatgtagtgtgctcgatatcatatgtatcgttgctttccctgactcttatgggattgggtcaggtcctgataagaacaatgtatattagtatttttgagcttttgctgtggacacgcatacgcgctctcccgtgatacatttgtctttgttctagcacttgctcttgacatataatctggtgtctggccctgtcatgtttgtcccgattgattctgagtattatgatggtgtgatcttataccgctgaggtgtttatactggagagtctacagcagctgttagcttaatggatgcatagatgtacagtgacactcactagaagtacttgaagtgtggacagaagattatatagaaatgatcaaatattttaatttctgtgaaacaattcgtgataaagaagcgacgcctccagcctgtactggttatgcatggggccctctgatacagttatgtaaaggcatctcacatcaaacatactggcaaaatcaaagtacttc

SEQ ID NO: 7463 - DNA, 981 bp, Diabrotica virgifera
  misc_feature (924)..(924): n is a, c, g, or t
  misc_feature (931)..(933): n is a, c, g, or t
  misc_feature (965)..(965): n is a, c, g, or t
catgaatgaagaatacataagagaagaattaaaatctacagttgtcctttataaacatgacgaccgaacaaaaatttaatgctgctgtgaatgtcattcgaagtttaccaaaaaatggttcctaccaacccagtaatgaattgatgcttagattttacgcatattttaaacaagctacaaacggaacatgcacaggatcacgccccgctttttgggatcttgtaggaagagcaaagtatgacgcttggaagagccttggagatatgcccaaacaagaggcaatgacaaaatatgtcgatgaattacattcgatagtagaaactatgagctattcagataaggtagctaatttcctagaagctcctaccaatgaattagatgcaataaacttcgacgacttggagttaattgctggagatgttatcgaaagagttagatcacaacctaattcacctttagcatcaagagaaggttctccaattaggtttggttctaaaagtcccagtgtaggatcaactccgtctgttgctcccagtactccagatgactcagatcacagtgatgatgaatatattgacacgatagagaatccagatcccccaagaatgaacatatctcacgatggtattccaaacggatacatacaaacaccacaaaatcaacatatttcaagatcaaaaattaaatccactacaaacgtagacgtgtcacaggaaatatctttggctgtacagagcctgcgagcggatatcgaaaatatatcgaagaaagttaattcattggaaaatgcaaataggttggtagcgaaacgacaaaagagattatttcccaggagtccctaacaatttcttagcttttgtcatagcatggccttttatagccacatttatcatgaatcgatattggtatcgaaggaatctttangaaattnnngacagtgtgaagttagatacctgatactgtangacaaaactagtcttt

SEQ ID NO: 7464 - DNA, 271 bp, Diabrotica virgifera
gccgcattttaataaattagtagtcaaatgtagagaacttatcaacagagggccctggaaataattcataggtcctatcttcttcgattatatgagagtataatatacatttctatgtgtacattcgcaaatttaatttcccatgaccccttaaaatcatccataattttcaccccaaaagatctcgcaaccatttctgcttagagaagttcccctagacgctttcaaattaccccaactttgcgggaaaatgccccccctgaccctatca

SEQ ID NO: 7465 - DNA, 963 bp, Diabrotica virgifera
  misc_feature (750)..(763): n is a, c, g, or t
  misc_feature (765)..(779): n is a, c, g, or t
  misc_feature (929)..(929): n is a, c, g, or t
caatagaacaagtccacagagtcgttaaacaaattagcaatgacttagaaaagaaaagatattgttcagccgcattcatagatattagccaagcttttgataaggtgtggcatcctggactattgtataaaataaaaaaaggtttaccttacaacttctattcattattaaaatcatacataacagatttttcttagtaaaacagcagtctgaatatactaacatctaccacatacaatctggagtaccacagggtagtaccttgggcccaatattatatttattgtacacggcagacattcccactacagaacaaacaacagtatcaacatttgctgatgatacagcaatactagcctctcatcacaatcctgcaggagctacaagaaacctacaaacttgaacaaaataggagtatggctaaaaaagtggaaaataaaagcgaatgaatccaaatcaatacacgttactttcacgatgaaaaaaaaatcagtgtccaccagtgaaactaaataacagccaattagcacaagctgatagtgtgaaatacttagtagtgatgtaacgaatgtcattttttgaacattcgcgaatacgaatgcgaatgcgaatatctgttaccgacattcgcgaatgcggatgcgaatgcgaatattcagtttttttaaatttgtttctatttttgtaatgtttcctaaatttataatgaaaagttaattgatacttagtgtaaatcaatctgcttaagcnnnnnnnnnnnnnncnnnnnnnnnnnnnnngtgaaggctgataatgtgattatacaaggttaagttctatctatctattgcccgtcatttgtcccaagttgaacgtaggcctcccccttattttccactcttctcggtcagtgctaatgctgtcgatctggtccctgcgtatatttttangtcattcgaccatctcgtctgtggtctgcccctt

SEQ ID NO: 7466 - DNA, 877 bp, Diabrotica virgifera
aatacactcagaaatatcaaaaaactgaactcaaccttggcacaaatagaacagagtgcacagcagctcaaaaaagacaaagactctgtgaggaatgacattaataatttaaagactcagtttgatgcagctattgatagaattaagaaagatgataaaatcgataaagcaaccgcagaaaacctctacaaatccttatccgacaaggtaaacctacaaatggcagcgttacagaagaaaatccaagagcagaagatcgctgatgagcaggaaaggctgaggaagttacaggaagagatggaaagacagaggaagttaaaggaagaagaggaaagaagactgagggaggaggaagaaaacaggagacttaaagctgaaatggaagctagaaggaaaattgaggaggaagaaagaaggaagcaggaagaggctgataggttattagcaaaaaaacttcaggagcagcatgccaaggatgaagaagagcaaagacgtctccaagaacaggaagaccaagaaaagcaagatagggaattggccttgcgactagcacaagaaagcaacggatcaattgaagaaagtccacctatgattcgcaacggcgttatagaaccggacaaaatctacaagttgaacaggtcagaagcacacagaaaccatcaagctactttggccaatagcaaatatgacctgtctaaatggaaatactcggaacttcgtgatactatcaacacttcctgtgatattgacttgctagaagcttgtcggcatgaatttcatcgtcgtcttaaggtttaccacgcctggaaagcgaagaaccgcaaacgcaccatcatggacgagaacgaacgcgcccctcggtctgtcatggagtcgg

SEQ ID NO: 7467 - DNA, 487 bp, Diabrotica virgifera
tttccgcgctcgctcgtgctcgtctcgtaccgtctgtaacgcccctatccatcccacggcggattgctactctgtagaacgaggataatgtcgccaagggcaaagtgagtggcatgatgtctcttaggaaccggctggcaatactggcacgttcatattatattgaccctgcaatacatccccatacttacaaatgagagataatgcatgaggaccgagaccatcacccttgccaccacagacgcattatggatggcgaaaggaaaacccccggtcgaagggtattacattcagtggcagaggcgctttctgatagtgtaacagctactgtagtgagtatggtatacaagaatgaggtcgctaccttccaccgcagattcgcttccatcacctctgccatgcatctaattctaaattatggaatcactgaagttgatctatagtgcgaaataccaacccccaaccccaagaagacattctaccctgg

SEQ ID NO: 7468 - DNA, 515 bp, Diabrotica virgifera
gcagcttttgtgactttttcggcgctgggatcttctcaggcaacgctcttgatgacacctactgcaacgggttgcctcctggcatggacagaaaaacaagcaaagagcggggaaactcgggatgatactataccagagaggctcgtgagggatcccgtggccaatactgggttccactttctcaataagtccttataaaagaatagatacggtccaattggcggacacacagaataacaacacaaacaaaggaacgctacacgatcaagccctatacaatgtagacagaaactaccggtgagatgatataacaacaaatctactgcggacagaaagcaaacacccttacccgacgctgaatactactaccgtttttacactatctgaaatgatataatgtgattgattcagctcgatgaacccatccacattagtatataaataatacgaacccggaagacccttatttccccaggtgctgaccatagggagagtgcaaggagctcataccctta

SEQ ID NO: 7469 - DNA, 229 bp, Diabrotica virgifera
  misc_feature (27)..(27): n is a, c, g, or t
  misc_feature (57)..(57): n is a, c, g, or t
  misc_feature (64)..(77): n is a, c, g, or t
  misc_feature (80)..(102): n is a, c, g, or t
  misc_feature (104)..(104): n is a, c, g, or t
  misc_feature (114)..(114): n is a, c, g, or t
  misc_feature (134)..(134): n is a, c, g, or t
  misc_feature (154)..(154): n is a, c, g, or t
  misc_feature (171)..(171): n is a, c, g, or t
  misc_feature (211)..(212): n is a, c, g, or t
taacagcgtaattttattggagagttncaatcgataataaagattgcgacctcgatngtggatnnnnnnnnnnnnnnggnnnnnnnnnnnnnnnnnnnnnnntngtcgactttnaaattttacatgatctgagnttaaccggtgtgagccaggntggttctatctttattnattatatatttagtacaaaagaccaatatataaataattnnttatattagataatatt

SEQ ID NO: 7470 - DNA, 864 bp, Diabrotica virgifera
  misc_feature (6)..(26): n is a, c, g, or t
gtgacnnnnnnnnnnnnnnnnnnnnnattgttaaaacgtcaaagaaaagtggaaagacttatttttatttttgtctggattttggattgttgtcaaactgtgacatcagcaaaattggttggttaatgttagtggaagtagtgaaatgtctctaaaaccaagaagagtagactttaacgccacttggggcgctatcagggaaaccatcaatggtgtgattactctaaatcacgtagcaaggcctgtctggaatgatagattttccgatgtttattcaatatgtgtggcacatccagagcctatggctgataggctgtatgcagaaactaagcagtacctcatagatcatgttgcaaaacttttgaacaaggttcaagaagaaggcgaacaaaacttgataaaaaactatttcctctattggtctcagtactctgtaggtagccaatatttgcacagtttatatttgtatttaaaccaacaacatattaaaacacagaagctatcagatgctgaaatcatctatggaagtccagactctactggaggcgagcaaatggaaattggtgaattggcattggaaatatggcaaagtgggatgattgctccattgggcttacgattggtgaagcttttattggaggctatagaccaagatcgagcaaaacagacactgactgtacctatcgaggctgtaaaaggaaccattttaagtttcgttgaggttcaaggctataggaaaaaagccccactacagttgtatcaagaactgttcgaagaagaatttcttgatgctagtggagaacacttcaaaagagatgctgctagacttttacaggaaaaagacgtcagtttatatatggaaaa

SEQ ID NO: 7471 - DNA, 896 bp, Diabrotica virgifera
  misc_feature (164)..(186): n is a, c, g, or t
  misc_feature (247)..(261): n is a, c, g, or t
  misc_feature (363)..(384): n is a, c, g, or t
  misc_feature (815)..(834): n is a, c, g, or t
atttgtcttcagtaacatataataaattttatacaataaatgtagacgaaatcatataatattgtcgaacagagatgtacttaacctaacataacgtaaatgtggctcctgcacgaagaaaatttcctactgaacaccacaaaatacttttgattcaagatagnnnnnnnnnnnnnnnnnnnnnnnaccaatgaaggaccattgtatattcattagctgttacaataaactttacactttgaaatannnnnnnnnnnnnnnagtagattttaagagagcaaaaccatcattgacaactttcacagtatgtatttgtaaacttttttagtagtaatttttttgtgtgttcgcaatctttatacnnnnnnnnnnnnnnnnnnnnnnatacatatatacatatatatgcttttaagaatttttttagttagttaattttttgttacattcctgtttcatcctctttttattatttattgcgacattttttaacctttcactgttatattggataagtttaaacttgtgatgtctggttcacgtttagtcgagactagtttggagagtcaaataagttaagttgagattgtaagcgtatggtaaagagaaggggaaatgtacagatttttttttcaaattgtatacataagaacacaaatcaacacaaaaaactactaactaaaataaataaagtcttatatgtcaattgtcaaatataactgtcgtctgtcatttgtcacctaccctatgcttatattttgagacccatatatgtagcgcttaagcgtagttccgtagttctaccttatatcccgacnnnnnnnnnnnnnnnnnnnntgcaattaagacatttttttagtttattgaatgatgaacacgctatttcattatgtatttac

SEQ ID NO: 7472 - DNA, 521 bp, Diabrotica virgifera
  misc_feature (5)..(34): n is a, c, g, or t
  misc_feature (43)..(69): n is a, c, g, or t
  misc_feature (78)..(100): n is a, c, g, or t
  misc_feature (129)..(149): n is a, c, g, or t
  misc_feature (196)..(215): n is a, c, g, or t
  misc_feature (226)..(245): n is a, c, g, or t
  misc_feature (247)..(270): n is a, c, g, or t
  misc_feature (308)..(327): n is a, c, g, or t
  misc_feature (351)..(381): n is a, c, g, or t
  misc_feature (437)..(478): n is a, c, g, or t
  misc_feature (484)..(512): n is a, c, g, or t
gggannnnnnnnnnnnnnnnnnnnnnnnnnnnnncccaacccnnnnnnnnnnnnnnnnnnnnnnnnnnnctaaatctnnnnnnnnnnnnnnnnnnnnnnncgacccaagcgggcccccggggggacccnnnnnnnnnnnnnnnnnnnnnccaggggcaaacaaaaaaggggaaaaaaaggaaggggagggcggggnnnnnnnnnnnnnnnnnnnngggaaaggggnnnnnnnnnnnnnnnnnnnntnnnnnnnnnnnnnnnnnnnnnnnngggaggggggatatcccccccggaagttttttttggtnnnnnnnnnnnnnnnnnnnnccccgggaagaggattacttaaannnnnnnnnnnnnnnnnnnnnnnnnnnnnnngggggaaaatcctacccgccttaggggtttagaccccggcaaaaaaacaccggtcnnnnnnnnnnnnnnnnnnnnnnnnnnnnnnnnnnnnnnnnnnaattannnnnnnnnnnnnnnnnnnnnnnnnnnnntcccccccc

SEQ ID NO: 7473 - DNA, 884 bp, Diabrotica virgifera
  misc_feature (822)..(822): n is a, c, g, or t
cagataaggagaaggcagaaaacatgatttgaaaagtgaaagtgatgcatagtgaaatagtttcattttaatgtaaattgtggttaatcagtgctacaatagaaatatgcttagtcgaaaatgcctagtcgaaaaaatatcaacgaacaggccagttcctcaggctacattagcaggcagcgcagtaacacttggtcgaacaatgaagcaaacagccgagctgcatcaacgtcggtcccaagttacgatctaggggctagaggccctaggagatctttatggattagtgaagaacctacaagcaagttgcgccttagagtcatttgtgctaaaaatcttatgaaaaaggacatttttggagcaagtgatccatatgtaagaattgatttaaatagcgttaatggtgatgagacaatcgattctgtccttacaaaaacaaagaaaaggactcttagtcctgagtggaatgaggaatttatatttagggttaaaccaggagaacacaagttggtgttacaagtttttgatgaaaatcggttaactagagatgattttttgggtatggttgaacttcccctgctaaatttaccaaaagaacaaccagaaagaaatataccacctgtcaagtatttgctgcaaccgaggagtgatttcagtgcccgttcaagggtgagaggtcatctggaactataccacgcgtttttgtttgattcaaatctacctccaatagctgctccggaagaacccagcgatgaacgagattgggagatcgtccacgaaggaagagaggaagaagcagcgcagcccttatacatcactccnacgacagactcgcagccaagtccgttgccatctggttgggaagaagacaagatgccaatgga

SEQ ID NO: 7474 - DNA, 820 bp, Diabrotica virgifera
caacaactgagttggatccgcgcgtcgtttttactgaaacaataaactaaaattaatcaatcgcgagacaatcaaatcgagaaacaatgtcgtaaacctcaacaatctttaacagtagtattagttttaagtacatacttggtgctacttccgttgcaacaatgtcgcacctccggtattttttcatcctcgtagtgatctcaggtttctttgtgccaaagagtgatcctttcgaaataactctcgtaggtgctgttagtattattaaaatcgcgggtgaagttgtgggaggaattgcgaaagcctggaatatagtcgatcagaatgttgatttttcccacttgcctctaccgctcttggataagactgaagaaaaacttttcggaaaaattaatgtgatttcgcagaagctagatgaacttgctgtgaacttggagggagtaggtaccagtacgataactgtagttctcaacaatcttccagaccgagttcgattggaactcaggctaaacgatctcttaaagtacatgaccagtacagatgtcaatttcaaaagcttcttgcgatatgcagaccgtacgaaagacttcgaaaggttaactttagaagattttgcacgaatggtcgtatcgcacgacagcaactccgtcgtcagtattttggaaaggatacatgcgtttatagtgccgtctggtataggaatatcggatactgggattctggaattgttgcgcaggatattatggaagtggaaggagacatgttatgcaattctagacagtcacctcagcaggttatttacaaactgtataacgctata

SEQ ID NO: 7475 - DNA, 1180 bp, Diabrotica virgifera
  misc_feature (330)..(348): n is a, c, g, or t
  misc_feature (528)..(545): n is a, c, g, or t
  misc_feature (747)..(767): n is a, c, g, or t
  misc_feature (983)..(1005): n is a, c, g, or t
  misc_feature (1010)..(1035): n is a, c, g, or t
  misc_feature (1059)..(1141): n is a, c, g, or t
cataattggtttcatttagcataattaaagccgcttctttgatttttctctttttactgtcttctttcagaactatacttgaatctctccactgaactctatgttcattatcccatgcgtgttgacatatttgagatctatcaaattctctatttttaatataagactgatgttcacttattctaacgtttaatggtcttgatgtttcacctaaataaacttgttagcattcacaaagtatgttataaatacaattatttgttctttcttgttcactgttaggtttagttttagatagaataggtctcaataattttgggcgccaaaacnnnnnnnnnnnnnnnnnnntggtaaaattgtggcttgtttcccatcaaaactagttaattgcaaaaatgccacaaggtaatagcttcagaacaacattaaaattctcctgtaaccgtgttaattaacacacttctccgaaacggcttgtccaatttttatgaaattttacacgtatatcctgtaggactgagaataggnnnnnnnnnnnnnnnnnnacccataagttataaaggggcctctttgacatttttgaagttatacttctttacgatcgagagtgaaattttataatgccgggcgcatgcgcacacagacagtatgtagttcgttgctaatctttcaagacatgtatgtattatcagcgctgtcagcgcaaataagtcattaaaaggatatattagtgtttttagtaaatgnnnnnnnnnnnnnnnnnnnnngtgtctttggatttgtcttcctcgggaataagatattttataataatagtaagtaaatttaaagtagttttgtatacttcacttggtctattaaatttgtcagtatgtatgagaaatcttgtaacctgtcaaagcaaagggaatatagctcagtgatagagcgtatgaccgggagatctagaggggcccgggtttaaatcccggaccattcataannnnnnnnnnnnnnnnnnnnnnngatcnnnnnnnnnnnnnnnnnnnnnnnnnnggggaaggaaagaaaattagtttnnnnnnnnnnnnnnnnnnnnnnnnnnnnnnnnnnnnnnnnnnnnnnnnnnnnnnnnnnnnnnnnnnnnnnnnnnnnnnnnnnnttttttccaggggggaccaaaaaaaacaacccccaccca

SEQ ID NO: 7476 - DNA, 289 bp, Diabrotica virgifera
cgggccgcccctttcggaggacggattaatacttcttattatacaagaagcatttctcttactactttatctatgagagtgacaacgtcgtatctggtcacgaatgactgcaatacaaaagagccatctaatactgctgaacgtcgaaagccatcgcgttgaataacatgatggaagtaaataccctactgctatcgcttccgaagatgaacaagtaaatggccgactgatacgtgatctttggaattacgagctgcgtaaaatctgatgatatactcacatgtagccg

SEQ ID NO: 7477 - DNA, 143 bp, Diabrotica virgifera
ccaacgggactttaaacactcggaaaaaatcctttatgagtttttcgcccccaaagaaccttttttccaatgattaacaacattgtaaaagtttgggttttggggggggggagattattccccggaatgggggccccggggaa

SEQ ID NO: 7478 - DNA, 734 bp, Diabrotica virgifera
  misc_feature (7)..(92): n is a, c, g, or t
  misc_feature (666)..(685): n is a, c, g, or t
aaaaacnnnnnnnnnnnnnnnnnnnnnnnnnnnnnnnnnnnnnnnnnnnnnnnnnnnnnnnnnnnnnnnnnnnnnnnnnnnnnnnnnnnnnngatttatttaagcgcaatacttaactaaagtgcgtggggagaaggccaggaagggagatactatgaccaagaagtagacggggagcgtgagcgaagtaggagagttgagtccgggctcgggcagagaccagggcttatccgatcgaggggcggacggtcgagatgggaaatgatgggaactagggcaataatgacatgtgtgaaagagagaaacgtaaggtgagaattccaccatacgtcagatatgtcgaggaaggggctggcaatgttattcctggaatactcacactcatcttcgaattacaaagaatcaatatgagtgatgccgaacctgctacggataatgtctactgagaaatcgacagtaacaaccacaatcagctaagtcgtgaggaattgagagactagctcaaacaacaaagggcagccgttgatgacggagacgtcccgagtgaggaaaagaataacatggtagtctagcacgacaaactagcagaacaaatcttctatctcgagcatcacgactagaatggatacgtttcgtgtggagaattcaccggtcgtaaacacgacnnnnnnnnnnnnnnnnnnnnatagatttaacatctagcgaaatgttaatccataacgatgtatttgtta

SEQ ID NO: 7479 - DNA, 170 bp, Diabrotica virgifera
caaagaaggagacaaatgtattcctccatctagctgtaagaattgtgaatgtgaccttctaccccatgtatcttacgtcacttacgatgataacgaattcactatcaatggaaattgtgtctatgtcatgtcaagagatcaagttccacttgtcggacaggaaacatcat

SEQ ID NO: 7480 - DNA, 823 bp, Diabrotica virgifera
  misc_feature (593)..(612): n is a, c, g, or t
  misc_feature (794)..(794): n is a, c, g, or t
ggggcgaacggcgtgccggtgtagtccacgggtacgaagccgccaccgagggcgacggcggcaaccggcaatacgctgccggcggcttgggcgctcgggtcgttggcatgtttgctcaggttgatattgatgccgccgacggggataccggtctggtcatcgccaagcgtgccagtcaactcgagccagggtgttgttatgcagcgtgccgttttgcagggtgcgcgcgacgttgaggttaacggtgccgccggcttgcatcgtggcggcgtagcctgggccgccgttgtcggtccaggtggtgacatcgcttgtgtaggagaagggccgcacgtttggcgagcggtttttgagctcttcaaaacgcgccttgtcgaagttgccggcggcggtggcggcattgaacgcaggcacgtcgatgtattccatgccttcccacacgtgatcgttcacatgccctggggtgttgatcacgagtttgcgttgcccggtgcgcgtgccggcgccctggttgagcaagtcgccagcggtgatgctcagatcgccattggcggccagcaggctgtagcggttctgcacgttgtcgccttgcnnnnnnnnnnnnnnnnnnnngacgagccgcgccgaggccgagtccttggttgccgtttcaaggtaagtctcgttgatggtgatttcaccgcgccgccaattgtcgtcctcaccgcagtgctgcatacacacccaggccggctgccggtgggggagagggttgggcccagttcaaatgcgttctttgggcgtctcgataaagncccggcgtggatgccgatggaaccttcgc

SEQ ID NO: 7481 - DNA, 996 bp, Diabrotica virgifera
  misc_feature (252)..(273): n is a, c, g, or t
  misc_feature (611)..(628): n is a, c, g, or t
  misc_feature (762)..(781): n is a, c, g, or t
  misc_feature (787)..(806): n is a, c, g, or t
  misc_feature (896)..(896): n is a, c, g, or t
  misc_feature (905)..(905): n is a, c, g, or t
gaaaaagataggtaaaactttatttcaatacaataaaagaattatgtataatcgtaaaatataaaacataaaataaacattatttaaacaaaaatataaagaacaaagtactaatacaaagcacaaccgcataacttaataatacatatttatgaatatatctttatggtaaaaatcttactattaacaataaactaacaaactactaactaaccaatttagtcatgtttaaatttgatcgatctggtagcnnnnnnnnnnnnnnnnnnnnnngttataaatataactaattaaatatagacattatttaatttgcagcgcaatatatgtgaaaaacatagctaccgcttgtggaggacctagaatcaaataattaataatatgaatacctatttaaaaaagtttttattggacaataaattgcgcaacgtccaaaggtactgtttctttttttaggaaagttgaccaagtgaaaattattgcatacaaaatattaataaaatcacaccaatggaagtaagaaattatgttccttggtttttggtgtattttattactaggctgttcaataagttttgcgcttcggtaagagagggcattgttaccaaccnnnnnnnnnnnnnnnnnnttggtagactcttcatatgaacttgtgtgaaatttcagtgtaatctgtgaattcattttttgtctacaagtcattgagtattgacgtgtcacagtattttttacaatagaaacaatcaagaagcgtgcagtgannnnnnnnnnnnnnnnnnnnggtttnnnnnnnnnnnnnnnnnnnngaacgaatgttgaaagtgtatgaggactcttcgccttcagttagcacagtagaaagatgggttgctgaatttaaacgtggtcatacaagncttgaattncgatctaagtcaaggacatccaaaaacagcaataacaccagaaatcgtagaaaaatacaggatatggtatgggaaaatcgtcgagtgactg

SEQ ID NO: 7482 - DNA, 906 bp, Diabrotica virgifera
  misc_feature (3)..(23): n is a, c, g, or t
  misc_feature (851)..(878): n is a, c, g, or t
atnnnnnnnnnnnnnnnnnnnnnttttctgcaaattggaggtataaaattatttatcataagaaccactggcttaaagcgctgctaagtctaaaggaaattaaacaatggaaaagctgttaaaaatgtttcctttggcttacgattttttttgaatgaattcatcatcatcataagtggctcgacaatccgttgtggatcttggcctgctcacaaagaagccgccacttctgtcgattcctggcaacttccctccatcttctgacccctagaatcttttggtcttcttccacatcatcaatccatcttcttcgtggtttcctctacttcttgtgccctctgattttgaaaatgttaatctcctcgtgcattaggccccgttctcatgacaggcgcttattgcgcgttttgataacacgcgattacaactacatacattttacttgagatcgcgcgttaagcgccttaaatcgagcgttaagcgcctgtcatgagaacgggccctaatctcctcctgatctgacatcctagcaatgtgtccagcccatctaagtctctgctctttaacgaatttcacaatatctggatcgttgtataactgatatagttcaaagttgtatcttcgacgccatagcccattttcatttaggccccaaaaatctttctatcgtaagaatttttttgtaaaaaagaccaagaactctttcattattttgaaataagatctacgttacagccccatatatcaaaaccggtcttattaaggtcttgtatactgggtgtccccgaaagtggtgcgttcctttgaggtatggatataatacacaatttagaataaaaagtcctataacnnnnnnnnnnnnnnnnnnnnnnnnnnnngttaaccgtttccaagaaaaaaattaca

SEQ ID NO: 7483 - DNA, 300 bp, Diabrotica virgifera
gcggcggaaccggggggccacccctttttgggagggtggcgatatgaacggtctatggatcgacacttttagcggatggacctcagtcacgcgctgctagacgaggaggacaacaaggagaggaagagggatctaccatcctactcaagatattcctagagaaaaacagttgacgcaacagaagtccaagataactccgcttgtcgatcgagcagacaagactctaggaggctgtggtaggagtgtaaggacacctctacccaagaagttgggcagaggagatgtcagtgaaattgtacc

SEQ ID NO: 7484 - DNA, 697 bp, Diabrotica virgifera
ggggcggaattccccgggcgacccccccctccggggaggggctgatacgtttatattcggccgatgcatttactttggaaccggcataatctttatcatgttggggagcgttgagaaccaaccgaggaatacgattgcagatacagaacctcatgataaaatctaaaatccgtacgacaagatgatgatgtctactgacattacgttaattgtgtacacctctttatgcgactaaaattatcgctagtattaaatcaaaacgatatgtgataaatataaacagattcagctgattgctctgttgtttgacaacatatttgtcagatacctatttaatagaagtttacctctgaggcgaactgtatgcgatgtgcgaccaactccgagtcagagcgagtcggaacaaaactgagaaaaaacctaaaatccagaacttttcaatgaaagtcgggccattttttgaaacatacgactttaatagcattttattgattatataccattaatatgttgacgagaatgatggtgatgagttggcccggagtgatgattagatttttattagtgtttgatggttcgacttagcaatctataaatctctctcagaaaggggagaatgagaaatctaactgatgttggattgtggtgttaatagaaccttaaattaataacgaagtatactatcattatttgatat

SEQ ID NO: 7485 - DNA, 56 bp, Diabrotica virgifera
  misc_feature (19)..(50): n is a, c, g, or t
gtgtgagccaggttggttnnnnnnnnnnnnnnnnnnnnnnnnnnnnnnnngaaagg

SEQ ID NO: 7486 - DNA, 976 bp, Diabrotica virgifera
  misc_feature (865)..(865): n is a, c, g, or t
gaatatgctaataaaaaatatcactaatttaaaaacatcagataaaactgccatactattgtgcagcactaacaaaattttggatataaaaacatataaggaaatatatgaaataagcaagaaaatatttcagacaatggaacaattcttgaagaatacaacagtcaattgcgttggtttactaatggataaaaatgtataccttccctccatcataattagttatacaagaaaatgctacattaacgacgaaccaagagactctacactgcctattttcagagcaagtggtgatttagccttgttaaaaaacggcaaattatattacaaaggcagaaaaaacaatgtgataaaacgatttggacacaaaattaatctggctcaaattgaagaaactatatttgaaacatttggtcttgaaagcaggtgtgtgtggtctcaacagcataagaaaatcctcgcttttatagtgataaaagaaaaccacaacatcgatgttaaagaacggattttggataaacttagaagtaaattaatacatgctttaccagaaaatagctttcctgattattttgatatcattcaacaattgcctatcacctctcatgggaaagttgatacaaataagttagaaaccttctacactattagtacaaatgtacccaatggtaatgttctccacatattcataaacctttggtgcaagtaccttggagtcagtaacggtgatactgactatttaaacaattatacttttttcgagatgggtggaaactccataagtttgatgcagttaatcgaagaatttagaaccttgacaaacaatcagtacacagatgaaatcattgcaataattttcgagaanaaattgcagattgcgtgaaatgtgtaaacaaataagtaagaaagtagtttgtaatgtagaaatgtgaaaaagtatggactttgaaatcactggtaaacgaccaaaaattca

SEQ ID NO: 7487 - DNA, 324 bp, Diabrotica virgifera
ccgatggtgtattattgtgcgatgtcggcgatcacgccacttattattcgaattacaaacaatttggctagtcaaagatgcactgtggtattaatacggaaaaggtagatctaaacatatgtacaacatattattaagaagtattacaaagtgataacgaatgcgtaagggaagatggcgtactctagaatttgttatcaatatttctgaagttcgaagtgggagtaaaactaccaattctagtaaaggccaactgcatagagaaagtgttttcggcgcaaacaatttgattgagggtgttgtagctactgtatatgcctcgcg

SEQ ID NO: 7488 - DNA, 405 bp, Diabrotica virgifera
gggcccccacgcgccgcgggcgaatgtccgtgtcgaggcattcatgtacggatgcaccatgccgtagcagaaaaatatccaggcgacgacgagtccacaggaatagtgatagctacgacggatgaagaagaaccgtgcttctgtaatgctgaagacaacgacgatcttggatgtgatgccataactcgtacaggaagatggaagagatgagattgcggaagcgggagcagtagagagcgttgataggatgtagacaggaggacactcaaagtaggttattagaacgcatatgacgagatcaaccccggcgttgagaattaatgtgtgaggattggacctatagcatatgttctcgagcctgcacaagattggatggtgctacagaggatataaccatcggaacta

SEQ ID NO: 7489 - DNA, 52 bp, Diabrotica virgifera
  misc_feature (25)..(26): n is a, c, g, or t
atacattgttacttcagacacactnntaactcttcatggactggctatctat

SEQ ID NO: 7490 - DNA, 783 bp, Diabrotica virgifera
caaggattacaaggattacaatcattacgagaactacgaggattccaaggtgttcatgctgctcttgctcttgtgccaattgattctacctattctcaacagccccatgtgccaactgaatcaactcaatcccatttgccccctgtgccaagtgatactcatgatcctcatgaacatcccactcatccctatcactacttcaactacgttgaccctgctgatgctgcctatgcacccccctctgacccctatgaaacagcccaaaccccacctccatccactccttacgaaccaacaccatccaatgcatatgctgtacctgtactaccaagagaagcacccaatgcatccaaaccatacgaagaacacgaagaacccgaacctccaccacaaagaccaccaagagaacctccaaaaatttacccaccatacccaatctacaaaacccatgaagaacgagaagaaccagaataccctgtatacaaaaaagaaaaagtagaggcaatagcgacagcatatacaccatacccacctgctccaccacatctagtacaactccaaataccccttctaatcctacttcaagtagctggagttcatgaagatcatactccctgtacaccctgtgatcgcgctgctgctgtacaagctgtaaaagtggccaactatgcctattatgtatatggaccctatgaagactatggacgactgcaaggactcctgaacgtcctgtctgtataatcactctaccgattctaattatcatcctcctctcttgactct

SEQ ID NO: 7491 - DNA, 947 bp, Diabrotica virgifera
  misc_feature (503)..(528): n is a, c, g, or t
  misc_feature (887)..(887): n is a, c, g, or t
  misc_feature (906)..(906): n is a, c, g, or t
agggagcattcatcacagatcacttgacactactcactttgtcattgtacgtctgaagtcactacgttactgtagttgttttttttttagcttgcatatatgcttttcgaatttatttatccaggcttatactgcttattctcagatttgcgatttggaacatttttattgcccgtggacaagagactatagttgaacttatactgggactgaagtttcacgacaaatgaatcccaaaacgtgcaatatcaacgttcaaacttagtacaaacacaaccatagaaagtaatgcaaaatcatttaaattatagtttctttaccacaaaaatatgcaacactacttactattcgaatgttttggcaacattgtggggttctgacgtcagaaatcttgaatgacgtaagcgtttttttgtagtaaaaaaactattataatgtttaaaactcatgatgctcttataaacgaacttttttgttttatatccaaaaaacgattgcttgannnnnnnnnnnnnnnnnnnnnnnnnnctattgtgaacgcctataatttatatacatgtatagttcaacgttaatattttgacagctttcgaatccaaattacgcttctttacgatttgtgacatgtgtcaaactgtttgacgtacaagtgtcaaatttatattgaaactgataacatttttgactattgtgacaggtgtcaaaatatttaacataaagccaaattcgaattaaagaaatttacttttgttttctttgacgattatcgtgacaggtgtcaaaatatttgacatataaacgtcaaattttaattagagccatttacgttggtttttctttgatgattaacgtgacaggtgtcaaaatgtttgacacataaacatcanatttgaatttaagatattntcgttcgctttcttgcttatattgtgatatatgtcaaatta

SEQ ID NO: 7492 - DNA, 161 bp, Diabrotica virgifera
  misc_feature (93)..(149): n is a, c, g, or t
tttccgccaagaagtcgccgttttattcatcaggttagtttcgatcaggagcatttactttcgttccaaacggaggcaatgggaagaaaaaannnnnnnnnnnnnnnnnnnnnnnnnnnnnnnnnnnnnnnnnnnnnnnnnnnnnnnnnctggagatacac

SEQ ID NO: 7493 - DNA, 477 bp, Diabrotica virgifera
  misc_feature (35)..(71): n is a, c, g, or t
  misc_feature (82)..(148): n is a, c, g, or t
  misc_feature (151)..(214): n is a, c, g, or t
  misc_feature (245)..(454): n is a, c, g, or t
acacacacagcggggttttttttctccccccccgnnnnnnnnnnnnnnnnnnnnnnnnnnnnnnnnnnnnnttgtggggggnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnnnnnnnnnnnnnnnnnnnnnnnnnnnnnnnnnnnnnnnnnccttttcctctttttttgttggggggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaagagagagggggttttt

SEQ ID NO: 7494 - DNA, 252 bp, Diabrotica virgifera
ctgctcgggcatgagacgaaatcgcatcggcagtacgcgacaccgcacaggtgaatctcagtttcacgacggtaccaccagcgtatgagaactgggataaaccggagagtgcaaacacctgctagagacgagcgttggagcgacatcctcgcatttcacgcacgagtgtgcggtaatcactcgtaacgagagcgccgagatcgtattctctccattcccatacagagagcctccccctgagtcgcccaatgg

SEQ ID NO: 7495 - DNA, 569 bp, Diabrotica virgifera
  misc_feature (3)..(15): n is a, c, g, or t
  misc_feature (20)..(69): n is a, c, g, or t
  misc_feature (72)..(250): n is a, c, g, or t
  misc_feature (259)..(355): n is a, c, g, or t
  misc_feature (361)..(400): n is a, c, g, or t
  misc_feature (402)..(433): n is a, c, g, or t
  misc_feature (467)..(504): n is a, c, g, or t
  misc_feature (532)..(565): n is a, c, g, or t
ggnnnnnnnnnnnnntcacnnnnnnnnnnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagnnnnnnnnnnnnnnnnnnnnnnnnnnnnnnnnnnnnnnnntnnnnnnnnnnnnnnnnnnnnnnnnnnnnnnnncggggggccgcgcccccaccccccacctcccacnnnnnnnnnnnnnnnnnnnnnnnnnnnnnnnnnnnnnncttcttttatctacacccccccccaccnnnnnnnnnnnnnnnnnnnnnnnnnnnnnnnnnnaccc

SEQ ID NO: 7496 - DNA, 757 bp, Diabrotica virgifera
  misc_feature (690)..(690): n is a, c, g, or t
  misc_feature (716)..(734): n is a, c, g, or t
gatataacccggacggtattgcgggccggggccccagccattgccgtgcccgtcggggcgacctggccagcggtgatcgttgggatggttattgccaccaccattgaagccgggccggccggggccaccctggccaccattgccggcctgccaatgctgattgccatcgttgcgacgcggaatgtcctgatagttgccgggacgtggttcctgggtctggcgcacggtatccgggcgcccctgaatcggcaggttattcgccggctgaggtgccgggtgcgggggttgctcctggttgccttgcgggcgaccttgccactggccacccccattaggccgctcaaaatgctcattctgcggccgtggctgattattttcgaaatgcgggttctgtggacgcggctgattgttctcgggacgaggggcttcgggacgcggttgattattttgcggtcgaggctggttgttctgcggccgaggctgattattgcctggatgcccttccgggcctttttcatgctggccaccgccttcagggcgtggctgttcgtcggccatcacttgcgcaccaacggtgaccatcagcaaaccaacacctgccaaacgccagatgcgcttcatgctattcctcactgcggattagggcctacacgtaagactggaaaaccggggcccggttctgcgacaggncatcagtcacgagaactattttcgcnnnnnnnnnnnnnnnnnnngccccgtcggtcgcccctttgag

SEQ ID NO: 7497 - DNA, 51 bp, Diabrotica virgifera
  misc_feature (4)..(4): n is a, c, g, or t
atanaaacactttattttatattctataaacactataaatcgataattatg

SEQ ID NO: 7498 - DNA, 487 bp, Diabrotica virgifera
gacaccaacaggcaagccactctcagccggcccgccacgtaatgacggggaaaacccaggcgcaaacccagctgagacgccgtgcagcacataccgcacaacacgagaagacgaaatacagaaaaggaccgaaccgatcgcccaacccaacagagagcgccaccagaacggccaacgggacgcgcccgggagcggagcaaaaaacgcggaggacgcgctgcccacgcgcaaagggaccaggacacaagacagaggacgaccgccagcaccaaacacccaccacccaagctgactccccacgaacggagaccatccccgccaagcacgaaaaacgggagctccccccagaggaacgataaagagcatgacggcaccacgaccccgaagaacaagaacagggagacgaggcacaccaaagagacatcgcccagatagacggcgcctcgccataagacgcaagaataacacgaaccaaatagacgggccc

SEQ ID NO: 7499 - DNA, 928 bp, Diabrotica virgifera
  misc_feature (803)..(822): n is a, c, g, or t
ttttctcgtcggaaaaaattacaagctgtaggtactgttttctgaatctttagtttgtttttaacgtaaaagttattaccgagtgttttcaaaactctgcaacatggatgtgtttatgccaattgctttgtgtgttatttttattattttgtttactatttgtggttggtgctgcaaaagaaaacgtgagggtactgtttatggatatggtccttcagtcacagtcacaacgacaacgcagcatgctcaatcgccacaggtagtcccaccttatcccatagatacacgtcatccggtaccagctagtaatattacgggatatggaaatcaagccccatatcaacaatacccattccacccaacaggtaatgtggcatcacccatggcaggagcaactccatacccgccacagccttaccaacaagccgcacacgactacagcgccaacccacctccatacgacgtggcagtatctcaaccacctcttcaaccaccccccaattcaaaggagggctacgtcaagcagtccccttacaacccagggtataattaagttcttctcatccaaccgttgactgttttagttggttcttcttacatttcgttacttaaagaagttggcagaactttttttgtttataattaaagtgtgtttaatgttattgaaatagaagaggtgttaacgcgttgacggacagtgcgtcaaatgtataagcaagtgttgtgacactatatgaattttacaaagtagaataaggaaattgctgaatttttgcttttagcacttatagtttatggaaacnnnnnnnnnnnnnnnnnnnnttgtaaacacgtggacacaaaccattggatgtcgtgtcattcatatgcatctctagatgtaatatgacaaaaatctacccgatttttttgtcacaactcgtatttt

SEQ ID NO: 7500 - DNA, 896 bp, Diabrotica virgifera
  misc_feature (303)..(320): n is a, c, g, or t
  misc_feature (853)..(854): n is a, c, g, or t
gaaagttgttctgaacaaaaactactttctgttttgacaaatatcgtactattcttgatatgtactaagatcgtcactgcggaaatcctctgctgatgattctatttttggaaagtgaagctaagatagagtttcgcaagcatgtagtcgttctccaagaggcccgaaaatgcacgtggtccactggtacttctatccggcgttatcgaaatgcctcccactttttcaggtaaatattttcttacatgaaatgcctcccaggtacaatcgaattgcctccgtttcgttaatcatttaggctgnnnnnnnnnnnnnnnnnnctctgtataatgacagaatgttgccaaatcataatttaaataggtagagtatctatatttattttgattcttctaattcttattgcgtgtacctacataaaatttgtttcacataaatatttcacagtacgacatacacatttctttttagaaaagaaagttgttgttgttacccgacaatctaatatccagcttttctgggtaattccaattgcgattctaatcttttcttaacgattccatgaataggtacttttaccttgatctttttaaatgttggccaaagatacagtaaaacggtggacatgtactaaaaaaacctgcaaagcatttttgtgaaaacacagggatgtgaaaatacgataattgaatcaatattagatcataaccacgagaagttgtctgccgaagtttacaagagaaaagccgtaagaaattcaataaaaagagcagctggtggaagatctcagcgaaaaccaatgaagctcatctgtaaagaacttaagaaagataatatagagacatttactatnncatgatatcatagcatcttctattattacaatagaaaatgaa

SEQ ID NO: 7501 - DNA, 805 bp, Diabrotica virgifera
tgcatccaccaggccttccgctgccagcgccggcagcatctcggcgcagatgtgcgcgatgtaagcatcggcacggtccacgtactccggcggcaacgcgtgagctgccaggcacgtgctgcgtacgctcaccggcagctcggtgccgaggcggcggatcacccgcagaatcttgcgctcgctggccagatccaggccgtagccggacttgatctccacagtggtcacgccatcccgcagcaaactgcgcaggcgctttcggctactttcaaacagttcatcttcggtcgccgcacgcgtggcgcgcacggtgctggcaataccgccaccggccgctgcgatctcggcgtagctcacgccttccagacgctgctcgaactcgccgctgcgattgccgccgaacaccgtgtgggtgtggcagtcgatcagcccgggcgtgacccacgccccttgcaggtcatgggtggtcgcgtagtccgccttcggcagttcggcacgcggaccgatccactcgatgagcgtgcccgaggtcacgatggcggcatcctcgatgatcgagtatttgccctgggccatggttgcgacgtggcagtgttgccaaagcgttttcatcaacgcctccgttgggttatcgatgagacaaagccgggtcgtaatgaaccttggctgcttgcccggcggcgggtttgacccacagcagataggcaacgatcagcaagacgatccatacggcaccgaccataagagcagcctgggtgtccgggaagtaacccaacacgccgaagataaacagcatgaacacgat

SEQ ID NO: 7502 - DNA, 962 bp, Diabrotica virgifera
  misc_feature (12)..(46): n is a, c, g, or t
  misc_feature (93)..(136): n is a, c, g, or t
  misc_feature (143)..(162): n is a, c, g, or t
  misc_feature (218)..(242): n is a, c, g, or t
  misc_feature (291)..(323): n is a, c, g, or t
  misc_feature (333)..(372): n is a, c, g, or t
  misc_feature (400)..(425): n is a, c, g, or t
  misc_feature (441)..(459): n is a, c, g, or t
  misc_feature (469)..(494): n is a, c, g, or t
  misc_feature (623)..(643): n is a, c, g, or t
  misc_feature (666)..(687): n is a, c, g, or t
  misc_feature (772)..(791): n is a, c, g, or t
  misc_feature (793)..(806): n is a, c, g, or t
  misc_feature (883)..(918): n is a, c, g, or t
  misc_feature (921)..(940): n is a, c, g, or t
gccaaccccctnnnnnnnnnnnnnnnnnnnnnnnnnnnnnnnnnnnggcccccaaaaggttaaaatttctttggtacgggggggaacaaaaannnnnnnnnnnnnnnnnnnnnnnnnnnnnnnnnnnnnnnnnnnnctccccnnnnnnnnnnnnnnnnnnnncccaaaggggggggggaccggaattttttggaggggggaaaaagggggtgggcccnnnnnnnnnnnnnnnnnnnnnnnnngggaccccttaaaccccgggggttttccctcaaaaaaaaggggttatgnnnnnnnnnnnnnnnnnnnnnnnnnnnnnnnnnatggtttggnnnnnnnnnnnnnnnnnnnnnnnnnnnnnnnnnnnnnnnnccttcgggggggggggaaaaatttgggnnnnnnnnnnnnnnnnnnnnnnnnnnggcctagggggttttnnnnnnnnnnnnnnnnnnncctttggaannnnnnnnnnnnnnnnnnnnnnnnnncccctttcgggccccaaaaacaaaggggggccaaggggggggcacccagtgggggaaccaaaaattcttttaaaaaatggggagggagaataagatttttcccccggggttttggggcccccattcccnnnnnnnnnnnnnnnnnnnnnggtgttcggggctcctctttttnnnnnnnnnnnnnnnnnnnnnnaaggggaagggggtgggggaagaggtgtggtggggaaacaggccccttcttttacaagaaatttgttcctcccgggggtttgggnnnnnnnnnnnnnnnnnnnnannnnnnnnnnnnnnggtggaggaatattcgggggaaaaattccacccacgggtttttatgtgtggggggggggccccgggggccctccccnnnnnnnnnnnnnnnnnnnnnnnnnnnnnnnnnnnnccnnnnnnnnnnnnnnnnnnnncctctctgccgccccttttttt

SEQ ID NO: 7503 - DNA, 662 bp, Diabrotica virgifera
ccagatgacagctaggggtgttaaatgaaatctgctagatcttacaaaccacatacattagacatggttatatggaatgctgttgctggcgcttcaaacatgatctacctatcaatcatcaaaagaataatcaccccacagctagctcgaattctccttaaattctcttctgacctatgccatgaaaacatgtgcttgcttttaactgtcatgccttattactgtcatgcactacgccaggtatatcccgccagagatgaatgacccgctcaccttgactttccctcttaccagaccagctgtcatcaccccataacttatcgaaacgattcccgtcaaattctgctctttaatacttcactctgaaacgcatcttgacgtataccgaagaactctataactctatctattcactatattgcggtgtatattacataaggacaaaattatgacgaccatcaaatgcgctctaggtgcttctactctctttgatgcgtactgccatctctctcgagtatcatgaaatacgctctattacagtgaatgtgcacaatagtccacactgaactgtctaatcgaacagaagcctgttatgttatcgtaatagacgtttctaccatctaaaatgtagccgacgtaaaagctctgccacccataaaact

SEQ ID NO: 7504 - DNA, 664 bp, Diabrotica virgifera
  misc_feature (38)..(53): n is a, c, g, or t
  misc_feature (55)..(67): n is a, c, g, or t
  misc_feature (201)..(217): n is a, c, g, or t
ataaagtaacattttgtatattacaacatttaacaacnnnnnnnnnnnnnnnncnnnnnnnnnnnnncttggtttatatcatacaaacaaaattatttcatacaaaagccataatcttgaataatatttacaatggcccttcttccgatatcctccagaaagtgaatgtccaagtaacgaataactcgctactgccaaaannnnnnnnnnnnnnnnnagattacgcaagctcaaatatgtacttacgcctcatgtaaagatgcctgccagcatgattctggaggtcctgtaatctggcaagatcctgataggagaatactgtatgctgttggagtgatatcttatggactaagatggctctacataatcatccacgcagtaaatatgataattacaatctacttggattgtggccttactatcacaaaaactctggatgcttgtctaagaatattttaattgaagcatctataacattatcatctcacaatcctgatcaaaccactgatatacaatggatctatagatgcggaagtatacttatgattatcacatgattgtacacctgatcgtcgacaacattacccctcgtgacactctcatcgtactcagctgtcttatactgaggaatgatggtctacgacaattccaatatatgcaacga

SEQ ID NO: 7505 - DNA, 963 bp, Diabrotica virgifera
  misc_feature (856)..(856): n is a, c, g, or t
ctagttctagatcgcgaagaattatgaaccttcttaatgtttcacatctacctgatgaatgggaaaacagttgcgataaggacccaaacgtaagtttataatttactaacatgtataaactacttacatattattttgcatttttaggtcagcaatgaagaaaaagagaacatccctttaagttcaacatcaaaacgttcgtcgagatcgtcatctagtagttccagttcgtcttctagcgtcaacagtagtagttcgtcatcttctagcagcagctcttcctctcgatgttgttcactggaacaaggacgatttgtttcccatatcttaaaaggtaaagaaattgaagcccagcctcagtctttatcgtctagaactacttcaccttcaatactagaatcagtaattttaacaccacgaactccagctgtacattaccgtatatcgccaatgaattcagaagagagtgatgctgatattagtgacaatgatcccacttataatgaacatcaaggtagaaaacgttcgccaagctcatcttcaagttcctctgatgatggtacttctgaagtagttgcaacatcgcccaggagatcgaagaaacgtaaagctgatcctactaaatggaagcaaaataaccaaaagataaaacgaaatgcaggagaacaatacatttctactaagactagaaacgttgttcctgcgcgtcaaatgaagagtccatgcaatcagaaatgcagattgaaatgcagcgaaaattttgatgaggctaaaagacttcaacatttcaaatgtttttgggcactagaagatttgcaattacagcgtatgtttataaaagcaagaatggctttangtgaaccctaaatatagtattcaaacgctcaacatcccagagcaccaaatgctgctttctacttgtacgatgataacgccaaaatcagagtctgcaaaacatttttt

SEQ ID NO: 7506 - DNA, 676 bp, Diabrotica virgifera
  misc_feature (42)..(61): n is a, c, g, or t
  misc_feature (76)..(96): n is a, c, g, or t
  misc_feature (186)..(211): n is a, c, g, or t
  misc_feature (375)..(392): n is a, c, g, or t
ctagtttagaatagtacaagatcctcttactcaagccaaccnnnnnnnnnnnnnnnnnnnngaattaccattgagnnnnnnnnnnnnnnnnnnnnnctagatgtttatttttcgaacctctgcgtatcaaggattattaattaacaatgatatttctattatttctctaatttgactacagctagnnnnnnnnnnnnnnnnnnnnnnnnnngagatttgttgtactttccctcgcactgctatgtcatgccgatttgaatatagctacttatttaaaacataacttaaacttatgtatgaacaatatatatgtagttggatatttccctatcattcctatcctctattttctgaggatgagctaagaattatacnnnnnnnnnnnnnnnnnnctcctgtaaaaagttggattattgatttgcatattctaacatctgatattattcatctttatatattattatttgtattctacctccatcatttattagcacagcctttaccattctcatttcttaacactgatgataatagtattattatttaattgaatatataatatttatatataagtataataactgaattctattgacactttttactcctgtttattaatgacatgtcttcttggatcttatgatatagtctcatctgcccactgatccatttgaat

SEQ ID NO: 7507 - DNA, 860 bp, Diabrotica virgifera
  misc_feature (44)..(806): n is a, c, g, or t
gcgagcggcagatcgaatagctgctcttgcaaagatgaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgagacttcgaaaaccccaactccgacagaagcaaatggatccctcctgacc

SEQ ID NO: 7508 - DNA, 335 bp, Diabrotica virgifera
cctcgggggcccacgcgtcggatttcagacttttgacgaagtcctttttagagcaagttattttattaatttcaatcacattgcagaggtaaaaagaaataaaaatggtatccctagatcccttaagaattctcaggcacaaagtcgcggaagaacaggcagagatagcccgaatcaggagatatgtaggcgcaatagatgtaggagatatggaaagaaacatctggctactaaaagagatggacaaaatgataataacaagtgcaacatatgcagggtcggataaaatcactgacgaggtaggaattgtgctaggaaccgcggtcatagaatgc

SEQ ID NO: 7509 - DNA, 59 bp, Diabrotica virgifera
  misc_feature (35)..(58): n is a, c, g, or t
ggaaatcgcttttaaaaaacactgaaatctaaacnnnnnnnnnnnnnnnnnnnnnnnna

SEQ ID NO: 7510 - DNA, 565 bp, Diabrotica virgifera
  misc_feature (2)..(318): n is a, c, g, or t
  misc_feature (335)..(372): n is a, c, g, or t
  misc_feature (392)..(405): n is a, c, g, or t
  misc_feature (408)..(430): n is a, c, g, or t
  misc_feature (438)..(460): n is a, c, g, or t
  misc_feature (490)..(521): n is a, c, g, or t
  misc_feature (528)..(564): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggatggttnnnnnnnnnnnnnnnnnnnnnnnnnnnnnnnngaaaggnnnnnnnnnnnnnnnnnnnnnnnnnnnnnnnnnnnnna

SEQ ID NO: 7511 - DNA, 958 bp, Diabrotica virgifera
  misc_feature (126)..(145): n is a, c, g, or t
  misc_feature (546)..(560): n is a, c, g, or t
  misc_feature (620)..(645): n is a, c, g, or t
ctagaaaatattttccaatttaaatcgaatttatttattcaagttctacaaggtattacatttcccttacaaaagaaattcgcctattaatgtattttttctaatttttagttgccgtggggggcnnnnnnnnnnnnnnnnnnnnaacgcaattttactaaaatactaaatggtgtgttaggcaacttttgtgagctattacattttcgtttacttttccatcgcaaaaaaagctttttttcgcctttttcgatgcaccctactgtatatgtcagaataacattttttttaaataggtaaaaaataggaatatcttgatttaaatcatcaaaaagtacataaattttatcggatgcacccaatgcaacctatttcttctctgccttctttttaatcttctattcagcactacccaaagtagcaaatcactgcgatccacattacttcttactataaaaagaaaatacgacaacaatatcttgtcaaatgacacttcacggatgaatgtcgtgttggtatgaaatgagccaaatttctgccgttgtnnnnnnnnnnnnnnnatacgctctgagcttcgctggtgtcgctcctagcggattactaatgcaacttttaccggnnnnnnnnnnnnnnnnnnnnnnnnnnttataggttaatatttacaacgcaaaaaagtaattaaattgtaatcgattttttaatcattttgctaatcattttaacgttctattaatgaaatattaatttcttacttcggatactttcacaattatcgtgtagatggcgcttagattaatttataattacatattacgaaatataaaaaaaacttaaattcagtatttaaaacgtaagtatatttaaggtaaaaatatacaccacagctttgaccaactaatattatttcctattaatgtttttattttcaatggttttaattaatcaagttgacatttat

SEQ ID NO: 7512 - DNA, 966 bp, Diabrotica virgifera
  misc_feature (839)..(839): n is a, c, g, or t
  misc_feature (865)..(865): n is a, c, g, or t
  misc_feature (901)..(903): n is a, c, g, or t
caaatgtataccgtgatggtaatactctccttagttctagaactactcaaaaccttcgcttttctagacttttgcaaaagggcatcgataaatatacataaagcgatgataaagaatgtactacattcagtgatggctttcttcgatacacactttattggtaatatattaaacaggttttcccaggatgtgattaatgttgatgagaatttaccctttcagttgttaaattgtctagaggtagcaatcaatgttggtgcagctgctactttacttatgacagtaaatccatattttttcttttatatatcagtaacgtttggagtaatgttattatttttaaagctatatcttccaataaccagaaatttgcgaagacttgaagcttcaacaagaagtccaatgataggtcatttaaatgctgctctggaaggtgttaccactgttagagcctataaagcagaaaatatgatcatcgatgagtacgagaggcatcaagacgttttcacttcggcccactacagtctactgtgtttcaagttcggaatgggattctacatgagcatgttggctggtgttatggtgacgctggtcatttgtagtttcgttctttttgaaacagatgccacagctggaagcattggtttagccttgacccaagtgatatatttaggtgctctaatacaaggagcagtgagatgttgggctgatttggaaactttaatgacagctactgaacgagccctggaatataccggattaaagtctgaaacaacacaaggcagcgtaccaaaacattggcctaaagacggaaccataagtttccaaaatgttagttnatcttataattctactcaaagaattntgaaacatttgagttttcaaagtcaggcgaaagaannnaatggatagtaggccgaacaggggctgggaagtcctcataatatcacatatttagactctatg

SEQ ID NO: 7513 - DNA, 60 bp, Diabrotica virgifera
  misc_feature (38)..(55): n is a, c, g, or t
aaaaaaggtaccccccgggccccgccgggaattccccnnnnnnnnnnnnnnnnnnggcta

SEQ ID NO: 7514 - DNA, 901 bp, Diabrotica virgifera
gacctgtaattgcgatggttgatatcgaggttaggaatattaacgagcaaatgcgacagaaggtattttatgaggtcattgctgatatgggccctcctgattctacaataattgtaaattttgaaaacgcttctgaaaatggcggcttcattggatttgattcaactatgatgacagttctgttagaagaattctcgcagttgggagaaattattctagttagattcgtgtcagatactatgtggatcacattcagagacgggcaagttgttttagaagccttaaagaaaacaaagggtgaactaaatgtaaacggcattgactttactctttcgttgaagacaccaaactgggtggatctggcaaaagaagaaatagatctgtgtacaagtaataccattccattatacacttcaccaagccagtctgattataactgtttaggcattccagaagtgaataaagtacctcgcacagctccaccaagtagacctcctccaccagtagtaaaatcaacacaatcatctccaagacgagcacctccaaaagcgggagtcatccatatgccggttagacctcctgcgacgatttctccaactaataatacaaacaattatgtgtcttctgctccaccattgccaagtcctccaatgtcaagtgttccagctgcagctccaccgctttgttcagctcctccgcaaatgcccccaccagatctaccaagtcagatgtctcaagaggagggcgtttacgaagagataagcgacgatgtgataagtactccagaaccattaggtcctcctccaccgccaccaagaccggattcgggtgcgctacctcctactccttcacgaggaccacctccagtaccagcacgatcagctcctcccccaccacttcc

SEQ ID NO: 7515 - DNA, 698 bp, Diabrotica virgifera
  misc_feature (485)..(502): n is a, c, g, or t
taagtaatggtacccccatttctttcctttattatcccgccctggtttcctttcctttgcccgcttaaattgttgcttggggctaagaatgggccccttaaaaaacccttgggtttttaaaaatttggcatccctccccaagggtgattcctggggaaactggtttgggttttttattcccttacggggagctttgcgattttgggtatgatttgggggattctttgacttggcccttgctggatagggaaaaccccccccgttttactttaacttccaacttattggaccctccaaataatccaccccttcaatgggaaaaaattgtcaaacccttggattaatggatcatttaagatatattggagttttttcttgaaaccaaattataaaaaacggggaggaaaaaatggatgcgtcggatttgaaatggtgttgggggaattccggttcaacccaaaattttgcaagctttctttggatcnnnnnnnnnnnnnnnnnnttttcgggttgcttgggccaatatagctttgagaatctagccagacattattccaatttggaccctttcctttttcctaaagaaatataactttttggaatcctagtggtggaataggtctaccctattgcaccttccaaataatctacaccttcaaaatggaaaaattggcaaacctttggattaatggatcatt

SEQ ID NO: 7516 - DNA, 773 bp, Diabrotica virgifera
  misc_feature (2)..(208): n is a, c, g, or t
  misc_feature (213)..(255): n is a, c, g, or t
  misc_feature (263)..(280): n is a, c, g, or t
  misc_feature (288)..(333): n is a, c, g, or t
  misc_feature (345)..(419): n is a, c, g, or t
  misc_feature (424)..(443): n is a, c, g, or t
  misc_feature (472)..(507): n is a, c, g, or t
  misc_feature (509)..(536): n is a, c, g, or t
  misc_feature (541)..(592): n is a, c, g, or t
  misc_feature (597)..(682): n is a, c, g, or t
  misc_feature (694)..(714): n is a, c, g, or t
  misc_feature (741)..(761): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttnnnnnnnnnnnnnnnnnnnnnnnnnnnnnnnnnnnnnnnnnnncatataannnnnnnnnnnnnnnnnntccccccnnnnnnnnnnnnnnnnnnnnnnnnnnnnnnnnnnnnnnnnnnnnnnggggctacaaannnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnggggggaattttttttttaggggtttttnnnnnnnnnnnnnnnnnnnnnnnnnnnnnnnnnnnntnnnnnnnnnnnnnnnnnnnnnnnnnnnncttgnnnnnnnnnnnnnnnnnnnnnnnnnnnnnnnnnnnnnnnnnnnnnnnnnnnnttccnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgctccnnnnnnnnnnnnnnnnnnnnncccggggggaaaagacccacgggttgnnnnnnnnnnnnnnnnnnnnngattatcctttt

SEQ ID NO: 7517 - DNA, 941 bp, Diabrotica virgifera
  misc_feature (331)..(362): n is a, c, g, or t
agacggagttcaaaacttttggctcaagaagttttggagtgttcatgaatgcttatcaacactaattaatcatgttatttctaatccgcaggatataccatcattcctaactcagggaaccacttatttaattccgaaggatcaaaataacacccaagatccagccaaataccgcccaattacttgtcttccaactttgtataaattggtcacatcctgtttagcccggcgtatctaccaagggttccatgggttgctaagaacaacttatcatcgactcagtcatttctaaccaggcatattccaaaaagaggaatccttttactgcctnnnnnnnnnnnnnnnnnnnnnnnnnnnnnnnnccgcatgaatggcttatagatatattgagaatatataaagtcgatgataatatagtgacctttttagagcatataatgacggagtggaagactagaattcaccttcaaatacctggtgaaagtaatatcgaaactgaaaatatcgcaatcagccggggcctgtttcaaggagattcgttgagtcctctgtggttctgtctagctatgaacccactacctcagctattgaactccacagatgcaggttttagcatcaaaaataacaacaatgtggtggtgaagcttaatcatttattttatatggatgatttgaaattaatggcttccactcgaaacgaactcgatgagatgctaaaaactgtagaaactttttctaatgatattagcatgcacttcggactagacaagtgccgtattttaaatatagtcagaggaaaagtacagcccggaggattcatatgcaaatggccagaacatcgtgagcatgagtgaaaacgatatgtatacatatcttggagtaatcaagcgcggagaattgaccctaaacaaatgaaaacagagataactactgagtttata

SEQ ID NO: 7518 - DNA, 407 bp, Diabrotica virgifera
  misc_feature (3)..(34): n is a, c, g, or t
  misc_feature (186)..(209): n is a, c, g, or t
  misc_feature (323)..(356): n is a, c, g, or t
tcnnnnnnnnnnnnnnnnnnnnnnnnnnnnnnnnggaactttatacttttattttcggaatttgaggcagggaaacggtagggaactttcattaagaaattttagtacgagcagaattagggaagggccggatctttaattggaaaaggaccaaatttataatggtattggttacagctcacggcnnnnnnnnnnnnnnnnnnnnnnnnttatacctattataattgggtgggttttggaaaattggacttggtacccttaataattgggtgctcccgatatagcatttccctcgaataaataatataagaattttgattagnnnnnnnnnnnnnnnnnnnnnnnnnnnnnnnnnnagatagtagatagaggggggtgggtaccggatggaacaggttacccggctc

SEQ ID NO: 7519 - DNA, 534 bp, Diabrotica virgifera
  misc_feature (10)..(57): n is a, c, g, or t
tcccccaggnnnnnnnnnnnnnnnnnnnnnnnnnnnnnnnnnnnnnnnnnnnnnnnnttctggttctaattcagctgatcgtctactccttataccttttcttgcaaatccaggtaggaatccaaaatttcttttacttctttcattgttttcttcttcatcgtcttctatctcaactgaacgtctatttctgataccttttcttgcgaaaccaggtaaaaagccaatatttcttttgcttctttcattggtttctgcttctgcgtcatctagctcagctgatagtctgcttcccatcccttttctagcaaaaccagttaggaagccaaaatcgcttttgcttatgagattattttcttcatcagtggagatggtagctgaagtacaacgggcgataccgggtggcgagcgaatgctcaaaaaaaaatttgccaagacaagcagatcctgcttaacatagttttgagtgaatttcctcagaggttgcagtgtccctaagttgaggctgggttacgaggtgactagcagaaagcc

SEQ ID NO: 7520 - DNA, 733 bp, Diabrotica virgifera
  misc_feature (2)..(545): n is a, c, g, or t
  misc_feature (547)..(578): n is a, c, g, or t
  misc_feature (587)..(664): n is a, c, g, or t
  misc_feature (670)..(687): n is a, c, g, or t
  misc_feature (689)..(727): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnngaaggnnnnnnnnnnnnnnnnnngnnnnnnnnnnnnnnnnnnnnnnnnnnnnnnnnnnnnnnnaaaagc

SEQ ID NO: 7521 - DNA, 617 bp, Diabrotica virgifera
ctatacgactctctatagaggagagatgggacgcctgcggggaccgggccggaatttccgcgggcgaccctcgttgtgcggccactgcgtccgaagccaaacaaacaaaatgtctgatatcgaggtagatgatgcacccccaggcccacatagtactatctggcgggtccatgtccgaaattcaaacactacaagaggttttgacaacatgcccttattcatgaaatgagtcctacatggtttgtatgacgctgttctagatttgtatgtaacattagccgcactttgagggatctctgaatctgtgacgagcctatgcaacaaaatatattctgagctctatgctcataacatcacattcctcataattatgtagataataacatcaacttcgtctaaagggcagggttaaggtacagtgataacatcggcatagcccaaacagtcgccggttgtccctgcgcaaacgtacggacattcttagtagactttcagcatctagatgttctgatggagtatcatctacaatgatagatagtgttacacatgatcaattatatggaatttagatctcatgggacaaaagactgaatatacgcccattatgacagtattca

SEQ ID NO: 7522 - DNA, 924 bp, Diabrotica virgifera
  misc_feature (306)..(324): n is a, c, g, or t
  misc_feature (906)..(906): n is a, c, g, or t
tacaattattgccaccgccatcaggagagtagctaaactcggataacttaaatagtgttgtgcggattgtgattttcgacatgggagataacgagaataacgattctcgaagaaaggtaaagaaagtaaggaaagcggaagatttagacgatttaaaacaggaattagacatcgactatcataagatctcaccagaagaactatatcaaaggtttcaaacacacccagaaaacggtcttagtcatgcaaaagcgaaagaaaatttggacagggacggacccaatgccctcacaccaccaaaaacannnnnnnnnnnnnnnnnnntctgtaaaaatctcttcgggggtttcgcactcttactttggattggtgcaatcctttgtttcatcgcctactccatacaggctagtactgtagaagaaccagcagatgataatctatatcttggcatcgtattagctgccgttgttatcgttacaggtatattttcttattatcaagaaagcaaaagttcaaaaattatggaatctttcaagaacatggtgccccagttcgcgaccgttcttagggaaggagaaaaattgacattacgagccgaagacttggtacttggagatgtcgtcgaagtgaaatttggcgaccgaatcccagccgacatcagaataatcgaatcaagaggtttcaaagtagataactcatctcttaccggagaatccgaacctcagagtagaagccctgatttcacacacgaaaatcccctggaaacaaagaatcttgcgttcttctctaccaatgccgtcgaaggtactgccaaaggagttgttattagttgtggagacaataccgtgatgggtcgtatcgctggtctagcttctggctgggacactggtgaaacacccatcgcanaagaaattcaccatttca

SEQ ID NO: 7523 - DNA, 1016 bp, Diabrotica virgifera
  misc_feature (284)..(305): n is a, c, g, or t
  misc_feature (846)..(846): n is a, c, g, or t
  misc_feature (909)..(909): n is a, c, g, or t
  misc_feature (912)..(912): n is a, c, g, or t
  misc_feature (918)..(918): n is a, c, g, or t
agcaaagagatgaaagtgttttcatttaatagatcatccttcgaaacccctttattccagttttcatgattctgttgcttttagttctcgagatatttctggtaggccagttatctgcctcgccctatataaactgactttagcacgtcttaagcttaagttctgttggtgcaactaggcattagtctcccatatttatcgtaattttttgtgtaaccaaatttaaaaatctcagaaataatcattatacgccaagtatgttaatcggtgcaagacaaaagtannnnnnnnnnnnnnnnnnnnnntgttgcagtagaatacctatatttttagggcatggcaggcattttccagaccacgggatggccaggtgtggtaaccgtcatgagcaactggtttggaaaaagtaaaagaggactgatctttggtttgtggaactcgcataccagtataggaaatattttaggaacgctgattgctgccaaatacgtggaaaaggattgggccttgtcctttattatgccaggcttgttcataggagtagctggttttatcatcttcctctttttggtagtcaatcctagtgatgttggctgtgctaccccagatcgatcagatattcgtccgaaaagaccacgacttttggatcctcaacaatcagtcaatgatgaaaccagttccgggattgactcagacgttgacgatactaatattattgtaggagaacaagaggtccaaagaagaataacagagcgaacgcagttattggctcgttcacactccgagcctgaagagcgggctattggattcgtcgatgctctccgtatacctggtggtattgaattntctttggcattgttctttttcaagctggtcagttatactttcctctattggcttccattatanttnaacgcnatcacttccatgagtgctgaagacagtgcagatttatcatactatttgacgtgggtggatcgttggagcataatcgctgggtatttactgataaaacg

SEQ ID NO: 7524 - DNA, 453 bp, Diabrotica virgifera
cttgtgaactgcaggacacatgaacatcgacatttcgaacgcacattgcggtcctcggatactcgttcccggaccactcctggctgagggtcgtatctatttcaaagactgctcggttttcttatataggaaaacgtcagagcgtgttggatgttatcgtgtccaacaggaaaaaactacaaatcagtcaaaatcacatgattagagaagccctaaacgtgcccagatatgtaccactgcggtacatataccgggacacagatcagagaaagatcctaaggaccatggatgaaaaagcgtatgacatcttcacgaacgcaagaaaccaccccagtaggtggctgagggaattaacggattatgacgaaaacgtcagaacgaagcatagacggcctaaacagcaaatacagggatacaggcaggtcccagcagaagaacatgatgtctgagatt

SEQ ID NO: 7525 - DNA, 987 bp, Diabrotica virgifera
  misc_feature (85)..(102): n is a, c, g, or t
  misc_feature (433)..(447): n is a, c, g, or t
  misc_feature (876)..(876): n is a, c, g, or t
  misc_feature (880)..(880): n is a, c, g, or t
  misc_feature (889)..(891): n is a, c, g, or t
  misc_feature (893)..(893): n is a, c, g, or t
actaagtaccccgaaacaaaaggtcaacagcacaaagttggagatgatcaagtaaaccaatccgaatattggaatagtagtgccnnnnnnnnnnnnnnnnnngaaaatacagaaaatgctactagcacaaataaagttccaggattcggatatagacatatacaaataggactattatttttaatgcttgccattggttacgccatgagagtaaatttatcggtaggcatcgttgcgatgactaatggaaccacaacagaaaatcctgatgtaccgtggtacgaatggaaaaataaaagtgtagttctttcttcgtttttctggggctacatttgtttgcaaatatttgctggacaacttggtcaaacttatggtactaaatggttagctttcgtttcaatggccgtcaattcaacagcttgtttcattatcnnnnnnnnnnnnnnntggctgggatcttctggagttatagcatgtcgtgtggtacaaggattatcacagggtttctttttcccttcggtgcataatattttgggaaaatgggccccattggaagagagagcgtttctttcgatgatagcttttgcaggaccatcattcggtacaattgtgtcactaattgctagcggagcaatagcatcttcttgggcagggtggccgtatgcattctacatatttggagggctgggttatgtttggatgctaccgtgggcattccttgcagcgaatacccctgccttacatccgaatatatccaaagcagaaaaagattatatagaaaatagtcttagtgttaagacgcaagtggttgcgcctacaccttggaaggatatatttacctccgtacctgtatgggctttttgtattactatgttntggncaaaattgnnngntactcgacactactgacagagataccaaactactttgagcatattatgcatttttgaatgaagtcgaacagtcttttatcagctgcacatatgc

SEQ ID NO: 7526 - DNA, 482 bp, Diabrotica virgifera
  misc_feature (298)..(321): n is a, c, g, or t
  misc_feature (458)..(480): n is a, c, g, or t
aaatattataaagaagagttagttttcaacagtgcaaacaatatgtggaatatcaatattaggatactttttttatttgttggatttgtaacaattgcactggcatcaagacaagatatattgaatagcatacgaaaacacatccacgaatgccaaaaagaaataaacgtatctgatgattttgtggccgaaataggatctaaaactgaatctgatccaaagaaagctggcgaatttgcctggtgcgtcaacattaagacaggtattcaaactttgacaggagaatttgtagacgatnnnnnnnnnnnnnnnnnnnnnnnncttgagatagatgaaagcactgtaaagataattctgtcgaagtgtaaactgaaaacaagcagcggaggaggagaagcagctttgttttacttccagtgcttaaatgatgttgtagattagtcgattagataaactannnnnnnnnnnnnnnnnnnnnnngt

SEQ ID NO: 7527 - DNA, 917 bp, Diabrotica virgifera
  misc_feature (52)..(866): n is a, c, g, or t
cgataacatcgtcgtcatacacctaaccttcaaaatattagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatccgcccttaactatgggagttccagttactctaatcgggtgatcag

SEQ ID NO: 7528 - DNA, 393 bp, Diabrotica virgifera
  misc_feature (63)..(85): n is a, c, g, or t
  misc_feature (102)..(120): n is a, c, g, or t
ccttgtccggttacatcccaagtagggttcctttaattctaagtctaatttcgaacagccgcnnnnnnnnnnnnnnnnnnnnnnnataagtgcggtacagcnnnnnnnnnnnnnnnnnnnttatgtcattggacacgtacatgatggacaatctactactactggatgatttagtatacaaatgtggtagatagtcgacaaacgtcccatcaaaatggtctaccacttaccacaaaaagtgcccaaaaagtagtacagataggcgaggcaacaccaaagacttaaagaagatcgagcagctgtctgcagcatcaacatgtagacgtgatgcaccgctaatgccccatgtagcacagagaggcgccctctcctgacaaaggaaatgccgatcgt

SEQ ID NO: 7529 - DNA, 329 bp, Diabrotica virgifera
  misc_feature (31)..(72): n is a, c, g, or t
cttttgagtcccgggggggaaaagccactgnnnnnnnnnnnnnnnnnnnnnnnnnnnnnnnnnnnnnnnnnntataagcaccccttttcttatgggtagccttggaattgacacaacaaacacccccgggcgattatacccccagaaacactcaaacccaaacgaacaacgagattaacgtgtgcccggatgaactccctcgggtcttactatcgcgagacgcagcacacattctccgcaaccaatcggtgcctcagcttgaacacctgggcagtatcatacacccaagatatttggataatctagcacattgaaacaatgactactga

SEQ ID NO: 7530 - DNA, 901 bp, Diabrotica virgifera
  misc_feature (105)..(124): n is a, c, g, or t
ctggcttcagcaatcaaccagagatcaacgaaccccatagtataagttccaataaagatgatattcaaaagtacgtcggaaactcaactcatccaaaagttctannnnnnnnnnnnnnnnnnnngattgattcagatcaatcgcaatttacaactccaaacaaccagatcccaggagaagatccatccataatcataccaatccgagatgaacccttgaaggaaatcaacggtggaatggctggtgatgacaggaaagaaggagcttcgtggactaaatcgccgttgttgagagatactttcaagtacctggtaacggatttctatccggagaaaatattgaaatcgctgtccagcggattcggttcttccaatcgaacgaaaaataacgagggagccaagtcttctgtggtgtacccccttatgatggaaggtgtttctttgcttttgaaccgtttcattgagaatgggagcagtgaaagtacaacagagaactcacagggggcgatcagaggtaggattgccaacattctgacagagtcaattggtgagttactccaaaacaagttcgcgaacagtggaatcgtgagtacagttgaaaataagaagtcttcagcagatggaaatactgaaggtattggagggataaacttggagactgtgaagagcttattaccgttgattcaaaaagctgagagcaatggagagttttcaaatttcatgtcaaagtttttgaaaaacccaccgggcgaacttggagacttgaacagcctcctgcagaactacagtccacaattgaatggcattttgagtaatcgaagagtcttggacgcattgcgaagcaagttcaagtcaatcgaatccattgaatttgacgaatatcatggagcaattcataccga

SEQ ID NO: 7531 - DNA, 947 bp, Diabrotica virgifera
  misc_feature (777)..(777): n is a, c, g, or t
  misc_feature (845)..(845): n is a, c, g, or t
  misc_feature (873)..(873): n is a, c, g, or t
  misc_feature (907)..(907): n is a, c, g, or t
caaaacataaattgaaacgaacgtcgatgtgtatatacattttgtatactgtatactatatactacacacatcggcgtacgtttcgctttctgttttgacgtaatttgattgaaggtgagtcgtgccgcatgggaggagttatagcggacggactatatgtgtcttgccttctccattttagtctggctatcctttcgatgacgtcagtcactttggttcttctcctgatctcgttctttattttgtcttgcaaaccatagatcgctccattcttctctgtttgttagccgaggtttttgttaaggtaagtgtttcttctcctttgtcaacacagggaggacgcattgatcaaatattcttctcttcatgcatttgggcagctcacttttaaaactttttctcagctttccttattctgcccaatcaagacagattcttcacttcagttcatggatctcattatccccgcccatcataatttcatattctaggtatttatatttatctaagagttctatttcttgcccacaaatactgatgttctggttgggtaccaaatttgttattatttttgctttcgagatgtttatatttaaacctacattttctgtagcctcaacaagtttctgtacccatctctcttgccatttctagatcctcaactattaggactatatcaacagccaaacgtaagttttttagatattctccatctatttttattccttttgtcagccaatccatatttttaaaaccatgttctggcatcgtattanaaagtttaggtgacattgtgtctccttttctaacccccggctctatataaataaaaaccttttattanttctttattcatcacattcttaactatnagcaatatatgggcaacgctgtgggaaaatgacnacgtcaaatgagatgacgtggaatgtattttactatgaaa

SEQ ID NO: 7532 - DNA, 223 bp, Diabrotica virgifera
ttatatcgatgtaaagaccgtgttcaacgatgaggaagaaagcggcagagacacatctatccatcggaagatgagcctaatatacggggctgaaccactacggctatacagcagaagactggctgtccacccaatgcgagatggcgacggtactcataactcaaatgagttacaacaaggaagtaagacacccatgtgaatgacgggaggattgatgggaact

SEQ ID NO: 7533 - DNA, 388 bp, Diabrotica virgifera
ccgggggccccccccgccgcccgcgagggactagatacagctagagttcctcacatgagtagactgatgatccggcggttattcccagacagaaacagatactattggttcacatgatctagccgtcaagagacataaccgaactgaaaacatgacacatcaccgattctccggactggcatatgaccgatccctagaaagttttcatatcttttcgaccagctgaagataaacgaacgagcatattctgagcgaaatctattcctgatctgggctcacggctaaataccctcagactggctatgttactagtttaagtacgagatacagtagacactgtacatctaccaattgctgccacagcttgataaacgagagattatcattg

SEQ ID NO: 7534 - DNA, 957 bp, Diabrotica virgifera
  misc_feature (26)..(48): n is a, c, g, or t
  misc_feature (492)..(509): n is a, c, g, or t
  misc_feature (923)..(923): n is a, c, g, or t
agcattacaagtacgtgtaaaatacnnnnnnnnnnnnnnnnnnnnnnngtttaatatgaaccgccgttccgagtgaaatcttcgtcggcgagcgtaagtgtgttgtgctgttttctccactctttcttttggtttggttcagttacactttgataatgccaccaggaatcatagctattcgagttttattttggatggttataaaatctgtaaacgttttgtatattccggtcctgataaaaagaatattcaggaaatcaagagcttgtcctccagtcaaaaatgaaatcctcctcctctctgcttcagaactagctgagagaattagacaacaaaaggtaacatgtgaaagcgttattaaggcttacatagcgcgtatacagcaagtgaatccattcatcaatgcagttatagaagatagataccaggcagcaatcgatgaagccaaaaggatagatcagtatctctcgagtagttctagaaatctggatnnnnnnnnnnnnnnnnnnccactacttggtgttcctatatcgataaaaggtagtatcgaggtagccaaaatgaagagtacagcgggaatggtaaccagagccaacgtcatagctgattatgatgcagttaccgtaaaatatgccagagaagccggagccatactgttggtaacgacgaacattccagagttatgcctaaattgggaatcgaccaataaacttgtaggaacgacaaagaatccctacgatacgtctaggacttgtggaggatcatctggaggtgaggctagccttctggccactgccggatctattataggcattggatctgacatagctggatcgctaagacttcccgcacacttttgtggcgtttggggccataagccgactccggggacggtctctagtggtggtcattatcccagctgntagcatgaggacgtatggaaagctgcctttacct

SEQ ID NO: 7535 - DNA, 897 bp, Diabrotica virgifera
  misc_feature (779)..(796): n is a, c, g, or t
  misc_feature (804)..(804): n is a, c, g, or t
  misc_feature (824)..(853): n is a, c, g, or t
gaaacaatgatctagatagatactggttagatattatattatgccttattggtgaagcttttgaaaattctgaagaaatatgtggagcagttgttaatataaggcaaaagggagacaaaatagctgtttggaccgctgatgcccagaacagtcacgcagttctagagattggaagtaaattaaaggaaaggcttcatataccttctagagttacattgggttaccagttacataaagatacgattcagaagactggatccgtctcaaaatattcatatactgtataatactgcagggaattttagatatcacggataagcaatagaaaattcagatgcaaccaatctaatggcacatacttttattgttatacatctaacgtttttaaacttaacttatatatcatacaacatttcacattcttgattcaaaggtggtataaatgttaagtttatcattgcatgcttaacttttacttaaaaatagtaacacattgattgttgttacaaagctacaaaagtagttccagtatttatttttttctgccataacagacaacataatataaacatttatatcactttttgttttctcttttgctggttgatccatgggaatttgcttattactaacgttgcatctggacgattttttggaaatctgtgttgtcaacttaattaatcagttaatgttaacattcatagttaatttgaaattgtatcttctagtactcaataataatttttagtttgaatgacttttttattgttacagaaatnnnnnnnnnnnnnnnnnntgaatganattctacgtatttgtttagnnnnnnnnnnnnnnnnnnnnnnnnnnnnnntagcaaaaaggtacatatttatgcttttctgtatttatatgaat

SEQ ID NO: 7536 - DNA, 941 bp, Diabrotica virgifera
  misc_feature (15)..(893): n is a, c, g, or t
acgatcccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaccacgaaagcttaaagatgtcaggcacttctttaagagcgtttt

SEQ ID NO: 7537 - DNA, 583 bp, Diabrotica virgifera
  misc_feature (83)..(102): n is a, c, g, or t
gtgaaaacaaaatagtaaatcgtcagcttgagtgtggtggattatcttatgtcagatatatgaaatttgttgcgtggacggtnnnnnnnnnnnnnnnnnnnncagtatattacttggcttctacagttatttgatatagccacctttggttgtttgaatacaaaaaacaaggtgtaacaggtgctatgttgccgcactgcattggttgtcttgctaatgtctatttcgtagaaaagttctaacagtgttaatctgttaactccgttctcaggtcttctgctcaaactgtctgaccatactttaattactagatattgtgaatgagaatattcctgcaatttttaatttttagcaatatgtattagttttacgatttttaaaacatttgtttgtgtcttctgcataaattcaaaaatgaagtataggttaacgctctaacgtgataaaatgtttttcattcttaaattaattaactggacctaatgaaaacaagaaatattacaagatcacataccagacttctggtagagtgttggtacgattctgtcatcgactgcaggcagtagaaggcaactgcactcga

SEQ ID NO: 7538 - DNA, 997 bp, Diabrotica virgifera
  misc_feature (65)..(97): n is a, c, g, or t
  misc_feature (355)..(369): n is a, c, g, or t
tggatgaagaagtacgcgccgcagcaggccatgggcatgaccttctcggaatccggtccggtgcnnnnnnnnnnnnnnnnnnnnnnnnnnnnnnnnnggtacacggccttcaccgccgacatgaccaagaagggcctgccggtggtcaacgaggacggcacgcccaagtggcgcatggcgccgtcgccgtatggtccgtactggaaggacggcatgcagaacggctaccaggacgtgggttcgtggaccttcttcaagtccaccaaccccgacaagatggccgccgcctggctctacgcccagttcgtcacggccaagacggtgtcgctgaagaagtcgatcaccggcctgaccnnnnnnnnnnnnnnngacatccacagcgactacttcagcaagaacgcggccaactacggcggcctgatcgagttctaccgcagcccggcgcgggtggcctggacgccgaccggcaacaacgtgcccgactatcccaagctggcgcagctgtggtggaagaacgtcgccaccgccgtcaccggcgagaagacgccgcaggccgcgatggacaacctggccaacgaaatggaccaggtgatggcgcggctggagcgggccggcatggcgcaatgcgcgcccaagctgaacgccaagggcgatccgaacaagtggctgtcggatcagcacgcgccgtggaagaagctgggcaatgaaaagcccaagggcgaaacggtggcgtacgagcagctgctggaggcctgggaaggcggggaaggtgcggtaattctgtgaggcgaacagagggcagcgtcttcggcgttgccctctgttatgaggatggaaattccgagcctattttgcttgatgtgtcctgtgagcccgtgagggcagcagccgagagtgtgtcacggtaattaagtccgagtgagcggaaaagtatggagggcacgcgagtcaaccatctcagtaaagttgagtcggtcttcgcgatattgcgccattg

SEQ ID NO: 7539 - DNA, 706 bp, Diabrotica virgifera
gccatgttgaggttatatctgattgtgtaacgatgatatttaaagaaaaatgctaatacagattgatatttggaatttacatacttctgtacggcaccaatgtgacgcataatttcataattttgtggcttcacggaaagtacctactcaaataggaaaccttctggctctaactggcgatacaactttaacatggtcttcaccaattttaacgaaactggattcaaacgatacagatataaatccattgggaaggaagataacattagatgaaatatcatggatcggatctttgcagtatataggcgcaatggtaggaattctgcccttcgccgttttagctgatgtaataggaagaaaacctgtactgctcttattggccgtaccgcacattatatcgtttctttcttttgcttttgcaaaaaccatcggttggtattatgtggggcgcttcttggggggagtttccttgtcttcggtgtacatcatattgccgatgtacgttgctgaaattgcagaagattcctataggggaatgttactaatgtcctacagcacatttgctagtttaggtgacttaattccgtacgtattaggcccttacgtatctgttttatggtttaatatcattttggctgtttttcccatatcgttcttggttatatttttgataatagcccctgaaagtccatattactacgttaac

SEQ ID NO: 7540 - DNA, 857 bp, Diabrotica virgifera
gaactggaagccttttgttttaaaggactgaaagctcttacgtatcttaatctaaacaaaaaccagttttctgttttaaaaaatgatacttttgcaggacttgtaaatctagaaacgttagacgtaagcctgaatcaattaactaccatagactcgaatgcttttcgaagtttaggtgctctaaaagagctgaatttaaaaaacaacaggttacaaaatcttacagtgaacatcttcaatactttggtcaaccttgaaagactgaatttacaaaagaatgaaataagcagattagagagaggtcttttcgatgggctcaaaaatcttttggagttaaacctggcggaaactcatttaaccattatggacgttggagtctttcatcaactcaataatttaaaagtattaaacctgagcaaaaacagtatgggttcggttaaaccaccacgcaattcttttgagataggtatattttcaaacttagcaaacctggaaattttggatttgtcttttaacttgatctctagcttgagcgttaaaaatatgttcatgtctttaagaaatttaaaggaactgttgttagatcataacggtttgaagtatgtagattttggcggacttttaaacaattgcaagaaactttcttatataggtatatcgtttaatacgtggaaatgtgagtatttagctgatattaccgaaaaattgtttaactctagcataagttatcatcctaagacacctatttataatcaggataatattgaaggcatatattgtactgatgtttgtaaatttgtatattgtgaaggcagtgaaggaagtgaactagaaattcaataaatgtatcggaatgt

SEQ ID NO: 7541 - DNA, 933 bp, Diabrotica virgifera
  misc_feature (2)..(22): n is a, c, g, or t
  misc_feature (264)..(282): n is a, c, g, or t
  misc_feature (464)..(493): n is a, c, g, or t
  misc_feature (676)..(700): n is a, c, g, or t
  misc_feature (795)..(795): n is a, c, g, or t
  misc_feature (896)..(896): n is a, c, g, or t
cnnnnnnnnnnnnnnnnnnnnncccgcctaaaataaaacgagggaaataaagctcttcacgtttcactttcacttttcgttgtgagaaatgtgagaagctcgatattagaggttatgctcatcgattataaaaatcgattatttttaaattacagttaaactattctacttattttaaattagtattacatattttctttttgtttttaaatttcttctgctattacctaattggtcttactaaaaatctatttcaataccagnnnnnnnnnnnnnnnnnnncctatcgaaacgtatctattattcgataaatcgattaatttagttttcgaaccaactatgttaaagtgttaatcacgtatcgtggtcacgtgatagtatttaaaggaggagaaaggcttggtagtacgtcatcaccgcgcgcgatttgaaaattagactcgacatcattttagctgtgatannnnnnnnnnnnnnnnnnnnnnnnnnnnnngcttcaaatcaaggttggattgaaatagttatgctaaatgattttaaaagcgaaatcataaactttttgtttaaatattggtattatttacattactttacgtggaatacatcaaatttttcgacgtccataaaatacagggagtaaaattcaagcgatacgtatttaaccaacaccgttgtnnnnnnnnnnnnnnnnnnnnnnnnntcaaaatttaaccaaaggaagttatttctgtttcgtgattattacgtgaaataaacgtacctttgcgatgtaaccgacattcacacctatgatanaaaacatgtacaatattcgtcattatgattttatattattctaatgtcaaacaaagtataaggaagcaaaaatatattgggtgaatgatttggcactgaantacgtttttttcccgtcatgcagctgaccgactgtag

SEQ ID NO: 7542 - DNA, 549 bp, Diabrotica virgifera
cggggcgccccccttttccgcgcccaccagaatcttctttttaatgtgcctacgcctcaaaaaaatacatctgacaatatgacgttagttgcgtcatgtaaataacctcatggagagttactcaactcataaaccttttattcgcccaattaacactcaagaactcatatacgacaatgtagtaggtctccataattagacatatctcgtcacaccttatgcccaataacaggatgtaaatgctcatatcataccaaaatattttatagagaatctatactgatacactataccgccgcaatcgataaagtcacacacaaccgagccagtgactacagatacatacaaacttcaaatccacacagaagattgttatcatgccaatgtatgtccacctatgcgcattggcactggaccaaatcatatttcatatttgtggaggcccgtaatacgttttaacttcacctggcagaaaatgcccccttggagcacaaacaccacatgcactataacgacttacatggatctattatttaaaggtagcgacct

SEQ ID NO: 7543 - DNA, 914 bp, Diabrotica virgifera
  misc_feature (32)..(63): n is a, c, g, or t
  misc_feature (800)..(800): n is a, c, g, or t
  misc_feature (846)..(898): n is a, c, g, or t
ttaattttctgtaaaaatattttagctacaannnnnnnnnnnnnnnnnnnnnnnnnnnnnnnnaccgattttgtaagtctaataagaatttgtacagtatttttggttcgtggtatgcggaaatattgggatgtatagttttctttgtttgctattttagacttgtctctggatagttatagaataaaagaatcaacagtaataataatgaagacaattattagcatactcctgtttgcagtagtactagctttatcatcctcagagaaaatagtaaataaggatgactgtcattgccatgagggctttctagcaaagacaactcctgacaaaggatataagtgttttggcgttcttctaaaacttataacaaattgtaataccataaaaagaccaagatgcgtttgcacagaagcaacaggaattctatcagatgaaagtggtacccattgtgttgagtacagaagtggcagagaaatccaaaagtggaattgtgaaaaccaggcagattgggagaagttttttaccgaatatcctggtgaacgatttgtcaaattgtaaataatcgatattttataaggtttaaataatatatacgggtgtccagaaactctaccgacggacgaagataggagattcctcagataattttaagacaatttaatcaaattcacctagtccgaaaatgcttcctaagggagctggaactctttgaagatggcgccatgtaattagtttttcttaaatatctccggaacgcttctagttagaagggcaaaggttggtacgcctatttattntttcggggataaatcgattcatctatacgatatgttaccggcgccnnnnnnnnnnnnnnnnnnnnnnnnnnnnnnnnnnnnnnnnnnnnnnnnnnnnnccacatattttttttt

SEQ ID NO: 7544 - DNA, 829 bp, Diabrotica virgifera
  misc_feature (322)..(568): n is a, c, g, or t
  misc_feature (673)..(720): n is a, c, g, or t
  misc_feature (743)..(761): n is a, c, g, or t
  misc_feature (772)..(790): n is a, c, g, or t
gtaaaacttaatttttaactgtaaagaataatcctaaaaaaaatgggtttctcagacgattccaaacaaagactcgctactgtcattgatctagctaaaactgtttttcattatggttttattcctactgttttatacttaggtttcaagaaaggggcagatccaggcatgccagaatttagtgtagctaatattttctggtagaaaattatcataatcttcaggagaaatatgtgatttattagaagtaacaaatcttacctagagatagaaaatatttatggattataatgaaagatacatcaaataaagcatttagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccccaaaaaatattttccgggggcggtttttaaaaacggggggggggaaaaaacgggggggcccccaaatttttctcctgggaaaaacccccccttttcccnnnnnnnnnnnnnnnnnnnnnnnnnnnnnnnnnnnnnnnnnnnnnnnntttgccccccctaaaagggaaannnnnnnnnnnnnnnnnnngcataataaannnnnnnnnnnnnnnnnnnttaccgggggggaaatttattttttggggggccccaaaa

SEQ ID NO: 7545 - DNA, 253 bp, Diabrotica virgifera
ccgggacccccccccgcgcccctccatgatgatcgacagccaaattgattaggaggcccaatgtacgtcattcttcatatgctgtttttggcggtgttagtcattggctggagtgaaactgtaatcattaaggtcacagctgttgaccgcagacacatgctttcgtgggcaacagctgcagaagtcgttggtacgagacttttcaaaacatgacttgacaacacgtactgtgaaagatttttattacaatgtg

SEQ ID NO: 7546 - DNA, 895 bp, Diabrotica virgifera
  misc_feature (333)..(358): n is a, c, g, or t
  misc_feature (871)..(872): n is a, c, g, or t
taaatattagtcgaagctatatcgataaattttcacgaaatgaattcgacaaaggcaaaattagtgaagaacgattacaagatgttttaaataattccaaaaaccttaaagtcaaaatggatggtgaatttactgcaaaaatatcttgccctttatgtacatttatttcttcagcctattcagtgaagaactccaaaaccggaagaaaatgggtgatttcaaacttcctgagacattataaaatacattttaaagatgatggaaccaacttaactaaaaaattaccgattaaaccgcagaaacccgaaattcagaccactatacttaactttnnnnnnnnnnnnnnnnnnnnnnnnnngacttaaaccaagattttgaagatccaagaggaaatctctttgacctaaccgatcccaatacagatttaaattatggagcttcgacatcatctggattgcacttggaattgactactgaattgagtcaaaatgattcgttcattgaccaaaattacgaaattcatgatgaggcacagcaaaataatcctaatggggtttttttacactataacacagacctcgacacagactctccaacagataatcaatcgtcgagtcaactaagaacaattgttgttaatgatttttctactgaggaacatcaaggagccagccaagttgtaaatgatatcccagtatctgaattagagtataatccagacaattcatctccattggaagattttttctttcttgacaatgtagcggaaatcaatcaaagcaataatggttctgaaaaagtaaagtctcccaaagctaaatctttatttgatgatagcaattccagaagagaaagaagcttgcgcatattnnaatgagtaccatatcatcaaaca

SEQ ID NO: 7547 - DNA, 184 bp, Diabrotica virgifera
acttcaccggtcaaaaacggggcacatgtgctttgttaacaatttttacagaaaactaactatctaataataaaaataacagtaaacttaaatcgcaatgagatcttccagactcataacatgataagcggtcggtgatagaagatgcaagcaccagtccatatagtcggtggggccaaccaag

SEQ ID NO: 7548 - DNA, 257 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(241): n is a, c, g, or t
  misc_feature (243)..(245): n is a, c, g, or t
  misc_feature (248)..(252): n is a, c, g, or t
  misc_feature (254)..(256): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattancnnnaannnnncnnna

SEQ ID NO: 7549 - DNA, 745 bp, Diabrotica virgifera
  misc_feature (165)..(177): n is a, c, g, or t
  misc_feature (179)..(194): n is a, c, g, or t
  misc_feature (459)..(492): n is a, c, g, or t
gtgttttggttgttctgtttgacaacaaaattcttataaatttaaaattggatcaaatacaaaattatctgaagatgtctgtgagacctgatgaccatcgtcgaaaatgggacaaagatgagtatgaaaaactagcagaagagagaataaaggaagagaaatacnnnnnnnnnnnnncnnnnnnnnnnnnnnnnggaattcccgtaaaaagagaactcctaaaaatccgtgactacaaagtagatctcgactctaaattaggaaaaagcattgttataaacaaaaatactcctacatcacagtctggtggatactactgtaatgtctgtgattgcgtggttaaagattctatcaactttctggaccatatcaatggtaagaaacatcaaaggaatctgggtatgtccatgaaagtggaaagaagtagtttagattcggttaggaaaagatttgaagcgnnnnnnnnnnnnnnnnnnnnnnnnnnnnnnnnnnatgatatggcgtctaggctacaagaactggcagaagaggaagaaaagttgaaagagtacaggaaggagaaaaggagagagaaaagaaaaattgaagaggatgctgaagaagaaccacaaagtgaattagctagtataatgggattttctgggtttggttcgtctaaaaagaaataagggactagttaattgttaaatttttttagtgtcacttttcttctcccagatataaatattgttttactgcttgattc

SEQ ID NO: 7550 - DNA, 960 bp, Diabrotica virgifera
  misc_feature (10)..(28): n is a, c, g, or t
  misc_feature (944)..(944): n is a, c, g, or t
aaagcagtcnnnnnnnnnnnnnnnnnnnaggtaaataaaatttgatattggaaaatatacataataaaacaaaatatctttaccaaaaagttgaacaagatgctgtatttggaagattatttagagatgatagagcatttacctcaggaattaagagatagatttacagacatgagagaaatggatctaactattcacaataacatggacgaactcgaaaaaagggttaaaaattttttcagtgattgtaaaaggtgccctaatgatttacctcagtcagttgaagcagaatttcaaggtatcagaaaggaatattataaaactttggaagaggcagatgaaaaggttcacctagcaagccagatgtacgacttagtcgataagtatttaaggagattggattctgagctacacaaatttaaatgtgagttggaagcagataacaagggtataaccgaggttttggagaaaagatcattagaattagatacaccaaatacaactccaaatatttcatcgcttcagcaaaaagaaaatcgctacgacagtgcatttagatattctagaccaagagctgaaaagcgaagggacagtagtgtttcaatacctgctcaattgacagaaaaacgccaagctgtcacgccggtggcgcctcctcctttaatagaaacaagacacgctaccacttccgttcaaccaattgccccttcctctgctaccactacaaccatgtcctataatctcgggcataatttgggagctggacctgcaatcgcagctgctgcttcccaagcaatcgctgcaacccaacagatgcaacaaggtagaagaactgctagcctaaaggcatcttacgaagctattaataccggcgtgcatggtcatgaatttggtattgggagagaattggcaggtgctgcgcagactgcccatccagctatccnacaggatcatgcgaat

SEQ ID NO: 7551 - DNA, 768 bp, Diabrotica virgifera
tgtccattcattaaaagaaattttcctagagattatggcttcttttaaattcctgttgttcctaggcattgtggggtattgctgtgctgcacctgcggtgaattgggatgaagtgagtagaaaaatcaatgaaatagggaacaaggttcaaactgcggcaagaggtgcatgtggatttattaactcaatacccggaggccaaccctctccatttaacccccaagggtttaatacaggatttagaggatttcaaccatcttactttccacagtccccaggatttgcagcaggtagaggttttccacaatttcctgcaggtagaggcttcccacaatcaccaggatttccatcctactatcctccatcatattacccgaatcggtttcctggtcgagctccaaactctcctccagcttctcctcaaactccaaactccgttcctccttcaagctcgggtggaattagaccaaatggaatgccaccagtaccaaataccagctaccttacctccatctcttcttccctcaacagtggctcctccagacactcaaacatcttttgaacaaaatgacttaaacgtcggtaatgtcggtaatgaagttccagcatttatacctccttctactgatgataatgatgttacagggaaccttatcactagcagacgcttaagaaatgcctttagtaataaatatgttaactggagaaaataaattttgtttaattttattgtatggttctatgtaatagttatgttcgttttggaac

SEQ ID NO: 7552 - DNA, 894 bp, Diabrotica virgifera
  misc_feature (370)..(411): n is a, c, g, or t
  misc_feature (794)..(794): n is a, c, g, or t
  misc_feature (807)..(827): n is a, c, g, or t
  misc_feature (848)..(848): n is a, c, g, or t
attcttttcatacatggcaggaagtgtaggtactgtgcaggctattaaattgtgttaaacagacgtttctggctattaccagaggcgtgcgacgggggaaggtgaatggttgaccctttccagattctgcgcctggcggaattgctgttttagttcaatttttggattctccattgctttctatgagagtgatatactcttcattcgtaacgatggagtcattagttttcgagatcttatgaaacgacacggttattttgattaatgtagggccggtactttatctcccggttaaacctcggttggctaaccggggtttaatcgggacagaaaagtacctcatagggcctcttgcgttgtaataaaagcnnnnnnnnnnnnnnnnnnnnnnnnnnnnnnnnnnnnnnnnnngtataattgcgtttatgtctatgttatgcatatatttctgtcccgattaaaccccggttaactaaccggctgttaacggagacgtaaagtaccgggccttagtgtgtcgtttcatttttaatttcaaatatctcgaaaactaatcattttggcgttgcgaatggagagtatattgtttgcatagaaaatagtggaaaatcggaaaatttcactaaagtagccatttcgtcagtggcgtggaatttggaaggggtcaaccagccactaccccctgtcgtgcgcctctggtagtagctaggaacgtttgtttgtcttaatttggtagggtgtgctgtgcctacattttctgtcaggtatgattaggatactccaaatagttttanagtactgagtacnnnnnnnnnnnnnnnnnnnnncatatgaatcatatatcatanattatcaaaataactgtgcccgttcatatttaacttcaaatatctc

SEQ ID NO: 7553 - DNA, 958 bp, Diabrotica virgifera
  misc_feature (231)..(249): n is a, c, g, or t
  misc_feature (861)..(861): n is a, c, g, or t
  misc_feature (902)..(902): n is a, c, g, or t
tttttatttatttacaggccagactaagttataccaggaaaagggctcaggccataacattattctgtacatataaaaacttaagcaagtgtgtccttttgggagacacaacagatcgaacacaacgagccatgtgtatcttttttggtacacagcgttgaggacagtgtgtatctaaaaggatacaccggcgctgaggatgctaagctttctttattagacttatggaannnnnnnnnnnnnnnnnnncatatatcgctggtacctatgattaatgtgattcctaatacatttccagtgaaaataataactctttgataagtgttggcgatacaagtttttttatgtgcctgtccgcgaagattataactcccaaaataattataacgaaaagatttagttcataatagatgccgacgaaaacaattatttccctttctgtttctgtttctgccgacgaaaacaattatttcatagttacattaaattttgtgggagtattcaaaacaaaagttttcattgttttatttctagataaataatgtataaaaataaaagagttgatatattatatgcataatatcaattattgcaagttagtgaatcaaaataatctattttcagtagtaaattattattacaaaatcgtgacatccaaaaaggatttagattacctctagtattttcagtttaacctggcagctctatatttgttagtatttcaaaaacggaaaaaaaacactactgcttgttgattatactgtttaaaggaagcttttataaaataatgagcatattttatgtcaataattgtaaagatatatattaatttgtaatataatttttaactaataatacatncaaattattagtctatagggagatgtatgccatttttattntaactgatttgtttataatttgttttatttgggaagcaagaaaagcctaacgcatt

SEQ ID NO: 7554 - DNA, 262 bp, Diabrotica virgifera
  misc_feature (16)..(43): n is a, c, g, or t
  misc_feature (70)..(107): n is a, c, g, or t
  misc_feature (127)..(140): n is a, c, g, or t
  misc_feature (143)..(165): n is a, c, g, or t
  misc_feature (173)..(195): n is a, c, g, or t
  misc_feature (225)..(256): n is a, c, g, or t
ccttttccgcgcgagnnnnnnnnnnnnnnnnnnnnnnnnnnnnccaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7555 - DNA, 966 bp, Diabrotica virgifera
  misc_feature (38)..(963): n is a, c, g, or t
cttttaaccggtagtgtacaaaaaacatattcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntca

SEQ ID NO: 7556 - DNA, 860 bp, Diabrotica virgifera
  misc_feature (481)..(513): n is a, c, g, or t
cttttgtaacgttttaaaactgcttgctgcaggtggaatcaatgtaggtgggacatggcagagaaataagttccaaaaattaaggataagtaagacagaaaaactaagctcaattttaattgaaaacgtgacacggtcaaaacctgtcaaagaaacaattgttggtgtaaaaggtaaagtaaaacatggattgaatttcagtttcttcaaatttgatctatacatagctataccacaatggtcacttccttcaaggatattttcaaaattttgtacaatgcaaattataattgcgttgaattattcatttcacaataaatttgtaggatgtattgttaacttaatagattttttgacacaggataaatataattgatcggagcagcctatcataaatctttgataacattgtagatattattcaagtgtgtgttcaattctaaagcttttaaccataaataatccgcaaaaatgttatcannnnnnnnnnnnnnnnnnnnnnnnnnnnnnnnntgctaatataaaatgctataacaatcaagaaagtacatgtcttgagtgtttttgctaaacttttagagtacagacttaaatatcaaattacatacatcgtttctgttacagaaacaggtgaagaaagttaaaatgtgctatttaacttcaactctaataactaaactataccgtgtgtcaacttgaacgggcaccaccatccatctataatttggtctctacagaaaatccaaaaacatgcaaaacacgtcaaattcacttgcgatggggatatatagatatatttaaagaggtggcattctggcctattccactgcgaccttttcagatctattgtggtcctctag

SEQ ID NO: 7557 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7558 - DNA, 643 bp, Diabrotica virgifera
ggcggggtgaagtctttaaaggtgagttaggagggggaggaagaggaagaagagcctttataaatagtatattatggaagagtgatgttgaggagaatgtaatgttgggtaattgaaagaatatggaatggaaatttatgatagtgagagtttgtgaagaaggtgttaattgggagtgtggattaatgaaaattgaaaaaggtaagaaaagttaatgaaaaatagaaggagtggtagaatatgtgttgaagataaggatgtgagtaggtattggtaggaagatattgaagtggaagtgcgatatagagaggtgagttgtttggtgtattctattattgttgatgggtagtgaggtttggaatgttatggttgtatttattatatatttggtgaattatgatgtgtgttatgtggagttatgagaaaggttgtgatattaccatggtgtgatggaaggagtaatgatttgttgttaaagaagaggtggggagagataagtgatgagtaatatgataaggaggaatagtaggtgattttggggagtatttgaaaatgatgatatgggttgatgtattatttgtgggtggtaattttgaaggatagtgtgggtgtgatggagagagggtttagggtaaaaagattt

SEQ ID NO: 7559 - DNA, 155 bp, Diabrotica virgifera
  misc_feature (54)..(72): n is a, c, g, or t
caatttattgaaaatttgataattggagggacttcacaaacttatatttaatgnnnnnnnnnnnnnnnnnnncttaaattaacatgaaaataaatctttaaaaaccaatttaaacgtgaaaatgtgacgtaaaatgtcacgatggtacggatgac

SEQ ID NO: 7560 - DNA, 1012 bp, Diabrotica virgifera
  misc_feature (461)..(481): n is a, c, g, or t
  misc_feature (584)..(604): n is a, c, g, or t
  misc_feature (822)..(823): n is a, c, g, or t
  misc_feature (836)..(836): n is a, c, g, or t
  misc_feature (908)..(908): n is a, c, g, or t
  misc_feature (936)..(936): n is a, c, g, or t
  misc_feature (948)..(948): n is a, c, g, or t
gccaatcaaaccgcctaattcccacttcatcaaaatgttctttgacaactctggcaatatggggttctagcattatcttacatgaaaatgtcatattcgcctaagtcatgagaagcataacttgatgatctaaaacttctgttacatatctgttggccgtaaaggagatattttgtatgaagactaactgtgcgtgcttgtaaagtaattcctgtccagaccataaccgacccaccgccaaatgggagtcgctcatcaaaacaagccgcggcatatctttctccaggtcttctccatactcgacgacgtccgtctgacccatttagacaaaaatacgattcatctgaaaacagaacgttgttccaatttacattattccaatggaggtaggtttaacaaaatttaatcttgatattctatgccggcgttgtaatggtgggcctgtagccatcttataaacnnnnnnnnnnnnnnnnnnnnncttttgagaaaactaactagcagatttaatatgttcatatcagtggtacagacaacctgtagatatggtaaggtggtaaataattcttttgaataagtgattnnnnnnnnnnnnnnnnnnnnnagttataattattgcaattaaaaaatatatgatttaagtctccgaaagacccacagctacataatgaattttgtgttatacctaatttggataagtgagcaggaaatttgtccatttaacagttctcaactattgaagttgatttcgtaagaaaaccgcagatgctcttttattttgcaaacttgaggactcggttcattgagtttgaccattaacannagacatgtgtaanatttcattaattaaatatacatttcattgggtttttcattatgaaaaaagtgaatatcaattgtcttactanatgatttctttgtagaatgacatgaccnatgtattattgnttatatccccaaacccccaacttgtacgttttaaaaaacaataataaaaacctggttattattg

SEQ ID NO: 7561 - DNA, 151 bp, Diabrotica virgifera
  misc_feature (18)..(42): n is a, c, g, or t
  misc_feature (50)..(50): n is a, c, g, or t
  misc_feature (75)..(75): n is a, c, g, or t
gagattattatagagatnnnnnnnnnnnnnnnnnnnnnnnnncaagatgnaacctattggtttgtgtttgatgantatagcagcatctaaagctatttccacaaacagattaaccaatgatgatgcccacttgggagattttcatggatcg

SEQ ID NO: 7562 - DNA, 774 bp, Diabrotica virgifera
  misc_feature (16)..(38): n is a, c, g, or t
  misc_feature (264)..(284): n is a, c, g, or t
  misc_feature (363)..(382): n is a, c, g, or t
  misc_feature (447)..(495): n is a, c, g, or t
  misc_feature (635)..(655): n is a, c, g, or t
  misc_feature (670)..(670): n is a, c, g, or t
  misc_feature (741)..(741): n is a, c, g, or t
ctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttntcaacgaaaaagattaagacctttaagaataacttctttcattgaatgactacaatttaaccctccagctngacacagatattctgattgccaatattatcatc

SEQ ID NO: 7563 - DNA, 958 bp, Diabrotica virgifera
  misc_feature (694)..(716): n is a, c, g, or t
  misc_feature (781)..(781): n is a, c, g, or t
  misc_feature (866)..(866): n is a, c, g, or t
  misc_feature (916)..(917): n is a, c, g, or t
ggcttcgaaaaaggttgaagtaaaatatacaaaactattcattaacaaccaatttgttgattccgtcagcaagaaaacattcgaagttctaaacccaagcaccggaaaacccataaccaatgttgcggaaggggacaaagaagacatcgacaaagctgtacgtgccgcaaaagctgcatttgcaagaggcgcgccatggagatccatggatgcttctagtaggggagccatcattaacaagtttgcagatcttgtagaacaacatctagatgaaatatcagaactggaggtgcttgaaaatggaaaaactttggaatttgctaaaatgtgtatccaatttgctgtatcatgctatcggtattatgctggtttctgcgataaagtatatggacaaactattccagcggacggtccaattatgtgtatgactcgcaaagaacctataggagtcgtaggacaaatcatcccatggaacttccctgctctgatgcttacttggaagtggggccctgcactggcagctggttgtacgttggtcttgaaaccagcagagcagacccctctcactgcattgtatatggctgctctaactaaagaagccggttttccagatggagttattaacgtagttaatgggttcggtcctactgccggagcttcgttggctttacacaaggatgttaggaagattgcnnnnnnnnnnnnnnnnnnnnnnngacacctcataatggaatatgctgcaaaatcaaacttaaaaaaagtgtcattggagcttggaggncaaagtcctttagtagtttttgatgattatgatgttgatgaagctgtcaaaattgctggcaatgcaatcttcggcaaccatggcncaagttgttgtgctggttctagaacatacgtgcaatctgggatatatganntaatttgtgaagaaagctgccgaatatgctaaaacattaca

SEQ ID NO: 7564 - DNA, 1021 bp, Diabrotica virgifera
  misc_feature (662)..(662): n is a, c, g, or t
  misc_feature (866)..(866): n is a, c, g, or t
  misc_feature (1003)..(1003): n is a, c, g, or t
cggttatgacagtgactgatctataataaacaatcatattaattgaaaatcaacaataaatatatcattaaataatagttctaccatcttatattattatctggcgatatggctatagattatgtgctagtagtggacgaggagagcgaatatccaatagaactacctactgaggagaatggaaacttgctgctaagcactgttacagcacaatttccaggagcatctggtttgaaatacaaagtatctgttcagagtaggacatttcgaggtgtaaggctttctgatggtgttcttcatccaccagccgatgagggatgggataacatagttttttgttgtgtatatcctaaagagaataaacgtaagcatgatgatgctttagaagctcctgcttctaaagtcaagcgtctggagtctaaattgaactgtactgatctgattgtgctgggtttgccctataaaagtaccgaaaaagaattaaaacgatattttgagaagtatggtgagctgttggtggtgcaattgaaaactgacaaagagggaaggtctaaaggatacggttttataagatttgctaagtatgaatgtcagataaaagttttgtctcaaaggcatatgattgaaggcaggtggtgtgatgtgaaaataccgaattctanagaaggttcggtacctcttccacgtagagtgtatgttggcagattaactgaagacataacggcagaagacgtaagacaatactttgaaaagttcggccaagttactgatgtatatatgccaaaagatttcagagcattctgttttgtcaccttttttagacccagaaattgctcaagccctttgtggagaggatcatataattnaaagatcatccgtttatgtctctgatgctgcccctaaaaacaattctaggaaacaaatgatacaggcgaagacaataaacatttgggtcctcatttaaaggaataattttttcaatgaaaatgaccgattcattggnaatgatcgggatcaaaac

SEQ ID NO: 7565 - DNA, 975 bp, Diabrotica virgifera
  misc_feature (198)..(218): n is a, c, g, or t
  misc_feature (222)..(240): n is a, c, g, or t
  misc_feature (464)..(484): n is a, c, g, or t
  misc_feature (843)..(876): n is a, c, g, or t
  misc_feature (943)..(962): n is a, c, g, or t
agggaatcgcactaaatctaaatacaaaaaaaatcatcggttcataaaggtatcaaagtttttagatcggtatctcatcttttctctcctcacaatcgaccatcattaacccggcatcggtcgctaggtaaatcgttacgcgtgtggtcgcgcgtgagattttctctcacatcatccaactttcgccttttttttacnnnnnnnnnnnnnnnnnnnnnggtnnnnnnnnnnnnnnnnnnntttgctttaaaaagacacgacgtttttctgttttattattattatctttatataaaatgtgacgactattgatgccgccaatatttaacattgaaaaatatatggtaagtgaccatctacaactaacccgtgaaacagaatataggattttcatatcatcaaccacatccacggcgccttttattacatcataaaaggatattatttcaggttttaaggggagnnnnnnnnnnnnnnnnnnnnnacagttggtgacgccggtggtcgcctgatgagagaatctctcacatgaagcacactaactcaacaatatggtgatactaagtaaactgagtcactatctgagcggacgagtctattagattgtcgagggaggatagttaggagactagaaggaattacagcgcgtatattttcccagaaaaaagttgtgcgcaattttctgaaaccgtgagagaaaatctcacatagcgaccactggcgggttaaagaaacctgggaaaccttggccaaagatgaaaatttatcactttttagcttatgaatatttatgcttttagctggtttgatatattttcgttgaactagcaacgttgccctagnnnnnnnnnnnnnnnnnnnnnnnnnnnnnnnnnncacaatttgaaaaacgcgattttcggttataagagtttgtacagttttttatgaggccaagtgtacnnnnnnnnnnnnnnnnnnnntttgacagtttga

SEQ ID NO: 7566 - DNA, 886 bp, Diabrotica virgifera
  misc_feature (805)..(805): n is a, c, g, or t
aaaaaacaaaacaggttcacggaaaccaacgcctttcgcggtctcattcgcctgtggtaactacgggctccagaacttcgaaatcatgcaatgaatcgaaccagtcgtcatcacgaagatttcggttcatttttcactcttcaaaaaattcggtcgggtaaatcggttcaaacaccgttaccaagtcaacaggaagcaacggatcaccgaatctgcagcaacattcccaaacggacgagagcaaagcagaaattaatctatcaagaaaaatagcacgcgttcagcaacagagttccgtgttttgctcgatgttgtcctccaacaacaccccactggttatacggttatgtcgctgtctggcggcatgtaagtcatcttcagtgttcatgctccctaatggttacacaaaaggcaactttttctacgttaagcgaaccgaatactgttggggatgctattttccatttactagcgttgttagccagaaaagcgtctgataagaacttattgttaaaaccattgctaatgttcttatcgcaagtgaatcagctgagcgagccagtattttggttcgttctgcagtttttggatactgaagaagctgtggaattattctttaattcaggtggtatatcaatattgggtaagaacatagtcaacagcacaaattcgcctagtaccttatctaaaataggtactatatcaacggtgatgcaacattttagctgtataaattcatcttctgatatacggagtatactaacggcacatgctaccaaaaaatccgctcatacatttcccgaanacaaaatgtcgatgattaactttgcgccatattgtacgatatcttgcgaatctagcactgctcagtctgcagacgtttgat

SEQ ID NO: 7567 - DNA, 572 bp, Diabrotica virgifera
gctctattgttcgctgtttatgtagacgaggtttacacgtatagcttatctatattggtattaaatacgaattgtggctgttgggtgaccgtacaaaaatgggaatgtaagagtagttcgaccatggtcattatctatcctttaatccctctttagtattttattaacataaaaatcttcgataacctgtacccacaacagcctctgtttcttctgaatgcttcatatttgtaaatctggatttattgaacgactcagactgtatgttctaccccttgttgctctctcatagattgtttttctgaattcttacatcacgcattgaaaactaatatggtggatgggagaatacctacaaacagctttacgagaaatgctcgacgtgagccgatcctgcgacttaaagatgatctaagacagttgatgtgtctgcccttgtaagatcctacaggttcggtggcagatatatgcttttatccactgatttgatcgaacaactctatatactatctgaaagtgtgacgtgtacatcactctattgtgtacttaaacgggtacttatgggcacactg

SEQ ID NO: 7568 - DNA, 912 bp, Diabrotica virgifera
  misc_feature (2)..(26): n is a, c, g, or t
  misc_feature (30)..(60): n is a, c, g, or t
  misc_feature (121)..(878): n is a, c, g, or t
cnnnnnnnnnnnnnnnnnnnnnnnnnctcnnnnnnnnnnnnnnnnnnnnnnnnnnnnnnncttttatccgtaaaatcaaatatctttaaataattcttttcgtaatcgaaacgttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagtcaaatcgat

SEQ ID NO: 7569 - DNA, 811 bp, Diabrotica virgifera
  misc_feature (793)..(793): n is a, c, g, or t
gctccccttaggaagcgttttcggaccgggtgaatcgggtcggatcgtctcggaatcgtccgaggggtctcccgtcttcgttcgtcggtggagtttccggacaccccgtatacgcatatagtacctataaatctgaattaaacaaacgtagttgcagggaattagtactatgtatgtagtcaataattatttgagtggttttggtcaattgatgttttttatatacgtataaaggtgctatgataaaatgaactttcaaaaaacaacaaacaaaatgcaatagcttttttatatggtgtttaaatggttttttttatacggctttatttgtgtaaacatcatttgggtattcccttatatataactgtgtatcaaatctatagattttatacgttgaggacgtttgagctggaatgggttcattttttcgagagtgggccattttggagatgaatcccgaaacaggtcagtttttgcttttgaattgtaattttgtggcatatatattatactaatgtgtgaagtagtaatgtgtgagaatagggtttgtgtgacggctcatttgagaggttgttcagtaatataaacattgatatgattgtttatacagggtgtccaaaactgtatgtaatttacttatttgaaaaatcaacattgctttcgcttaaattaaatgttcaaactgccaaaaggcaggtgggtggcaactttacactttacaacaatatttatttgtcaaataaacattttctcctatttttgacaacagtaaaatgtatttcgaattaagtanattacatacattcttctt

SEQ ID NO: 7570 - DNA, 896 bp, Diabrotica virgifera
  misc_feature (155)..(174): n is a, c, g, or t
  misc_feature (257)..(278): n is a, c, g, or t
  misc_feature (285)..(306): n is a, c, g, or t
  misc_feature (853)..(853): n is a, c, g, or t
aggcatacgagtaatggtacgaccgggtaagaatatgtatgcactacaatgtgtaataatgccaaacacgtcacatcgacatgatagtaggagttgacgaattggcagaaaaacatgtagtgatagattttaaaaataatacgatgaaactaacnnnnnnnnnnnnnnnnnnnnaggacaaggaacatgagaaacaaaatacggacgaatcaggtaaagaacaaacagtggaaatgaatttggcagcgaagcaaggnnnnnnnnnnnnnnnnnnnnnnggtcagnnnnnnnnnnnnnnnnnnnnnncctgtggctcctcaaaagaagagttgagcccagaagaagaaaatttgagagtatcagaaacaaaggacacctgggattcctcaaaagaagagacgagctcaggagaagaagaaataaagcaaaaaaatgaaagtgaaaagaatatgattgaaacagtggtatttgaagaggacgtatatgcaaacgaggatgcagaatgcacggtaaacatgtgtgaagaatctgagaaaaaagacagaaaattgatatgtggagaagggaaagaaaaagaattgcggttgatgttaagaaactacgaaaatttgatcaatgaggaaaacagagtggctaaaaagtacgaacattcatttgaggtaaaaaacttaggaaattttcgatcaaagacttacccgattccatacaagtatcgacaagaggtgaaagaagaattaataaaatgttggaagatcaaatcatcgaaagatgtgattcaccgtatgttaacccgattgtgatagtaaagaaaagaaatggagaattgagattatgtttagatgccaggaatatncaccagcacactgtatcacaatatgaatcaccctctaacatcg

SEQ ID NO: 7571 - DNA, 754 bp, Diabrotica virgifera
  misc_feature (8)..(44): n is a, c, g, or t
gttctctnnnnnnnnnnnnnnnnnnnnnnnnnnnnnnnnnnnnntttccttagtcactgcatatgtacttgataattatgcagaagtgatttctgccccacctccccaaatgtccaacgacatctctgacgccgcttctgccgatctctgcgatacatcagccctatgatcaacctttaataaaacgacccagggttgccaaaaccatacgtaagatgctgctgacttatcttcaggatagcaacccatctgaccctacattctatattgtgtaccgatccacatcttggagcggctgcctatctctgaacgcagtgaatgttccggtcgaggctgagttccaactttcatttgctgacttcactgacacagacctgtgcagctttcctggatagcgcgtacaacgaactcttgggatgggaataaccaaagttgacacctgataatggctctccaaggatcggctttatgtgcactcgagaccatattgacacacgagactattgcttatgtccgactcatgcagacactggacatgcgcgatgactagggactggtggatcatatccatctagcgacggataagactccacctacacagaaagatgaagctctccgagaagatgagctaaattacgacgggctaccgcaagtagcttatctatctgctcccgtggacgtgatgcagatgtagatcgtgcaacttctctcatatgctcttcgtgctatggtgatgaagatatcactgccacta

SEQ ID NO: 7572 - DNA, 752 bp, Diabrotica virgifera
  misc_feature (24)..(65): n is a, c, g, or t
  misc_feature (70)..(150): n is a, c, g, or t
  misc_feature (152)..(166): n is a, c, g, or t
  misc_feature (176)..(197): n is a, c, g, or t
  misc_feature (219)..(553): n is a, c, g, or t
  misc_feature (560)..(597): n is a, c, g, or t
  misc_feature (617)..(630): n is a, c, g, or t
  misc_feature (633)..(655): n is a, c, g, or t
  misc_feature (663)..(685): n is a, c, g, or t
  misc_feature (715)..(746): n is a, c, g, or t
ggccgctcgcgatctcgaactcgnnnnnnnnnnnnnnnnnnnnnnnnnnnnnnnnnnnnnnnnnncgacnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncgtcttttcnnnnnnnnnnnnnnnnnnnnnncgcccaccgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7573 - DNA, 877 bp, Diabrotica virgifera
  misc_feature (154)..(166): n is a, c, g, or t
  misc_feature (168)..(182): n is a, c, g, or t
  misc_feature (199)..(271): n is a, c, g, or t
  misc_feature (281)..(869): n is a, c, g, or t
cccacggcgtccgatttctccttcaaaatcatcaaaatcactctctctctcgtaaatgtaaagaaaaatctttctcttaacgatagttaatctcagattcgtgagagaaatctcttcacttttctaaaagaaaaatcttatttttcgtacctcnnnnnnnnnnnnncnnnnnnnnnnnnnnncatcatcatttatctcnnnnnnnnnnnnnnnnnnnnnnnnnnnnnnnnnnnnnnnnnnnnnnnnnnnnnnnnnnnnnnnnnnnnnnnnntcgaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagag

SEQ ID NO: 7574 - DNA, 858 bp, Diabrotica virgifera
  misc_feature (66)..(93): n is a, c, g, or t
tattatttccggatcccaatcataattattattctcaagtaattattccaaacaaaaccataattnnnnnnnnnnnnnnnnnnnnnnnnnnnngaagcaaaccgaaagtgcaatctcacatcagacagaaacaacgaaaacaagttttattataatatttccttgaaaaggtatttgcaatcataatatttacataagaagtgatctgattgaattagacgcaaacatcatctatttttcacacttaactcttgacattgaaagtaggtgaatgactttttctgattaccaaaaataatgctcttactatgattatcgaattactgattacgaatacgaatctccaagaatttcgctacgttttcaaaacgatacactcatacaggaagtattaaatgagttaaaatgtacctattctacaaatataaatgagttaaaatgtacccctaacacaaacgtgttaaaagtaatacatgttctttcgatagtactaattttgatcatattgatatcgagtcgaatggagtatctcaaactaaagtgtattgtaaatgtaactttgtaacctattggattaaaaaaaccgaaaaccggttttccaaaaaccggttttttggccggttataaccgccaggttaaaccgtaagtaaaaaaaccggtataaccgaaaaccgctgttttgtcaaaaaccgccatccctatctgaaagtgcctctatccttggagtcgaattggaggtgaataccatgttcttctgaccactccaaaagggtcgagccatttttgtcactgtcagagtacctctacgtttcatgatgggtaaaatcacgtacataatatatgggctggattttcata

SEQ ID NO: 7575 - DNA, 201 bp, Diabrotica virgifera
  misc_feature (7)..(44): n is a, c, g, or t
  misc_feature (57)..(57): n is a, c, g, or t
  misc_feature (64)..(77): n is a, c, g, or t
  misc_feature (80)..(97): n is a, c, g, or t
  misc_feature (110)..(132): n is a, c, g, or t
  misc_feature (170)..(193): n is a, c, g, or t
taacagnnnnnnnnnnnnnnnnnnnnnnnnnnnnnnnnnnnnnntgcgacctcgatngtggatnnnnnnnnnnnnnnggnnnnnnnnnnnnnnnnnnaggtctgttcgannnnnnnnnnnnnnnnnnnnnnnagtttaaaccgttgtgaggcaggttggttttctatccnnnnnnnnnnnnnnnnnnnnnnnnaaaaggac

SEQ ID NO: 7576 - DNA, 670 bp, Diabrotica virgifera
  misc_feature (13)..(29): n is a, c, g, or t
  misc_feature (31)..(68): n is a, c, g, or t
  misc_feature (70)..(83): n is a, c, g, or t
  misc_feature (85)..(114): n is a, c, g, or t
  misc_feature (136)..(471): n is a, c, g, or t
  misc_feature (478)..(515): n is a, c, g, or t
  misc_feature (535)..(548): n is a, c, g, or t
  misc_feature (551)..(573): n is a, c, g, or t
  misc_feature (581)..(603): n is a, c, g, or t
  misc_feature (633)..(664): n is a, c, g, or t
aaaaatcgtatcnnnnnnnnnnnnnnnnncnnnnnnnnnnnnnnnnnnnnnnnnnnnnnnnnnnnnnncnnnnnnnnnnnnnncnnnnnnnnnnnnnnnnnnnnnnnnnnnnnncgcccaccgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7577 - DNA, 873 bp, Diabrotica virgifera
  misc_feature (824)..(841): n is a, c, g, or t
atcaaaagaaagtttaagttagcagcagatataggatgtagccgtggttatgtatctagacatatctccccagattctgtagaagaactgatactatgtgacattagtgaatcaaatttgaatgctgcagttgtacaagatggcataaaaactacaaaacaaattctggatgaggaacacattgagtttaaaccaaattcattggatatagttatatcttgtcttagtttacattgggtaaatgatttaccaaaagcctttaaaaggatcctgctgagccttaaagaggatggtgtctttttagcttcagtgtttggaggtgacacgttatacgagttacgatcttcccttcaattagcagaactagaaagaagaggcggaatatccccacacatttctccgtttactgaagtaagagatataggaagcttattgacaagagctggctttacaatgttaacaatagatacagatgaaatcattgtaagatatccatccatgtttgaactgatgattgatttaaaagggatggcagaaagtaatgctgcccttaatagatcgttgcatttgcatagagatacacaatttgcagcggcagctctataccaacagctttacggagcacctgatcctgaatctggggaaatgtctgttccagcaacctttcagataattaacatgcttggctggaaaccccatccaaaacaaccaaaaccaatagaaagaggaagtggggaggtttccctgaaggaccttcacagactagatgaaatcattaaagaagtaaaatcgattaaaatagatgatgatgataagcgttgagnnnnnnnnnnnnnnnnnngaagttatctattttaataaatattctattcc

SEQ ID NO: 7578 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7579 - DNA, 109 bp, Diabrotica virgifera
caaaatttatcgttttattaaattttgtcatacaatggaagtacacaacgcctcctttcactcatacaagttatacatataaacttaaaaactacgtttacatcatact

SEQ ID NO: 7580 - DNA, 1016 bp, Diabrotica virgifera
  misc_feature (348)..(362): n is a, c, g, or t
taacaacattatttgtgctgctgataaaattaaaatgtttgccaaaccaataactgtgaggaacaaagtgatgtgtataccaataaatcaggacagtgtagagagtgttgcattggacttgacaaaacattgtgaatcccagactgtgaaaaccccagcaaaaatgttcagggatcaaggtactcaagttgatattgatattaaacctcctaaaccagaaacagtaagcatagagacgaacacagatataacaggagatatagttaaaaaggaagaaaactggtttaatttgcttgatttctctagtttggataacgatattccacaatcaccttttcccgaaggccnnnnnnnnnnnnnnnagaatttcgacttaccaggcaaaagtatggacaatagtaaagaatatacgacccttactaatgcagtaacaggcaaaaatgtagctaattactcagacaattcagtcaatacagcaaagaacctttttatggagttgagacaggctctagttaataatgatgaaggaaatttaccaattcacgtaggcgttatagcaaataatttcaaactagtcaaacggaatttgttcttgctgaaagtcctgaaacactctgtagacgtaccaaacagtcacgattatactccactgcaattagcattgatccacaattcttcgatagaaattatagaagccctcttggccgagggtgctagttgtcgcaccacagattccgaaggaaacagtattcttcactacggggcagagttaaacagaaaagaggctctcaaattgttagtgagcttcgccggtctccaaaggtgtactttgaatccgtttaaccacgaaggtctaacgccgttgatggtatgttgtttaaacaaaaatttcgaatgtgccgaaatacttctggatgctgatgcccgatcccatattaaagatcaaatatctggaaggacggcactgtttcatgccgctgagaagcacgacgtggaaatggtcgaaatgctcctgc

SEQ ID NO: 7581 - DNA, 407 bp, Diabrotica virgifera
catcgactcctatagggaagctggtcgcctgcaggaccgggccgggattcccgggggcccccctcctcccccggtgtgtctgattgaggctgtttcaggtctattagagtgtatgttaatgcagggatcctcacatattgccacagatggttcgattctgatcgaaaaacccttcctcttgaccgacctagcgtgtctgaggccaccgccgacggaatatacctccattatgatccagtttggaagatggaagccatgcaaagtgtcacacggaggagctatatctgcatagcaactctattgcaaggacacgttactcgttatacagctatctgtaactgctgtaccaaatatgtgacctccacctcatcgcactatatgcaagagtacaatgtctgcatactatt

SEQ ID NO: 7582 - DNA, 949 bp, Diabrotica virgifera
  misc_feature (624)..(646): n is a, c, g, or t
  misc_feature (769)..(769): n is a, c, g, or t
  misc_feature (868)..(868): n is a, c, g, or t
  misc_feature (914)..(914): n is a, c, g, or t
  misc_feature (931)..(932): n is a, c, g, or t
gtaggctgcctgtcaccggggaacggccggggagatcaacatttttggagctttggttttttcggaaagcactattgctaaatatcactttaagtacagcacttttcatattgtcgttgttaaattaacatttttaataatcaactgtctttgtttcaaacaaaggggccatcgtacctactcattttctaggggagaaaagtctaaaccccaacgacctaacttgtaagttagatgtagctaaaattaatagaaatctttaacactgtcgttgccactttattattaatattctcttaggattctcgagtagcctctctttagttatgagttgttaaccttgatgaacagaaaaaatatctacgactagagtttgctagaatatgagtttatttttcgcagactaagaaagctgataaagctgagtggcagacgaagaaatgaactaactacatagttactcgccgttatttttttgaattttacatgtttcgacttttttggattatacacacactacactaataaaattttaaaactctactacgtatttttactagtaggtcaaacagcacccggctgatatttttgacacatacacgtgtacctttttatttttgggcnnnnnnnnnnnnnnnnnnnnnnnggaaataagcctttagaacaaggtgagctacgctttagctttgttgtggcgacagttttagaccagtccccgtaggtatacagctttaaacataaggaatttgtacatttcaaaattctctanaaccgttaagaacaaaaaccttgccaattttcagtatacgagtagtagttcagagaaataaggaaaaaaatatcctgttggtgacacagccttctccanggccgaaccaattttttgagtagtatggacgtctatattagtgacnctttatgttcctgtagnncatttgatgatgtgcat

SEQ ID NO: 7583 - DNA, 1233 bp, Diabrotica virgifera
  misc_feature (711)..(711): n is a, c, g, or t
  misc_feature (852)..(866): n is a, c, g, or t
  misc_feature (876)..(876): n is a, c, g, or t
  misc_feature (890)..(908): n is a, c, g, or t
  misc_feature (985)..(1009): n is a, c, g, or t
  misc_feature (1131)..(1183): n is a, c, g, or t
gattatgtagagtttgtgtaatattttaattttatcgattcacttatgataactaaaatgtcatacattttatactagataactataaaatggtattgtcagcattttgaggttcagtcctgggacgattttattagaggatcattattgtcatttctgtctgtcattttacattacgtggctcagatgtttgcgtttttgaagtttttgaaacactcctttgtctttatttgtcttcttaattggatatttgattcttttaggaaatcctacatatttttcttttttaaaagtctaagatataagaaactgtacatctattaagtgatacacctaagcattggctacttgactgattcattactctcccccaataccaaataacggatagaagttttggtattttggcgtttgggttttagatgctgtaatttttttactagctttagaaactaattgttggtaaaacgtgtattacttatagtccacagtgcatcgtcctttttggaagatgatcataagagtcttggaaatggtcttaactgcttcgtttgagcgagtctacccttttctcaaacatttcagaggggatgggtggggaaccgcgtttccgcgtcccgtgtcattgacattatttaggttgtcggacaaatttacagccgcgtttcgttattgggacaacgtaaatatgttaatgacgcgggacgcggngacgcgtccagcctgcactctggaatttttctgagagtggtggactcgtttaaacgaggcggttaggaccatttttaagacttttgcaatcatcttccaaaaaggacgaggtactgtggactattagctgtattttgtagnnnnnnnnnnnnnnnctgcaagctnaaaattgatgttgnnnnnnnnnnnnnnnnnnngtttacgttgtttgttgagattttttgaaattacaacaatagtattgacataatttgaagtccggttgaaacatagnnnnnnnnnnnnnnnnnnnnnnnnncatggttaattcttttttagtcaattccaaacagaaattttggttggaaaaatccttttaagttttggttcctggaattttttggaaaaaactccccctcacaaaaacacaaatgggggatnnnnnnnnnnnnnnnnnnnnnnnnnnnnnnnnnnnnnnnnnnnnnnnnnnnnnctcctctctccaacaaacaaatacaaaaagaaataaatgggaaggggtgg

SEQ ID NO: 7584 - DNA, 852 bp, Diabrotica virgifera
  misc_feature (833)..(833): n is a, c, g, or t
aatgtgtaacaaattataagtaaaattcaccttaaacacaaaaataaacagtgtttactatacgacaacaccgaatataacgccgatctactcacagagtgacgtagctacgttggccccgcctacctgctccatgtcatatcttctgttattgcatcatggtatgaaggtaataaataacttacaatacatctcgatactgctgcacttaattttgactggttctaacttgactttactgtactaactaggatcaaggaaactgaaggtaacttatagtacctatatatttaatcgaatatggtattagattaagatatttcaaagatataagtgtattaaacttagagaaaaattcaatcagaagctaaacgtcaaacctcagagacactcccaccccaagtcctttcgtcttaacaatcttttggactctttttctataaaaaaaagggtggggatatttcccttctcaaaaaaatgacaactttgcttttaaaaaaaccaggctgtttctgggtaatctaaacaatataacggaacatcaaaaaaggctaaaacggaacctaactgtagttttcagaaaggaaacgaatgatcaaaaaggaatgaaataagttaagccgatatcggtggatcaaatagaacttaaacggaaaatagctataaaatattgcaatagagatccccgttttaaaatagagtacctaacgggattttagtaataaatttgttgagaggtttttaacagctatttcggtacctcttgtacaaaacagattacaataacaagacctatgtaaaatatgagactctaggtctcttttcaaacatcngtgtttcggcaggctgcat

SEQ ID NO: 7585 - DNA, 887 bp, Diabrotica virgifera
caaaattaaatcaatatcggctactcggaaggcaaacattgaatattattctatcaggttcttatggttttagatcattttagttgttgtacaaagattaatttaacattttctctggaagtattaatttagaaagataatatgcctcattggtgttgtgttttgaagtgtgaaatgcaaagtaatcgtgataaagttagcttttaccacttaccatcagtgctacattctaagcacaaaactgaaccaatttaactaaataagttatagttatcatctgagagacaacaacaatggtaaaatgcaataaaatataaagattttactagcaaaatggaaattcccctgtaatcatcttatatctggtaagttacaacatttgaacattaacgatttttgaagatgttaacagtctaatcttgtaggaaaaccagccgatttaactgataataacaatccagattgggttccttcaataaatatggggtatataaacacaatgaaatgagttccccaaaatctaaaatgggaattaaggtaccaaaggagaattaaaagaaaagggtacctacaagaaaaaattgcttttttattcctcttgaaatgatttataagacactggactgtcttatattctacaaatactaggtaggtctatgattttacacatttttcattaatgatacattactgttactttagtagatttagaaacagtggatagttagtggtagatagtagttatttggtataaaagttagtttagtagaagacaagattttgccaaatagtcaaacatatattacaatggaaaaattaacaaatacattttatgtcattaacattaacacaggattttaaatatcagcttaagaaatagccttatc

SEQ ID NO: 7586 - DNA, 945 bp, Diabrotica virgifera
atttgtgtaaatttattagttttgtaataatgtttataaaatttctattaaaccgtggtaaaaccagcataatttgctaccacaggcagtattctaatagaaatatactaaaattaaaagaacgtggcatgtttgaggatatttttccagataattcagggaatgtagttactgatttaatgaatgctcgcccacaaacagtttacgcgggttttgatcccactgcaaatagtttacatgtaggaaatttgttaattcttattaatttactgcactggcaaagaggtggacaccaaacaatagctttggttggaggtgccactgccaagataggtgatcctagtggtcgtaatacagaacgtgaagagatatcaaaatctttcatagccgaaaatatacaaggactttgtaataatattagcacaatatttttgaatcatgagaagtttttatggaaagaaaaaaattccttgaaaccttatactcaacaatgccagttggtaccaagtcatggatccagtagatctgattggaggtgctggaagatatttaaggatgggaacattgttatcaagaactagtgttcaaaccagacttcagtctgctgctggtatgagctttacagagttcagttatcagctgttccaagcatatgattggttgcatttgtttaagaaccacaattgttcttttcagataggaggtaatgaccaaatgggaaatatcatgtctggccaagaactaattagtaaaacttgcaaaaaacctgtctatggtcttacacttccactagtaacaacagaaatgggtgataaatttggaaaatccgctggtaatgcagtatggctctctgaagaaaaacatcagcttttacattctacccagtttggatgagacaacccagatcagaaagtgaaaagtttcttaaactggtcacatttgata

SEQ ID NO: 7587 - DNA, 997 bp, Diabrotica virgifera
  misc_feature (11)..(871): n is a, c, g, or t
  misc_feature (873)..(873): n is a, c, g, or t
  misc_feature (945)..(945): n is a, c, g, or t
  misc_feature (966)..(989): n is a, c, g, or t
tctgcttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnaattacctttagggataacagcgtaattttattggagaagtcaaatcgataataaagattgcgacctcgatngtggattaagtttataattgnnnnnnnnnnnnnnnnnnnnnnnntggtcgac

SEQ ID NO: 7588 - DNA, 579 bp, Diabrotica virgifera
ctttgtgcgcgttcgcttgatgtgtgtgtgagctactgtaactcctttatagaataaaagaaaatgtcgttatccaccgatcgcccattggggagcgtatacaacgagaagttggagctagcagaggaagcaaatatgttgctgtgcagaagtgcacaatggaccctaatgctagccgatattcaggacttgcaggcgaaaacaaggagtgacgatacggtcataagccctacgacgtctaggacaacctctaagatctagaatactgccaactactgctgatgaagctgtttggaaggtcctactccttggacgagatgatatatgaatctattatcaccgcataagggaacaacagtaagatccttgtcctggtccacccgcttaaaaggacgtggcatatacagagggagatttatcactagccgtggggttgatagaatggacctattctgatactgcccgacgtgttatgctatttgcagacggacctggctgagaacgagttgatcctggaggtagtgaagattgaccacagccgatctgtacacagcatgatacttaaataaagaattccaa

SEQ ID NO: 7589 - DNA, 408 bp, Diabrotica virgifera
  misc_feature (83)..(104): n is a, c, g, or t
ttaacttcgtaaatacgtcgtaatagtagttaggacacttaagatgtatttttttcgaaaataatactattcgaaaaactagnnnnnnnnnnnnnnnnnnnnnncaatcagtaggccttaaattaaagtattgcaatacaaacttgggaatgagctcaaactttatggggtaatatgcaaagtatactttataaatttgacaagagaaagggtgcaccctgtcaagataccaaggcttccacggaccacagggacacccagtccttaaaccgacttccagatgtcatcgtttccattgaattcatcatccagagggcccattccattcgttcctgccatgatgctgctgtaaacgtcatccatattttcatcaaattatttgagtttaagaaataaacttgatttttg

SEQ ID NO: 7590 - DNA, 568 bp, Diabrotica virgifera
tcttgtccggccgaagaagaagggactagacaatggtggacgcctttacagccggtgaacctggagaattccgaggaggtttctggaggtggggggcgaggaggcagtagaggtggtcccactattaaaggtagaggtcgtggcagaggacgtggtcgcgacaaagaagataaaaaagaagtgggtaccagaaaccaaactaagacgattagggaaggatgaaaagagccggtctcctaaagaaatctacctgttctctttgccaatcaaattaattcgagatcatggatcatgtcatcgaatcagacttgaatgatgaggtatcgaaaatcatgcccgtccacaaggaaactcgagttggaaaatgtacacggtcccaggacaatgtggccgtgggagatacaaaaggacacataggactaggcgtaaagtgcaacaaggaagtagcaactgccatcggaggtgctattattctagacgcactgactgttggtgcaaaacgaataagagactggggcaacaagattgatcgaacccaaactgtacctagcaaggaaactgaacaatg

SEQ ID NO: 7591 - DNA, 884 bp, Diabrotica virgifera
  misc_feature (765)..(782): n is a, c, g, or t
  misc_feature (806)..(806): n is a, c, g, or t
  misc_feature (841)..(860): n is a, c, g, or t
tagacgaatggtattctgtgaagagatgatgaacaagcaaaatgctgaccaaaattttttaaagaacattttatttactgacgagtcgacattttctcttcacagaaaacacaattcatcgattgttcggtatgggtctcgagaaaataaacatttaagcattcctgtgcgaacacaatacccgcaaaaacttaatgtttggtcgggtattttgggtgattatgtaataggccccttttttattgagggcaacctcaacggcactaaatacctcgaactgctacaaaatcaaattgttccggcaattcagcaacttccgaatatgaatctcggagatatttggtaccagcatgacggatgtcccagtcataatacaagggcagttaccgaatatctccaaaggacatttccaaatcggttaattgcaacaaacggtacaatcaagtggcctccaagatcagcagacctctccccaaatgatttctttttttggggctttcttaaatcaaaattttatcggcacaattttgaacgtgcccaaaatttaatggagttaatagcgaaaattgtccaatattgtgctgacattacgccagatcaactcagacatacaagagaatctttgtatgatagattcacccattgttcgtatgttcaaggtggattatttgaacctttactccattaaattttgtgcctaaataggttttttaagttgtttttagaatttaatcttgttaagttttgttaagtttctttaagagnnnnnnnnnnnnnnnnnnacgagattactttttattttccanaccgttacggcaaaaaagaaccacacacctatttnnnnnnnnnnnnnnnnnnnnaatcgattttacaataattttcaa

SEQ ID NO: 7592 - DNA, 903 bp, Diabrotica virgifera
  misc_feature (87)..(105): n is a, c, g, or t
  misc_feature (824)..(824): n is a, c, g, or t
  misc_feature (856)..(856): n is a, c, g, or t
  misc_feature (886)..(886): n is a, c, g, or t
aaaatacgattccaatattcttacaccacaatcagtatgcgactatatagacgaaatgggtttcgaagcgtcacttccacttttggnnnnnnnnnnnnnnnnnnntaaagaatcttgtattgtagaaatcaaggggatgacatgtaattcatgcgtgcagagtatagaaggaatgatatcaacaaaggaaggtgtacaaaaaattcatgtagacttgcacaagggagagggctatgttgaatttcagcctagtaaagtaacacctgaacaaatagcagaaatgatagaagatatgggctttgaagcgtacataaagtctattaatgataaaagtgtggagaaaaatatagtaaccagtccgaaatctagtaaggcgtccactagccgtgaggtcgacgaatcatccaagtccaacttgtcgaggtgttatttgcaagtaaaaggaatgacgtgtgcttcttgtgtagctgctattgaaaaacatgttttaaagatacccggtgttaacaaaattgtgatatcattactcggcgctcgagctgatatcaaatacaatccaacagaggtgagtccgccagatatagctacttccattacaaacctgggcttcccctccacagttatacaacagtccgatttagacgaagctgaagtcgacatagaaatcactgggatgacgtgtgccagttgtgtgcataaaattgaaaccgatgtaatgaaacttccaggtttgaacagtgccaaagttgcgttgccaacaaagagaggaaagtttaagtataatccagaaataaccggaccacggaacatcatcgaagctattnaaacattaggattcgaagctcagctatttttngagggagaacgccaacggcgattatttacnaacataggaggaaatca

SEQ ID NO: 7593 - DNA, 134 bp, Diabrotica virgifera
  misc_feature (2)..(105): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataatttttgatcccatttttttttga

SEQ ID NO: 7594 - DNA, 762 bp, Diabrotica virgifera
  misc_feature (385)..(410): n is a, c, g, or t
  misc_feature (469)..(486): n is a, c, g, or t
  misc_feature (595)..(615): n is a, c, g, or t
ctagagtcattatatgattaaccaaaatcaacggtgcaccgaacataaacagtgtcacatatcgacttgtgcacggcatttgtccatttaaaatgtatataaagcggcgtttgtctaattaagacagtatatgtgattactttattcaaaacaatctgcgtatgtgctcaagaaaagtgacacatttatcacttatttatctttctttttgcagtattttttgtttaatgctgttacttatatttaaagttacatcattaaaaagtatgttaaccagattataataatgatgattattatattctgtattgcaagacccacttttgataaataatgtttcgtacatttttcgttattttatctgtatagtgtcacaactcaaacnnnnnnnnnnnnnnnnnnnnnnnnnngcacaattaatacactattttgtagagcttcataaacctttgtaactgactaaaatagnnnnnnnnnnnnnnnnnncagtttttgaattaaacccggaaaatttctagcacaaattttaaacgttttctcgatattttgcttttttgacttatgacactgagcggaggtgcgttatcattctacnnnnnnnnnnnnnnnnnnnnncacagccatatcacagcctattttttgaaaaccattacacggtagaatgcgtttattcacagcatccggctacgcgaatgtgtttttgttttacaagcttgtcaatcatgcagtgacgtaactgccaagttttatttgttggaaact

SEQ ID NO: 7595 - DNA, 849 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (803)..(842): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattnnnnnnnnnnnnnnnnnnnnnnnnnnnnnnnnnnnnnnnnctcatcc

SEQ ID NO: 7596 - DNA, 857 bp, Diabrotica virgifera
  misc_feature (274)..(310): n is a, c, g, or t
ggaaggaccttttcaccaatattacaattgtagaagatcgatccaaggagatgagtcagaatgaaacaactgtttatgaaaatgagaactctttcataaccaaaaaggacgatatgtacttcaagatgaagaagctaagggatatggagtgtgtaaaaatgaaggaagcctctagtgccttgtggatgatcaaaaacagtgccaatagcagctgggcggaggagttgttggcggagagtatacttctcgaaacacagctaagatacaaactcannnnnnnnnnnnnnnnnnnnnnnnnnnnnnnnnnnnnaccaatcaaaacaaggaaacttacaggatctgtcacgttatcaaatctacagtacgatataagagaacaagacaagaaatcaaacgattgcacaacattttacctgctggctatttcccatggtaccgtagtcttgaccacaaaagctatagagtcaattgatgataacaaacttatttttaacgaaacgtttactctcaatgacttagatgatgactttgaaattaaggctgaggtttactccattactctcaatactgctaagccgggaatcgtggagaaacttctaaaaaggaaaccgaagtgttgttgcccaagcaacaaaatctactacgaaaacgtcaacactgcagagctcaaagaatcatctattttgaagccatcatttttatcctgcggagaattcacaataaaatcaaacacataggaaactctagatttgccctcctgaaaggaaacaatacgttgaaaaacttcgtaaaagctgtattaaaagtagagcacatgactctatcgactaatttaaccggatttttaacattgggaa

SEQ ID NO: 7597 - DNA, 135 bp, Diabrotica virgifera
  misc_feature (7)..(99): n is a, c, g, or t
  misc_feature (103)..(134): n is a, c, g, or t
ggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnnnnnnnnng

SEQ ID NO: 7598 - DNA, 937 bp, Diabrotica virgifera
  misc_feature (862)..(862): n is a, c, g, or t
  misc_feature (865)..(883): n is a, c, g, or t
gagagatgtcgctagattgcgtctcaaaaggtggaatcattgtatcgcgatggttttccttaaatagacagattgttgatatttctttcagagttgtgactgcatagcttcactgaggatgcatgaggatgctgaaatagctatatggagatggtggtccaactctgaatcgaatataaacaaaaactgcctttatattatttgtttgtattattgcctcaacatttatggctagacttttatgatcatcatcactatggcgttacaactctccttgaatatttgccgcgcttactattgccttccatgtttgtcggtcatgtgccactatctcccattatctcactcccattttctctagatccctctctttgtatccctccacctgaaatgctgatagtattgatatcaaaagtttgttaagtcagcgttgtagtctggtattctagaaaccatgaatgataaaactatgtttagaatattggatctgatgattgtgtataaaacaattaatatctaagttgatgaagttgattattaagtgtgtctttgctgaacgattttatctatggacaagtgaattataggatatttagtgtgaccaactccaattcagtcaaattcgggacaagactgataagaatacctgaaatccgggacttttcaatgataagcgggtaattttttttcaatatagaactttaatatcattattttattgattatacagcttacgaacaatattaatatttttgtgctgacaatgatatttttggtgggattaaaccacaattggtttcatataataattacatttttgttagtttttgacgtttcgacttccaatccggaaatgatcctncannnnnnnnnnnnnnnnnnntcactgatgttggatttccatctttttttgtcccaccatttcatttgatctgaa

SEQ ID NO: 7599 - DNA, 222 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 7600 - DNA, 904 bp, Diabrotica virgifera
  misc_feature (817)..(817): n is a, c, g, or t
  misc_feature (888)..(888): n is a, c, g, or t
gatttgacctaaaatagagtgtggttccttgctgggttgcagggtgttttatctagaaatttaaaaactatttttgctcagcatcctaaaactattccaggtatccttttcatacctggcggaaagtgcgactactgggcaccctgctaaattatgatagacgtttctggctactgccagaggcgtgcgacgggggatggtgaatggttgaccctccttaaattctgcgccactgaaggaattgctatttaggtgccatttttggattccccaatgctttctacgtaaataatataatcttcattggtaaggataaagtcattggttttcgagatatttgaagttaaatatgaaacggcacagttattttgattaatttatgatatgattcatatgattaaaattatttttacccagtactttaaaactatttggcgtatccttttcatacttggcagaaagtgtaggtactgtacaccctactaaattaagataaataaacgtttctagctactaccagagtagaacaagtggaggattttgaatatctaggaactataatagacggaaaaatgcaaaaagagctgaacaacagaattgctaaaacatcacaactatatcactccctcaatttgggtttcattagcaaaagagaaattagcaagaagacaaaagtgtcagtatataagacaatatacctacctactttgttatatggaagtgaaacatggacgctaactgaacgggagaagagcaagatacaatcttctgaaatgaagtatttaagaagagtaggagttacgctaatggacaaagntaaaaatgaaacgataagaaacaacctagatgttgagagtgccaacaaagaaaaggagttattgagacaangagaacttgcaacttt

SEQ ID NO: 7601 - DNA, 773 bp, Diabrotica virgifera
  misc_feature (3)..(24): n is a, c, g, or t
  misc_feature (64)..(110): n is a, c, g, or t
  misc_feature (112)..(134): n is a, c, g, or t
  misc_feature (143)..(162): n is a, c, g, or t
  misc_feature (184)..(273): n is a, c, g, or t
  misc_feature (303)..(334): n is a, c, g, or t
  misc_feature (337)..(350): n is a, c, g, or t
  misc_feature (446)..(470): n is a, c, g, or t
  misc_feature (516)..(543): n is a, c, g, or t
  misc_feature (689)..(707): n is a, c, g, or t
  misc_feature (709)..(730): n is a, c, g, or t
aannnnnnnnnnnnnnnnnnnnnngcagccaataaaaattttattgaatgatacttaattagcnnnnnnnnnnnnnnnnnnnnnnnnnnnnnnnnnnnnnnnnnnnnnnncnnnnnnnnnnnnnnnnnnnnnnncttaatacnnnnnnnnnnnnnnnnnnnnaacttataatagctactagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattacacttatttattaccactatatcnnnnnnnnnnnnnnnnnnnnnnnnnnnnnnnnccnnnnnnnnnnnnnncgcttaaaaatacaattctattaaaatttaattttgtatataaaaacttacgatcaaaaactttcctattttaaaacatgttattacttattttcnnnnnnnnnnnnnnnnnnnnnnnnnacatttcttattatcatataactctaaattatccaaatgttagagnnnnnnnnnnnnnnnnnnnnnnnnnnnntatattctacactgatatataggatcattcatggaattctacaacactgttttcacctggttattcaaaacatgtccttttgcattaaatatcccctctctgcctgcccactgattacttcgaatggccgccgaattctgaccgannnnnnnnnnnnnnnnnnncnnnnnnnnnnnnnnnnnnnnnntagaaccgttggatgaccaaacaactgccttgatttaatttat

SEQ ID NO: 7602 - DNA, 376 bp, Diabrotica virgifera
  misc_feature (37)..(65): n is a, c, g, or t
  misc_feature (147)..(165): n is a, c, g, or t
  misc_feature (206)..(236): n is a, c, g, or t
taattttcaagagttatcatattataatatatattgnnnnnnnnnnnnnnnnnnnnnnnnnnnnntaatgtaatgatattcgattaaaataatatctaattttattagaaataaattatgttgatttattaactatatatttattgnnnnnnnnnnnnnnnnnnntaagattaatgattgttatggatgaccttatttataaaagnnnnnnnnnnnnnnnnnnnnnnnnnnnnnnnatgattactcgtctgcccattgatgaatatgaatgatcgatttttatagaccatgataatgatgcattatcatttttttatttaaagatacctgtaatgtatgtatgtatgagaatgaagctgattttattattattaat

SEQ ID NO: 7603 - DNA, 702 bp, Diabrotica virgifera
  misc_feature (242)..(260): n is a, c, g, or t
catatctttacccgtaggaggttgctactgcaccgctgaggatgaatacgcgaattattgataaatgtatgaataatgtagttctcgtagtttatacgacgtttcttctgatgtgcgtgacagtggtttgtgagatcattcaaaatgaagaactgttgcatgactacaatgtggaaggtagaaagaaatcagagaaaagcgaccttctcacaaaaatcctgcctacactagcgatgcctttnnnnnnnnnnnnnnnnnnnctcccagtaatgctgtttttcctgaaactaaccatgataaatagcatgttcctgggaaaacttggcatcttcctctggttcatgaactacttgtttaacagacagaatccagaaggtgctctccatagtcatgccatcaacatcaatcacgggagacatcctgacaatgaaggaatgtactcaaatgatccgattatgaaaacgtcaaaccagaatagttatcagaatgttaaacgaaaaaagagaaagaaataaggaggatgcattaattaatgggatattaaatttattctagtcatagtcataacatatttgttattaatgtattttttaaaactttcacagtattattttgctgttgatatcgatagttctttaataaatttgttttttgttgtttcggattaataagatgaccgtgatattttgaccgcgctaaggg

SEQ ID NO: 7604 - DNA, 873 bp, Diabrotica virgifera
  misc_feature (2)..(842): n is a, c, g, or t
  misc_feature (849)..(872): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnt

SEQ ID NO: 7605 - DNA, 726 bp, Diabrotica virgifera
caaatttttcagttgcggggtcctgtctttccgccgtcgatatgcaatatttttgtccgtgagtatattttgtgcattagtcactaatggtaaggtatttttgtatttcttttaatatgatcctcgtaaacaccttgtatcttccgtgtataacaccttgtatttgctgttccttagtacccattattcactgctaaaagtcagaacagatctataagctgctttgaaaactttaatttttgtattgtatgatatttattttttgttcattgtgtgatacaccatcctcaaataaaacacggtatgtgcagccaacttaaaaccgagaaatcggctctcaaagtttttttctcgggactctatagaccagcggttctcaatctgtggtacatgtaccactggtggtacatttcattatttgaggtggtacgcaaaacttaaaacagccaaaatcagcaccaccattggcacaattatagttaattagatcacctagctagacaggtattttagttaggtggtaccaaaaataataaaaagtatttggtggtacctgacttaaaaagattgagaacctctgctatagaccattccagggtgacgtcatttgacagcgactggtgggcaaaatattgtaaacaaactaggttaagtgtagaaaaccattgtttaatttaagaatatgattaaaataccagcgttttgttcagttttaagtgttccagt

SEQ ID NO: 7606 - DNA, 230 bp, Diabrotica virgifera
  misc_feature (13)..(13): n is a, c, g, or t
cttttggggtggngtgggtggtggatttgatatcgtgttttttcttgctgtcctgctatgttagcatgatgagtcaggatgagtcgttttcgtacatgcgccggtacgtgtggaccttgcgagcggagtgagatacaattggagttcttcgtgagggcctgtgtcgacattgcactagcagagaacggagcctaggttgtcgatgctttcggacggactagatgatgagt

SEQ ID NO: 7607 - DNA, 893 bp, Diabrotica virgifera
  misc_feature (21)..(21): n is a, c, g, or t
  misc_feature (743)..(743): n is a, c, g, or t
tgtcgtccgaaaaatacatantgagagtgcatactgggtgaaaaaccatttgaatgtgaaatttgtaccaaacagttttcaacaaacttacttttaactagacatataagagtgcatactggtgaaaaaccatttaaatgtgaaatttgtaccaaacagttttcaacaaactcacttttaactagacatatcagagtgcatactgttgaaaaaccatttgaatgtgaaatttgcaccaaacagttttcaacgaaacaagttttaaaagcgcatatgagagtgcatactggtgaaaaaccatttgaatgtgaaatttgcaccaaaaagttttcaacgaaacaagttttaaaatggcatatgagagtgcatactggtaaaaaaccatttgaatgtgaaatttgcaccaaacagttttcaacgaaacaagttttaaaatggcatatgagagtgcatactggtgaaaaactatttgaatgtgaaatttgcaccaaacagttttcaacgaaacaagttttaaaaggtcacatgagagtgcatactggtgaaaaatcatttgaatgtgaaatttgcaccaaaaagttttcaacgaaacaagttttaaaatggcatatgagagtgcatactggtaaaaaaccatttgaatgtgaaatttgcaccaaacagtttttaacgaaacaagttttaaaatggcatatgagagtgcatactggtaaaaaactatttgaatgtgaaatttgtaccanacagttttcaaaaaactcacttttaactagacatatgagagtgcatactggtgaaaaccatttgaatgtgaaaattgcaccaaacagttttcaacaaaacatattttaaaattgcatatgagagtacatactggtgaaaaacatttgaat

SEQ ID NO: 7608 - DNA, 505 bp, Diabrotica virgifera
  misc_feature (2)..(15): n is a, c, g, or t
  misc_feature (17)..(53): n is a, c, g, or t
  misc_feature (55)..(71): n is a, c, g, or t
cnnnnnnnnnnnnnngnnnnnnnnnnnnnnnnnnnnnnnnnnnnnnnnnnnnncnnnnnnnnnnnnnnnnntaacaccctatagagatttataaaattatgaggaagttttctttagtattatttcttattgatctaataaatttatttgattggattgcttaagaaatatatttacactttatttatattatgatattaataatgactaattagatcccaatgttttgattacacaaggtcaatatccttggggatgacagagtgaattacagatgaggaggtcaactcgatgactacagagtgaggacaccagattggctattacggttttcctttgtgtaagcgctatatattgactacttgttttcaatttataaaactttatggttcggggacgagaccactaaagagaaaaagtgaacccaacattgatttacactgactatatttaaggaatgagtggacctattatttaccctgattgttaaaattttgggaaataa

SEQ ID NO: 7609 - DNA, 519 bp, Diabrotica virgifera
agtacatctagatcgccagcgggcgcccacagattataactagtcctaacagataactctcgaaaaatactatgcacaactacttttgggaagattgtatgactatttaggttttaccgtaataagcgaggggatcttcgtagtaggctttatgaaatcagttattcgattgtgtcgatgcttagctcatgggtgctgattgataggcacatggacttaccaaataaggctgatgaatgaacagctttaccttagccaacacaactgcagacgcgttggtgatattaacaggaaattccctgaggggacggttagtcctttcggatgggggtgacagagatgctagtggggaagatactgaaacgagtatggattacaggaacggggacctacgagcagaccgaaaattggcgctcactcactctgacaaaaatctaaaccactatgatggagtcgatggcattgatcgcggatgggaaatgccaagaaccaaaccaaagaggatattgcggaactgag

SEQ ID NO: 7610 - DNA, 114 bp, Diabrotica virgifera
ctaaccccctttaaaaaaaggatctcgtagaggagaaataaccccggcaaattggttccaaaatcttggaaaagcgggagatcttggcaatacaaaaataatggatgacctctt

SEQ ID NO: 7611 - DNA, 780 bp, Diabrotica virgifera
aataaacaaaaaaagtggtaatagcctaactaaaagttaaaggttgaagtaaaataaaattagtaaattgataaattaaacagctaacaaaatcaaagcaaacaatctttaaatcaatacaatggaagtaaaacaagaacaagatatttttccggtagaaggatgcgagatgaaaacagaagttatggatttccccaatgattcttttcactcttctgttaaaactgagattaaagaggaagagcaccaccccctcatctatgaggaagaggaccaatatgtggcagattcgcttaacaatgatacaaaaagctcttttgttaatggctgctcttcaaaccaattaaacatggacatttctgttggtgatatcaaattggaggaggaggaggataaggctgaactagtacaaattgataatgggtgtctggagaaaaatacggaaacaatcaaaacatttgaacatccatgtcataacgagcaagatacgggtccgaaaaaatctcatcaatgtcagatttgttttaagatatattctcgaaaatatgggttaaacaaacatatgctaatccatgctgaaggaaaatctctccattgcggaatatgcttcaagagtttttttcatgcaagtgatttagaaagacatgcgagaacgcacactgcgcaaaagccatatcagtgagagatttgatttaagtcggtttcccaagatgggtatttaaaaggacatctcagttatccacctgaagaacaattatttttaaggggaaaaatggttaa

SEQ ID NO: 7612 - DNA, 711 bp, Diabrotica virgifera
  misc_feature (196)..(212): n is a, c, g, or t
  misc_feature (443)..(468): n is a, c, g, or t
atcgaagtccttggcggatcaccggcagcgagcacgccgcacgcgcttggccgcaggtacaggtcggaaccccggaagaagtcgacgtcagtcaacaccgagtggcacgtcgcaccgcccttttcatagctctcggcaacgtcttcaggaacgaagatctcgcgaatcacgccctcgctcggcgaagccttttcgnnnnnnnnnnnnnnnnncggccgcttttcctcggcccgctcgatcagcgcatcggcaaacccgcgcggtgcatcagcggttttcgccaggccttccagttcagccaggctcgacccgggcacggcgttcggcaacttcttctgcctcgcgggccaggattttctccagaacggtcggaacactcatccttcattctccactttgaacaccgcagtaaacgcacccagttcttcgagcttttcgcgcgnnnnnnnnnnnnnnnnnnnnnnnnnngcgagggcaacaccctctttaagaatgtaggcgtgatccgcggcatacagcgccgcaccggcattgagcacaatcatttctggcggtttctggccgttttcggtcttgcgacgccccagggcatcgcgaatcaattcaagggaggccgccgggctttccacggccaggccgtgcaggctctggcttttataccgagggtcttcaggttcgacaaataattcggtggactggtcatccttcagc

SEQ ID NO: 7613 - DNA, 533 bp, Diabrotica virgifera
  misc_feature (195)..(212): n is a, c, g, or t
gcctgcaggtagggctgggcaatactcggggcgaccccctcgtccgccgggacctcagtggacataggtgtatctgtatttattaattgtatttctatctgtcagaagagcttcaacgcaaaaatactgaatagatacctaactattatagcttagtatattgcaatgattcggtatacacttctaatgatagcnnnnnnnnnnnnnnnnnntctttcatttattaatgaacattatatttataatcacgcattcttatattagtaagagaaattatttttaaggatcagcttaataaagaaaatttatattatgatagaaattgtgggtaccagttcggctgcatcacattcatttattaaaaaaagatctagtttcttataatcaatatgagatataatattaatatagatgttttatgaaaaaataaatgcaccttatttgaagaacacgtctgctgatatatattcactgttaagacaattggaaatctaataatcttattaacgaataataaaggcactcgtaaacat

SEQ ID NO: 7614 - DNA, 198 bp, Diabrotica virgifera
  misc_feature (40)..(64): n is a, c, g, or t
  misc_feature (72)..(103): n is a, c, g, or t
  misc_feature (114)..(153): n is a, c, g, or t
  misc_feature (157)..(189): n is a, c, g, or t
gatcagttaattagtatccgtgagagaatcttttcttttnnnnnnnnnnnnnnnnnnnnnnnnngtacctcnnnnnnnnnnnnnnnnnnnnnnnnnnnnnnnntcatttattcnnnnnnnnnnnnnnnnnnnnnnnnnnnnnnnnnnnnnnnnatcnnnnnnnnnnnnnnnnnnnnnnnnnnnnnnnnntcgaaacgt

SEQ ID NO: 7615 - DNA, 752 bp, Diabrotica virgifera
tttggggaatatgtgctcggcgcatgtgatttgatatactttttttactggttgtcgcatattaactatcgttaataatcggccagcataaaatagtgaaaagataagagcctcaaattaatggtttattactattgtgaaagaattaattgacgatcattggttagttacctggataatataccccgagattcgtaggaaatttcctaacaattgaaactgtccgtccaacaatatggatgaagaatgcagatattctgaagccaaagaattgctcgattgcctagatccacttcttctgtacgatatcccagagattcgtgttatgaggttctgttatcaattgttcctctatatggttacattatcggacgatttcccctgaattacgtagctttcgaagttccttctatggctacaatgcattttggaaggctttccaagtgacgttgatgtaatcctcgatcaggaaagtgtgtaatgttagacggatcgtctggtttggaatagagtggatttttggctactttggctgccataatgtatctaagtccaacatagcaccctactcccccatccatctgcagcatactgaccaggaggatgttattttcccccaaatcgaccaccgttcccccaaatttaaagtggttataacgtcttatcacccctgcctcctaccctcgtttgtaaattaccccatggaaatacaactcggggcccgaattattatagaaaggatttttcattta

SEQ ID NO: 7616 - DNA, 402 bp, Diabrotica virgifera
  misc_feature (219)..(236): n is a, c, g, or t
ggtcctctgcccacgaatggatgagccctgtatgttagaatgcagaggcggtgggtatcgaggcattaatggtggagagtggaggaggggacgactgagcagcgagataggttctattcgagacctatttaggggctaagctttgttatcagcctttaatatgtgtgtacatatatgtaagaattaggactaaaaatgcgagaagacatatgatcgcannnnnnnnnnnnnnnnnntaggggtggaaatgtccaagtgtctgaggaagttttacctacgatgaaactatagaattaagagtatcggaaaactagagataaaacaggttgtattgggttccagagagagatagcgaatattgcctaatattagggacgctatgctttcaataatcgaggttaa

SEQ ID NO: 7617 - DNA, 739 bp, Diabrotica virgifera
  misc_feature (9)..(120): n is a, c, g, or t
  misc_feature (122)..(386): n is a, c, g, or t
  misc_feature (388)..(732): n is a, c, g, or t
cgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatc

SEQ ID NO: 7618 - DNA, 494 bp, Diabrotica virgifera
  misc_feature (6)..(70): n is a, c, g, or t
  misc_feature (99)..(149): n is a, c, g, or t
  misc_feature (185)..(259): n is a, c, g, or t
  misc_feature (262)..(398): n is a, c, g, or t
  misc_feature (402)..(448): n is a, c, g, or t
gggaannnnnnnnnnnnnnnnnnnnnnnnnnnnnnnnnnnnnnnnnnnnnnnnnnnnnnnnnnnnnnnnntccaggggggggggcccccgccccgcgcnnnnnnnnnnnnnnnnnnnnnnnnnnnnnnnnnnnnnnnnnnnnnnnnnnntttttcttcctctttctctttttttttgttgttttnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnnnnnnccctctcaatagatataatggggcgggggaggcgccccccccctcc

SEQ ID NO: 7619 - DNA, 107 bp, Diabrotica virgifera
agttcggacgtcggccttcacggtacaagctccatctccaatcgcttcaacattctcaactcccgcagcacaacgtaacagaagcaggagaggtgcccctttccagt

SEQ ID NO: 7620 - DNA, 604 bp, Diabrotica virgifera
cgctatacctctttctagaaagacaaaatgtgactgggattttggaattactactttcaagggattgcattttgggataggcgatctcagagaaagagtgattgcataataagatctcacacctatagtttatgagactcgcatgttctcagtaaaccacacagggacaaaggagagatgtaacatattaagcatacatgttacaatgtaaatgcatcggagcgcaaagattatgtgtatagtgtaagcagctatataagtaaagttttgctttaagctatcgagacatctcgctttgagataagaaattatataaagcaacccgggacctgcagtaatccgcaagaataaagcttcctctgacatggatataatacacaatgaaaaacataaaaggcctacgacataattgctgcaggaaaacggttccagataaaatacaaatgggtctccatataatggaatttatattgtgataaagttgtatacatctggtatccctagcacaaggactctttgaaagttgggttactgacagcagagagggggggtgagacagcctgacatataattgataccacccccatggaatcaaaatcaaaca

SEQ ID NO: 7621 - DNA, 875 bp, Diabrotica virgifera
  misc_feature (531)..(531): n is a, c, g, or t
  misc_feature (695)..(714): n is a, c, g, or t
taaaaaacatttattgatactgaaataaaaactatactacatcatctgaatgtggtttcatacatttaacaacataattaatgaattgtaagtcttgcattagctttgttaacctatttaagtgcctctctgtataaggaagtgctgattcaagtgcagacctaagtcctgaaggcttgaaagtatcattctgcatttcgtttaataagatgttaataacaagttgagctggatgtgtatgtttgctatttgtgttccaagtaatagcagttttaagcaaattgtccttttgatcgtttcttaattcttttatagtatcagctagtccggtttccccattttttattatagtctctacaattttcaacacttgaaaaggtttgtctaatttcaaagcttgttttagagctttcagatagtttccactcatcatgtagttgcttaatttttgttcttgtagagttaattcttctatttctttggagttttcttaagacgcagttcttctgtcacatccttccatttgattanaatagaatcaccaccgccggtcactaaaccagactcatcctgttttacagctacagcccacacttgtgcatcatgctggtctagtgtacatgtacactccgaagttttaactgaaaataacttaaaccaacccatctccaccgggactcagtatctgcattccnnnnnnnnnnnnnnnnnnnnctttaacacccaagcatcatgtccctttctaggggctttgaacaactataggccggttattggacccaccggttgataagcaaaatcacaaaaaggtgtaaaaaactgactttggtcttaagggggaaactttgtcccaacaccaaaggggtctttttttt

SEQ ID NO: 7622 - DNA, 325 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(315): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacgcgtg

SEQ ID NO: 7623 - DNA, 920 bp, Diabrotica virgifera
  misc_feature (300)..(319): n is a, c, g, or t
  misc_feature (685)..(702): n is a, c, g, or t
  misc_feature (812)..(836): n is a, c, g, or t
  misc_feature (850)..(850): n is a, c, g, or t
  misc_feature (870)..(894): n is a, c, g, or t
cttcgtttatatctcataagggtttgttatattattttcatatccaatttttgcagtgaggagaaggggtgaagaataaaataatcaatggttggaaactgtcgaaagctcaaagggttagaggaattttgtctgtacttcgtctatcttcttgtttttcttatataccttttcttatcttgtgtatattattatcattgttcaattctggctaattttgttgttgaaagttagatatgttccgttggtggtttacggaaacaattataaaattagagtaagtgtaaaacaacgaacagnnnnnnnnnnnnnnnnnnnnggtaaacaagcgtgcttcgtttatatctcataagggtttgttattttagcgagggtgtgactgcgctgcgtgcccgctgtgtccatactgaccgagaccacaacactattatgtcatcatgtatgcggttctaccatgtggccagaaaaggcgataaattattaaatctgtcgttttaaaagctgagaacctttctgtagtttttaagaggttgacataaagagcgcggccaatctggcaatttgtgtttccctaaaaaaacccttaattttatacaatctggttttgtattttaggaacgaaaacacatgaaaaacattagacgtattctttcgttttgagaaaagttaatatttaaaattagcnnnnnnnnnnnnnnnnnngaagcgtgtcactatagatatgttagacatttgacaatgacgttttatatttgacatgagatatgtcaaaagtcacataaaaagcacttgagggcatttttttgacaagnnnnnnnnnnnnnnnnnnnnnnnnncaacttctactctnttctacctttacaaacgtcnnnnnnnnnnnnnnnnnnnnnnnnntaagtaaatgtggaacaaaatggttg

SEQ ID NO: 7624 - DNA, 824 bp, Diabrotica virgifera
  misc_feature (473)..(490): n is a, c, g, or t
  misc_feature (792)..(810): n is a, c, g, or t
gattttgtacattaccgagtatactcgactttaacaaataaaataaggcataaaaacttctcggtaccttcggtacttacgcttcattttcggcttccgtacattcaatccctttttcgaaattcgatttccgataagtatttcttcactcttttttcagtaattcggtcattcttccgaaccgtcatcacaatctcgggaattcatcattcaagaacgaagaaacttcgtcacattcaaatttcggacttttttcttcgattttttttcgttaattcgacgttcatttccgtttaatcgtaatctttcaacaatttaacaatttaataatcttgcatgggaccttcccgttactcttaatttttcagtgcccgtcattttcagctaattaacgttaagtttagaagccaacgatatatttaagtattatatttaactaccgggcttaaacttatccaaaacataatataacnnnnnnnnnnnnnnnnnncagaaagatatttcttaaatcgaaaaaagggacatatacagtataacataaggtgaaaactagttggtttctaattaacggcagagaattcggagccaatttgggaatttgtaaacaattttcactctaatagttttaacattcttggtttctttaccacattttttctttaatctaataaaacggtataaaaagagttttaactggtacattatcttggtacaagtctggcttctgatcttttatattggaatataaagattggacaggttgccgataagtggttgataggtgatccaacnnnnnnnnnnnnnnnnnnncagtaagcaccacg

SEQ ID NO: 7625 - DNA, 103 bp, Diabrotica virgifera
  misc_feature (36)..(56): n is a, c, g, or t
ctagttctcattttcttgggctggtgccacgttgannnnnnnnnnnnnnnnnnnnngtttcatatatcatttgtaggtttaacaggaaaattttcgtcatatg

SEQ ID NO: 7626 - DNA, 773 bp, Diabrotica virgifera
  misc_feature (538)..(577): n is a, c, g, or t
  misc_feature (737)..(754): n is a, c, g, or t
  misc_feature (760)..(760): n is a, c, g, or t
accctttaagcataccgtagatgacggattagatatcagaaaagcagcttacgaacgcacgtacactccgttagatacattcctcgaaaaatcggatttagccgaatttattaatcatttagaaagagcatcgaacgatcattacgatatcaaaacgttaactcaccatataataattagaccgtcacagatatcgcccagaagctcgtattcgcaatcaatgaataagttactaggacctctaaaatcttcattagaagtgaaagtgaaagcaaattcggttaaacaagaatatgaaaaacaggaagaactgaagaagtcagctgagcaggtcatagctgtacttcaaagtataccttcggcagtagcatgctgaatagagaagttaatatgtaaagaatataatttgccaaaaatattacatcgacaaaaaaatacgttgtcataaaggcaaaggattagcagcggttcctgaacatgatgacgtacttcttcaagcatgaaaaaatcaccaaattataaaaagggaattttaacnnnnnnnnnnnnnnnnnnnnnnnnnnnnnnnnnnnnnnnntttcgttattttcttacctaatattattatttaacgttactggtcaaaataatccaatacctagtagatatattcattattttatatcattcttgtttaacattttcgaggaatatatttaaataaaccgtggacattttctataacttcctatcattcnnnnnnnnnnnnnnnnnnaaatanagtttttatatct

SEQ ID NO: 7627 - DNA, 232 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(229): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnncat

SEQ ID NO: 7628 - DNA, 448 bp, Diabrotica virgifera
cttcctttccaatgctcttcttggtttacttgttgagtataattttcgttgatagaatcgtgtcccgtatttgcactgctgtctgatgaatcagcggtactttctggatatgaggcttcatcattttgaaaatcaggatctgcaatattgtcgtcaaagtcactctcttcagataaatcggtgttccggccttccataggtgtattatgggcctcagctgtactattttccttacttgcaccattttgcttaccatttggataactatctttgttgttacctaagctacgattatgctgaaacaaagttataataggtaactagggtatttatacggtaaccagtatttttttgccaactgactataaaataatcgttatcaggatatatattagcttcattatcactacaccaacttaatgtctgactagcctagtttgtgttcact

SEQ ID NO: 7629 - DNA, 735 bp, Diabrotica virgifera
  misc_feature (4)..(62): n is a, c, g, or t
  misc_feature (93)..(132): n is a, c, g, or t
  misc_feature (142)..(207): n is a, c, g, or t
  misc_feature (215)..(265): n is a, c, g, or t
  misc_feature (271)..(307): n is a, c, g, or t
  misc_feature (354)..(385): n is a, c, g, or t
  misc_feature (392)..(418): n is a, c, g, or t
  misc_feature (458)..(522): n is a, c, g, or t
  misc_feature (525)..(611): n is a, c, g, or t
  misc_feature (620)..(684): n is a, c, g, or t
  misc_feature (698)..(716): n is a, c, g, or t
aagnnnnnnnnnnnnnnnnnnnnnnnnnnnnnnnnnnnnnnnnnnnnnnnnnnnnnnnnnnngggaagaggggggggcccgctgtaaaaaaannnnnnnnnnnnnnnnnnnnnnnnnnnnnnnnnnnnnnnncaccacacannnnnnnnnnnnnnnnnnnnnnnnnnnnnnnnnnnnnnnnnnnnnnnnnnnnnnnnnnnnnnnnnncgcgacgnnnnnnnnnnnnnnnnnnnnnnnnnnnnnnnnnnnnnnnnnnnnnnnnnnnagggannnnnnnnnnnnnnnnnnnnnnnnnnnnnnnnnnnnncgatatcctattatattctacttttctttttcctcacccgcaccgcnnnnnnnnnnnnnnnnnnnnnnnnnnnnnnnncccccannnnnnnnnnnnnnnnnnnnnnnnnnnggaacaccaaaaaaacgcaacagaaaaaagaacaacaaannnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnngggacaagnnnnnnnnnnnnnnnnnnnnnnnnnnnnnnnnnnnnnnnnnnnnnnnnnnnnnnnnnnnnnnnnngcccacccaccccnnnnnnnnnnnnnnnnnnntccccctctcctttttttt

SEQ ID NO: 7630 - DNA, 883 bp, Diabrotica virgifera
  misc_feature (623)..(623): n is a, c, g, or t
  misc_feature (787)..(787): n is a, c, g, or t
  misc_feature (828)..(828): n is a, c, g, or t
gggccggtgtcttgtatatggtggcctggggcacgcaacgcccagggcggcgatttctcttccggatggaccgcttgtcccacgtacaagtacttgatgaagctgctgatgtggatccctctttcgacctggaggactacgtacggcgcgaggatgccctcaattttcacagcagcgaggacattgaaatcgtactcaaagtcgatgagcccctgatggaagacggccgccctcgtcgccatccgctgcgcgaattctggctggcgcaggatcagcggatgcaggaatgcgagggcgggtttgaattgcgggcaacagtgaagccctcgaccatgttatggcaactgctgcatggttacggctgctccatcgagatcctgcaacccgactccatccggacgagctttgccgacaatgcgcgacgactggccgaacgctatacctgacctttgaagatgcagtcaggtgcggggccacgcgtacgcgagaagcaaaggcaggagaatttcggccttgccgcgcaaattatgcgaggccaaccggtccattgaggtcgaatttggattgatctgcaccaatttcgctcccgccgccagcgccgcataacaaagctcagccgcagnccggggattgggcaagacgtgccgaccgtcagcacaagggttggcggacgtagccaggatgtggcaggtcctccacaatgctgcctgcggcctttctccgtgccagagccggccagggcgcacaaatgccccgcagagccggcatgcgggaggcgccgaatggngtgtgctcagcggtcgagtggcaagttgccgccggtagggntgagaaacgtggggaacaccgcaggcaggacaccaggcatcatccaatctgccat

SEQ ID NO: 7631 - DNA, 960 bp, Diabrotica virgifera
  misc_feature (160)..(255): n is a, c, g, or t
  misc_feature (750)..(764): n is a, c, g, or t
agaggttgtgtagtagtcgagtgattagaattgtgattaaatttaaaatatggtgaaaagagaagacacagtgttgatagtacctacaatggctcgtacacctttaaaatcatctttttcaattagttcgatacttcctgaaacagctttagaggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcctgtggtagactgctcaaaatcagaagaaaaatcttccgaggataagaaatctaaggaaaagccaccgtacagttacaacgctttgattatgatggccattagaaatagtcctgaaaagagattgactctcaatggtatctacgaatacataatgtgcaactttccatactacagagaaaataaacaaggctggcagaattccataaggcacaatttgagtttgaataagtgttttgttaaggttccaaggcattatgatgaccccggaaaaggaaactactggatgttggacccttcagctgaagacgtttttattggaggaaccactggaaagcttcgtcgcaggtcaaccgcagcttccaggtcccgtctagcagcttacaaacgaacattatccatgtactcccccttacaaccgatgtacccaggattctatcctccatctccggcacttctagcagcagcttaccaaaggtaccacccgtatannnnnnnnnnnnnnngtacggccataccaaccgtcctgaggccatctccagtacaaccacaacctggtccacaaccttttagtatggaaaggttactcggggcaacacctagtgttgacttcttcagacaccttttggatctgtacagtagctttaggctgccgcctccgtctagtatgttagcgcatcaccaaatggcgttatcacctac

SEQ ID NO: 7632 - DNA, 823 bp, Diabrotica virgifera
  misc_feature (95)..(719): n is a, c, g, or t
  misc_feature (734)..(791): n is a, c, g, or t
  misc_feature (803)..(822): n is a, c, g, or t
gcattttgttttattcaattctagcacttaaatttggctgagagttctcaatttttagaattattccaaaaattgcgaaaataaaaagccagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatggtctttttgnnnnnnnnnnnnnnnnnnnnnnnnnnnnnnnnnnnnnnnnnnnnnnnnnnnnnnnnnngtgctaggtagnnnnnnnnnnnnnnnnnnnng

SEQ ID NO: 7633 - DNA, 202 bp, Diabrotica virgifera
  misc_feature (7)..(44): n is a, c, g, or t
  misc_feature (64)..(77): n is a, c, g, or t
  misc_feature (80)..(97): n is a, c, g, or t
  misc_feature (112)..(133): n is a, c, g, or t
  misc_feature (136)..(137): n is a, c, g, or t
  misc_feature (167)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnntaagtctggtcgacnnnnnnnnnnnnnnnnnnnnnnagnnttaaccgggtggagccaggttggtttctannnnnnnnnnnnnnnnnnnnnnnnnnnngaaaagga

SEQ ID NO: 7634 - DNA, 204 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaaggccca

SEQ ID NO: 7635 - DNA, 95 bp, Diabrotica virgifera
caatacagctaaattacgtacagttgtatacagtattgtttatttcttggtaaaaactcagtcgaagtgaaaaatgtttgttttgtctgatgaaa

SEQ ID NO: 7636 - DNA, 942 bp, Diabrotica virgifera
  misc_feature (83)..(116): n is a, c, g, or t
aaatgatttaatcgatgagtattcttcaagactgctgaaaaatattatcacaaaaggtaatcaagtcgaatactttgctacannnnnnnnnnnnnnnnnnnnnnnnnnnnnnnnnnaatcggaacagcttgcaattttaatccgtgatgttgatgctgagggcacaaaaatttatgaacgtgctatcgggctgcaccatcttaaggactgtggtgccgaaagtatagccaacgccatacaatcgatgttatcggataaaagactagacatagaaaactgcgttggtcagtgttacgacggaacgaatgtcatcagcggggtccaggcgagaattaaagatttagcccctcatgctacgtacttccactgtcaggctgatcgactaaatctagttgtagtggatgtgttgggtaacattgacaaagttaaagacttttttctacagttcaaactctatcgattcatttccaacactgctactcgccatcagctttttgtaaaaatacaacagaggatgaataaaccactactaaatttggaaaggactgtaacgtaacaagatactggttgaatgcagtatcgaaaattcgatagacatgccagaccattttagctgttctagatgaaggaaaaaggccagggcagagagtatcggaataaaagcgcagataatgcagaaaatcttcatatttctcctttgttctatggagaagatattaggcgttacttattgtctatcacagcagctacaagccaaagaacttgacttagcaacggccatgcatctaatcaaaagtaccaaagaagaacttaaaaaatccagaactgacgacacataccgagaggttttagagaaggctaatctttgacagtagtggtattttatttgacgacaaaataagaacggtgactgttcctcatagactcgctatgagcgtatta

SEQ ID NO: 7637 - DNA, 913 bp, Diabrotica virgifera
  misc_feature (821)..(821): n is a, c, g, or t
  misc_feature (826)..(827): n is a, c, g, or t
  misc_feature (837)..(856): n is a, c, g, or t
  misc_feature (874)..(874): n is a, c, g, or t
ccatccgcgtggggaactacattctccagcttcacgataccggaaattatagtactattcgttacgccgataattcaaatacctctctcgttcccgattatcgcttattccggacgttaagaaaaatgggaggacaagttttggatatatttagatcaaagaaaatttccgaaaatattgttgaagagtccagagatgtcggagtacatgaggacagagatgttaaaaatgagagacagcgagtaaacaatttaattagggatcctcaaaataaccgctctgttataacagttgagaatctacataaggtttatcaaaaaggtgttaaatctggtatttgctcacgttctgcggaaagtctgaaggtcgcaataaagtctatatcattggcagtagattcggcagaagtattcggacttcttggacacaacggtgctggaaaaactacggcaatgaaaataattacagctgaagaggcaccaacacgaggacgggtacaaattgttggaagaaacataacctccagcgctaatacagcattccagtatttgggctactgtccacaacatgatgcccaatggaaaaatataactgtgaaagaacatctagaattgtattctcacataaggggtattccgaagaatgaaattaaaagaactgttgacttgtacttaacgggtcttcaaattcacgaacataaagataaacaggctgaaaaatgttcgggaggtaccagaaggaagctcagttatgctatggctatgattggcaatccgaaaatagttcttctcgatgagcctagtactggaatggacccgcanagtannagatttttannnnnnnnnnnnnnnnnnnngtttttaggggttcaggnggagctattctttacacacactccatggaagaagctgat

SEQ ID NO: 7638 - DNA, 130 bp, Diabrotica virgifera
ggcggcctgcatggcggcgtcggcgaagtgcgttacctgggcgccgccgccccttcgatcaaacccattccctaccgaatttatgccgacgccgcgcgccgcatccccttggccgtggacgtgccggtga

SEQ ID NO: 7639 - DNA, 591 bp, Diabrotica virgifera
tcgcttgtgtatctgtctctatacggtatgcgtatacacatggtcgaatacctaatggttggttccgcgtactatgacaatacaggatgctcccagcaatggaagggaaattttgaagatgtcctatttcgaacaagatttccgaatatattgacgattagtttatggatacgcaggtatttgaccacatacttgctaaatattgctcatgaatgaacagctagttatttacggacactactgctgacaagttagtgatattaggaggaaattgccagaacgtatgtttaacctttgggatggtggtgatttagacgttattggagaaaagactgaaggaggtattaaatacgggaatgtgggacaaagagtaggccgaagattaccgactccctggactgaaaaagatctaaacaactatgatggtgtaaatggttattgttgcagagggaaaatgaccagaaccgaaacaaattgtttattgagacatgatctcaactggcttgtatcggattccaggaaaagtaggagtgtcctcaatatgaggacccaatggcaaaatataaatagtgaaacaacatcttgaattcg

SEQ ID NO: 7640 - DNA, 312 bp, Diabrotica virgifera
cacccacacaaatatcaggatcaactctacctcagctgcccatacaatctatcttacaaaatcacgaccacccctagactaatacacaaggactccgacaccaagatctcaccgcactctgaatttcatttgataacctaaccacacacactgacacatcaaccacgataggaaacggcattatctctagagcaacccaaatagactatctcaccattctctccctgaaattcgcaaatccctttgattgaaaaaacaccaacctaccatcctctgatcacaccagagcgacatcttgtttctcttttcccc

SEQ ID NO: 7641 - DNA, 704 bp, Diabrotica virgifera
aaaccatctcaatcactcatgttatttttaacgttttttacaatatgcttctttaaacttgtttatcttttatgtcactccaatgcactattttccaaaaattaccattgtttttgaattgatatcttaccagatcgggtcgacattacaaaaggcattagaagtatgtactaccactcgaattaaaatatgaactgtgtaaatttactttcttctcttctaagcgaaaaaaagctgaaatttttcgattttctcgcgattttttcaatgttccggtaagaaattttgtccgcaaacctcatattcggattcagcagcccaaaatccatatataatgaaagaaatcagaactaccccaaaactttcccactaggagtaaaaaattgactgaatcataagaactatgtcgtcggcgaatcgtagaggtgggagagccttttgtcgtcgacatttattcctttggcgtcccactcccaattgtttgaaagcatgttcaagtactgccgtaaagagtttgagagataacgtgtctccctgtctaattcctcttttgattttcatagatttggtatctttgtgtagtcggacggtcatgattgcattattgtatatgttcactattagttggagtttcatactgattatatattcttcacacataacgtccttatgagcgaacaatctctttaatattgtccctaaac

SEQ ID NO: 7642 - DNA, 749 bp, Diabrotica virgifera
  misc_feature (733)..(733): n is a, c, g, or t
cttgttttcattgcaggcggccacactcgattatttcaccgcgggtaactctgtggcggtcggcggtgacggcaaatcagtttgttgaacgcgctctccttgactagtgcaagcgcatgttgtgtgaacggtgatatctgttttagcacaagtcagtggaccgataggacaagcatggtgtgtgaaaaaagtgtcttgcaaacatgcgcaaaaattgttatataggcttatgaaaggaacccgcgtccaccaaaatgtggggccgagcgatgctgctcgtgctggtaacgtcgctttggctaacatcaacgaatgcccttcaagaagcagaagacagtcagttgaaggtcggaaaatcgatagatctcttcacaagatacgggtatctcactttatccatgaaggtgatttcaaggaacgaaaccgactggatcttcagggaaccaacaatagacatatttgcggatatcgagaggttcgccacgaatccggaacgagtaccaaaaaggcagaggcgagtattcgaaggagactttcacatggagttctgcgacaacgtagggcagttagttcaagcttatttcagagatttcacgttcgaaaaactcgatcaaccttggaaagccttcacctcctcttggacgaccgaaaccatcgggaggaaccttgggatcaacggatcctttattgccaaagaacattgttatgtagattagtgcggttatctcgcttntcgcgatgtcgttaag

SEQ ID NO: 7643 - DNA, 257 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (247)..(247): n is a, c, g, or t
  misc_feature (250)..(250): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattacgcgccngcncaacaag

SEQ ID NO: 7644 - DNA, 823 bp, Diabrotica virgifera
  misc_feature (55)..(74): n is a, c, g, or t
gttgaaaacgtgtagatgaaacattaaaaaaaatgggttttaaaatatacatcannnnnnnnnnnnnnnnnnnntcttttagaagtattatatcaattactgtttgtaaaacagagttagattattatacaaatgaaaactgttgggagaataatgacgacgatttaaatacgacgcaaatacttcgaaattggggtttcactgctgaggaatatgagataaatacagatgatggttatggactaactattattagaggttatgggactattactaatccaactccaattgttatgggccatgctgttttaataaatagccgaggatttttgtttttacaaaattcatcattagcttatcagatcatctcctcaggccatcaaatatttctaataaactttagaggtacagaatacagtcgaaaacatgtaaatcttacatctgaagatagggaatattggaattttagttggcatgaatcaggatattacgatattccgaaagtcttagaattggtatctaatataacttatggacagaaagcaatattagttggatattcaatgggaagtacgacaagtttggtttatgcaaccagctttcctgatgaagcggcagaaaagttactgggaatcatatgtctaggaacagcaagcttgtataagaatacaccatccttattgagggtagttgctatgttggaccctatagttgcgccattaggattaagattatggaacggaagatttcccattaaagcagagataggaccattatttgaactgggatcgagtgatccaattttgtacaatatgatggacat

SEQ ID NO: 7645 - DNA, 798 bp, Diabrotica virgifera
  misc_feature (703)..(703): n is a, c, g, or t
gtaagtaagagagacgagaattcatgcttttcgtctctatgtatgtttggaattggaatttcatgtgggctgcgacacgacacgatattgctgtggtggtagggaaaggtgttgacgtttaaagttcttacagcaacagtgtggaatttgtgattaaacggcccaatgggcgaacttttgtgaaatatcagaactgacaggcaatacttatcaacaatgaagctcagcactcaggaaaaacgggaattggataaatttacaaaatttttggctttaaaatgtactcagatcatcgtacagtccagacttggagaaaaagtaacaagcaactgcagatcacaaaccacaagcacggattggttcaacttgaacatcagtgatctcccggaagtccttgcggaaacgaaaagagttctcaacggcgaaatcctatcctcaaatctgcccttatgtgtcgaaatttctttgcgtacggtcgagggtgaccatatggtcctcgaaaattggtgtctgggcatgttgcccgaacaacagtgtgatcctaccacaagaatagtgcatacaatctataatcgtatggggactctgctaaaatcgctagtgtcgataacgcgagttgttcctgcttataaactgtctcgaaggcaagggcctgactcattcgttatatgttatcgtatatttttaggtgagccgttgattncatgtctcggagaagacttccacaaagtccagatttggtcagatctgcacacccatcggcacgttaaaccttttccgtttcgtaccgcaccaaaa

SEQ ID NO: 7646 - DNA, 81 bp, Diabrotica virgifera
  misc_feature (11)..(29): n is a, c, g, or t
  misc_feature (37)..(55): n is a, c, g, or t
ttagcagatgnnnnnnnnnnnnnnnnnnntaataagnnnnnnnnnnnnnnnnnnncatctgttttcacatcttaagccgac

SEQ ID NO: 7647 - DNA, 189 bp, Diabrotica virgifera
agcggtcgcccttttttttactggttgttagtcccccatttaaaataaaatatgagcatggatgatgatttcattgaagaattagtagccgaattatgataggttgtctcttatccttatggaatggggatggttcaactacgtttatatggttaggtctagtaatgatatttttagaagaaaatacaa

SEQ ID NO: 7648 - DNA, 784 bp, Diabrotica virgifera
  misc_feature (465)..(482): n is a, c, g, or t
  misc_feature (701)..(701): n is a, c, g, or t
cacttttattcacagtccaggacttgacaccgtaaagtaagaccgagaacacgtagcagcgcagtaggcggatcagcaatgttcattttaggtctccgttacataatacatcagacaaccatttaaaagtggctctgaccttctccactctggatctaattttaccgtgactatctgcattataattcaattgatatacaaagaacaaatttgatctactaactcaagtgtgctactatttacatatatacacggttttatattctgtagattatttattacgaatattttggctttccgtatcttcagatcccgatctgcttccttacagctctgccgtcctcaaataaagcgcggtatatgcagcctaattaaaaccgagaaatcgactctcaaagttttttctcaggactatatgttttgacaactttttaacgcaaaacatgttctaataatagttgaacnnnnnnnnnnnnnnnnnncttaaaaaatcctgtttttatcaaagctgtaaataaaaagtcctataccgcgttttaattgagcagcggacatattactggatcagaaattgtgccgtatctgcattttatgtgtaaataggattttttacaacgaaaaatagttaccaaaaaaagaaaaataaacagcttataattgtttattttatacgcaaaatacctaaatgtcataaatgttcnaaatacgaggtggcaacacgagtctcgataaaaactcggtaaatgcgctgtgctcattaaaactcactagacataccgctttt

SEQ ID NO: 7649 - DNA, 959 bp, Diabrotica virgifera
  misc_feature (185)..(198): n is a, c, g, or t
  misc_feature (200)..(217): n is a, c, g, or t
  misc_feature (263)..(283): n is a, c, g, or t
tgtcgtccggtagagaataaaacatttgatatacttcctaatataccagctaatatgcttcctatgaatccttaattttcaataaatgtaaaaactattgtaaaaaatggaccgcaaccttaatattgcgtctaaagttgggcctagtaggcagtgctaaaaatatcttcaaaaatttacaatgnnnnnnnnnnnnnntnnnnnnnnnnnnnnnnnnataatgcctacttagggaccaaactgataacttttttaaaatctgnnnnnnnnnnnnnnnnnnnnncaaattcaaagtcgagctatgaactaactctccctttttttgttcatggattttgacttttcattttataacttctatgtgcccttagcatacataacgaatatgccctttcttaacgtgccttatcaagtccttcacgttggcgattcacgctcacgttggcgattaacatagcatgtctttctatttcttgagttactctgaacagctgttctgttgtccgcatcccgatccattttctgatattatttaaccacgaggcttgttttcttcgaacttcccatgttcttcgattttatccatcataatcaatcgaagaatataatactgttgtccccgcattttttgtccaaggtatgcaattttgctggttatgacgccatcaatgatggaagaggaagaatgctgaagacggggaagaaatgcgaagtcataaaaacaatacaaacgagaaaactggaatatctagcccacataatgagagggaaaggtactccctgctaatgctcataatgcaaggaaaaattttcagaaagaaaaatgtgggacggagaatgatttcctggttgcaaattttagggaggggacgggtggcgttcataaaattgtttcaaattgcaccaacaagtaaaattgctggggcggaaccccccccccgatgggaaacgaatgcaac

SEQ ID NO: 7650 - DNA, 963 bp, Diabrotica virgifera
  misc_feature (334)..(355): n is a, c, g, or t
  misc_feature (730)..(730): n is a, c, g, or t
aaacaactgttaaagttgttctacgagttaaacatattccaaaattttgtaaaaatgtaatacatttttcagtgtttcagcccaaaattaggccacacacagtgcaataatgtgtcacaatgaagttattattttcacatttttaaactgtcaatatttttattttatcatttattgtttaaaaacaatacagttgataagataccctcagttgcggagaaagtattaataataaagattttttattcagtcaatggtgtgagcactgtcagttaaatagtaacgtgtggtctaactgttacacacatacctaggtactgtggcaaatgtatcnnnnnnnnnnnnnnnnnnnnnnacatttaagtcgtagaacagttttaacttttggttttaatacaggtttcaattctctgcaaatgttctctcatgacttttgatgtagaatatttggggaggcggggattcgacagtttagaattgtacgttacaacacccggtatacaattgtacgttacaacacccggtatacaaacttttcacaagaattattattaacaaactaaattccaggctagatatacatataccaatgacataaacaggtaggatttaggccatgataaatatggtacaaattatcatttacaagtattaaagaatctgttcctcttctgagagtatggaatgtggaggcacggcacactattctgccagtcgacttctctgaggnatctatcatataatttcctatgtatgttttccatcttacagagggccttcctctctgtcttcttcctgtcgagttccagttcaatattttttttcgaccacctgtgctttggcattccttgtacatgcccgtaccactaaaagagatctgattttctactttttttgtaattgagcattctactttcattctcttccatattttctctgctcttatatatacctactctatgg

SEQ ID NO: 7651 - DNA, 627 bp, Diabrotica virgifera
  misc_feature (2)..(159): n is a, c, g, or t
  misc_feature (161)..(245): n is a, c, g, or t
  misc_feature (247)..(298): n is a, c, g, or t
  misc_feature (300)..(326): n is a, c, g, or t
  misc_feature (329)..(392): n is a, c, g, or t
  misc_feature (396)..(416): n is a, c, g, or t
  misc_feature (418)..(476): n is a, c, g, or t
  misc_feature (494)..(549): n is a, c, g, or t
  misc_feature (559)..(610): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnncnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnncatnnnnnnnnnnnnnnnnnnnnncnnnnnnnnnnnnnnnnnnnnnnnnnnnnnnnnnnnnnnnnnnnnnnnnnnnnnnnnnnncacaattgcatattcacnnnnnnnnnnnnnnnnnnnnnnnnnnnnnnnnnnnnnnnnnnnnnnnnnnnnnnnncaaaacctgnnnnnnnnnnnnnnnnnnnnnnnnnnnnnnnnnnnnnnnnnnnnnnnnnnnncccgcgatattttgacc

SEQ ID NO: 7652 - DNA, 958 bp, Diabrotica virgifera
  misc_feature (689)..(689): n is a, c, g, or t
  misc_feature (851)..(869): n is a, c, g, or t
ccccaagctggcaaccctgactgccaacctttcttaccatattacatcaagatacaagcctgaagtaccttttcaagtggacatttgcccacgagacgaatgggacagaggaaactgacgactcagactgcagggttacacctggtatacggacgggtctaaaactgtagacggttggggcgcaggaatattctgtagtggtgaaaatttcaacatttctattccactgggagaatatacctccgtatttcaggcagagacttttgcaatcttgcaacgtgcaagagaaaacagcctgagggcattcgaactgcagcgggttaacatatgcacagatagccaagcagccattggggctcttataaaccctaaggtgaactctaggctggtgtgggaatgtcgacaagaacttgacagactggcacaacataacagtgttatactggtatgggttccaggtcatcggggcatatacggcaatgaaagagctgatgcacttgccaagagagcataagctacaaaatacctgggtccagaaccggccgtgggagtgccaaaaagcaccgtccgcgaacgaaaaaaaacctggatccgaagccaacacaactcacactgggagagtgtacccggtcaaacacatggcaagatgtaaagtgatgagcgcgctgataaccggaaaaataggcggntatcttctatccttccctgactatgactatactctctcatcctggccgcattaaattcacttcttgcccattccatccgtattgaaagttcgttgatataaacataaggtgaaacagtagcgatcaacaggtagcgaaaacgcgttccaagattgcggctgnnnnnnnnnnnnnnnnnnngagatatttggcacacgtattcgtatataataaagaatggcggtacagagcccaattttgaaatatattaatatgtggaaaatactctg

SEQ ID NO: 7653 - DNA, 830 bp, Diabrotica virgifera
  misc_feature (818)..(818): n is a, c, g, or t
tttattagaaagaatgtcagctgttttgtacataatctactcgcatgtttaaaaactggaaaagggccatattaactaaatacattaatatgtgaaggaatttatgcatttgaaatggcttctgccaaatcaccagattctagcatttctttaacaatgtccaaaccacctacaagctcaccactgatatataattgtgggtatgttggccaatcagaatatgtctttagtccttgacgtacttcttcatctgagaggatatcaaatgtttcatatgaagcattaacactgttcaaaatatctataatcttcctactgaatccacatcttggtacatctctatttcctttcataaataacataactttggatttattaatcagtgcttttaatctttcttccaatggctcacttttactatcacccgaaccgctactatgtttcttaactgcctctgctatttttaaagtatcagccccatttataacttccacattcttaccagactgaaataggatgactgttggtacagcttctatattatacttgacagaaacttctgaaagctcttctgcggggcaagaatagaacttaatatttgaatttgcttgttgagaagacaaagcttccagtaattcgtttacttgagcacactgttctgcccattcggcttgaaaatgtaccacggatagattagacccttttacggcgtcatcgaatgcccttctgtgttttcaattctgataccattctaatttctgatgttttatagttttattatatttccagcaatttaaaaactaagggtagatactagntctagatcgcga

SEQ ID NO: 7654 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7655 - DNA, 771 bp, Diabrotica virgifera
  misc_feature (549)..(566): n is a, c, g, or t
ggccccccccgccccccgctctagtgttgcccctagcgtaggcaagaatttctaggaggcgaatacgacagatctcaactggggataggtttcacttcgattttatgcaagctgatacgagtaaaggtcgcttatgggacctatgcatgagaggtgccattgcctatggtaccaaggaaagggacaaaacaagtcatcacagaagacgcagacgacattcgagaaaaaccttgaactgaatgaatatactggacaacaagattccttgtctcttcatgtatttacaaacaaactaccccctaaaaaatccagactgaaacctgtgatgctgtacattcatgcatgaggatttataaggggatctcacgaaaactacgatgtatggccccgaataacttatgagtgaacacatatttctcgtaattcgtcacgtacagaattggtctagctggtattttcttaagaagagagagatcaatctctgtacgttctctggaaatgcaggtctaaaagatcaggtactgtctttaaagggagagcacagcgatnnnnnnnnnnnnnnnnnngtggatccccgagaacattagcctgatttggaaaatggggcggagagtcccttcctgggtgaaaatatgatgttatccccccctcaatccagggatctatactcataagggcatactttcctcgaggggggggcgaactgtagacttccacggacctcattaaaagaacccccctggccaaacctgaaccgtgcgggaggcctaa

SEQ ID NO: 7656 - DNA, 968 bp, Diabrotica virgifera
  misc_feature (773)..(773): n is a, c, g, or t
  misc_feature (953)..(953): n is a, c, g, or t
atcgaatacaaaatggaattccgcagcaaattcacctataactcctaaaactagtacaccaagtagtccagcaaagaaaattacttctacggcaactacgaacgataagtctaaatccctacaacaagcaccgtcatcatctcgcccatccgccaaacagcaaagcccccgatccgtagtaactcgagacgatctcaccgaacgtaattattgtggcagaagattcgctgaggatcgagttcaaaagcacgaggaggtttgttcaaaaacgggtaagaagaaaagaaaagcatacgacgccacaaagcacagggttatgggtacagaattggaatcatatattcttccctccaagggaaaggccaaggcaaataatatgaaggtgtctaccaaaaatcctccaaagaaagactggcgaaggacacacgaagagtttatagcagctatcagagcagcgaaagaggctcaaactcatctggctaaaggaggaaagctttcagatctcccacctcccccaccatcgacaaatcccgactacgtccaatgtccacattgcaatagaagatttaacgaagccgctgctgaacgtcatattcctaaatgtgcagattaccaatttaataaaccgaaacctggcgcatccaaaacaaaaccaacttatggcaagaaataaatatatagcctggcttaaaatttaattcgaatcttttctgatgtcaaaacgctcgatctgcaagcgcttaatagtacagtcagaattttttaagaataanaatatgacaactaaagattatttatttttctactttatataacaataaacattactacctttggtggaatatattagcatagttcgttaccgtaaaaagatcaagaagcccctaaaaatttcgtgtaaatacagcatgttttaggtaaaaacttttactatagtacaaagaaatagacanaatggttcctttttg

SEQ ID NO: 7657 - DNA, 773 bp, Diabrotica virgifera
  misc_feature (501)..(520): n is a, c, g, or t
  misc_feature (644)..(665): n is a, c, g, or t
  misc_feature (714)..(734): n is a, c, g, or t
tacagttagtgcagaaatgtgaattcctcgaaactctaacaaatatagctagaacatttcatgttaaagagcggtatcttaatgcgcaaatctgatctctgctactttttctccctgatcttggtcttatctagtctcagaatacttcgtaaaagcatcatggcaatattcaaattatttgcaataaaacatatactgcgaccatcttcatgtaatgttacaacttttgcattattttctgtagtaatactaacacgatttgaaaacactaatgaagagtgatctgaatttgtcaaaataaacgtgtaaacgcaataaaaaatacaaaaaatctgtggctagtaaacaagataaagtatcatttttgccaaatatcaaaacttggtttcaatggtgacgcgatcgtttaaaaacattaaaagaagcgtttgtattcttatgaatgaacgttttttatcattaatattatcttcctccccatgaaaaccacttacactgacnnnnnnnnnnnnnnnnnnnncaaaatgcaagtgttttgatttttttgactattagtgtagatcacaagaatcatatttgtgtaattaaaactcacaaagattataaataacaacttattaaagataaagatgttttgttacgcnnnnnnnnnnnnnnnnnnnnnngccacaacataatagcataccagaaatataacaagatagaaataaactnnnnnnnnnnnnnnnnnnnnnattttattctgtcatttttgttagcggttcctcactgat

SEQ ID NO: 7658 - DNA, 326 bp, Diabrotica virgifera
cggcgccccccacgcccccgctcgatatatttattgatagtgaattataaactatactacatcatctgaaggatggtgtcatacatttaataatatacgtatagaattgataggtcccgcattatctttgataacctagttatgtgcctcactgtgtacggacttgatgattacaacgaagacctaaatcctgaaggcttaaaagtgtcattctggatcacatttaataagaagtttctaacaagccgagctaggattagtattctagctattagtgtcccaaacaacaatagtactacgtctattgaacttttaatagttcctta

SEQ ID NO: 7659 - DNA, 1137 bp, Diabrotica virgifera
  misc_feature (800)..(819): n is a, c, g, or t
  misc_feature (1024)..(1063): n is a, c, g, or t
  misc_feature (1098)..(1117): n is a, c, g, or t
gtacatctcggttgaattcccagtttttttataatacatatttgtcggatcttaaatatttgatctcgtgttccatcacgaaagcctcattagcagtcgtctagaatatcttccgaataaaaatacctacccgtcggtaatagtagttcaaataaacatactgttgcagacttctttcattaaaaaaagaagaataatcatgggatatttaagaaactttttctacccttattgtgtcatttattataaagcaaagaatactcagaatagtctgaacatccccacctgattaaaaggaaagcaactgagagcaatattaaagtattttattgaaacttatatcgtattctgaagtataagaaatgaatttttaacagagctcttagatcaactcacaaattacttttacgtactgccagtgtctcttaaagcttaaaaacatgtaccatgataatattatctttttttacttgtttttagaataacttttagttgtctcgaaaatgttttaaaagcagcaccgattataaagttactttaactgaaaactgattttagcaataaatactagtaataattaatcagggtataaaggaacgcttagaaagttggatattttagaattatctaaaaaaggaaacatcccaaaagtcttcgacttaaaaaaaattaatgattttttgtttctttttgccagtatctttaatatggttttaaggtttatcattactcaagcactgcatctgtcagccatattttggtgatgctgcattaaaaattttaatatcacaatattgtgnnnnnnnnnnnnnnnnnnnnggtgtaggacacttattgagcttagaaattctgagcttatttatctattccggttcatttcttgcaatttttacgccgaattttttgggttttttgttttttttcccaccaaaatttacccccttccgctaatttccaaatctcctgggcaattccaattttgggggctttggggccccccaaaaatttttggctttcaaaaacnnnnnnnnnnnnnnnnnnnnnnnnnnnnnnnnnnnnnnnntggggacaagcctttccccccgtttttaaccctcnnnnnnnnnnnnnnnnnnnntacaaaaccctcttttggtg

SEQ ID NO: 7660 - DNA, 1255 bp, Diabrotica virgifera
  misc_feature (136)..(155): n is a, c, g, or t
  misc_feature (687)..(759): n is a, c, g, or t
  misc_feature (957)..(957): n is a, c, g, or t
  misc_feature (1137)..(1183): n is a, c, g, or t
cagagaccgcatgggaggcggcagaggtggcggtggccgtggaggcggcggcggcggaggccgtggtggcggtcgcggcggtcttggaggccgaagcggtggaggagccggaggcagaagcggtggtttcggctcnnnnnnnnnnnnnnnnnnnnctcgaagcggcggttttggttcgggcggcggtcgaagcggcggcggcggtctaggaggtggttctggagatggcggatttagatctagagatactagcgcaggacgaccttcgaggtttagtgcacctggaggcggcagtgggcccgccggtggtggtggcggcgctggcggaagtggtggcatgggcggtggccgaatgggtggaggtcttggaggcggcagagctaatgggtttgcgagtcgagcagcaccctactaagttaaccaacgttggaggaaacctctcagtgtatcagtattcttcagatgcattcccgtgcgtccctctttagatcgtttaataactttatttaccacaaaaataatctactgccgtctctctgcagcatgtcgttccatgtttctagttttaagagatcttgaagattaattaaacttatttaattaattactaaaatggtgtaaatctgtgattagattgatcgatgattttaattttgacttaatataatgtaatctattgatgtagtnnnnnnnnnnnnnnnnnnnnnnnnnnnnnnnnnnnnnnnnnnnnnnnnnnnnnnnnnnnnnnnnnnnnnnnnngcccgcctctagaggattcccagtttttcctacgcgtggatgcgaagttttagcttttcttattggggtccccctaatttcatttccctggcgcgtctttttttacaaccgcccgggttgggaaaaacccctgggggttacccactttttattgcctttgaaccacttcccccttttccccacgttggcggaattacnccaaaagggccccccccccatctcccctttccccaccagtttgggaaccccttgaatgggtgaatatggggcccccgtccccggcacccgggtctcttttatggcccgccgggggggtgggtggggtaatcctcccgggcttggatccgccttcccttttctccgctgccctttttggtnnnnnnnnnnnnnnnnnnnnnnnnnnnnnnnnnnnnnnnnnnnnnnnacgtctttaaccagggattttctccccctgtccttagcctttttaatacgtggggggtccctcccctttttt

SEQ ID NO: 7661 - DNA, 257 bp, Diabrotica virgifera
  misc_feature (11)..(39): n is a, c, g, or t
  misc_feature (50)..(84): n is a, c, g, or t
  misc_feature (86)..(102): n is a, c, g, or t
  misc_feature (114)..(136): n is a, c, g, or t
  misc_feature (139)..(163): n is a, c, g, or t
  misc_feature (172)..(204): n is a, c, g, or t
  misc_feature (222)..(254): n is a, c, g, or t
ttagctaatcnnnnnnnnnnnnnnnnnnnnnnnnnnnnngaaggggttgnnnnnnnnnnnnnnnnnnnnnnnnnnnnnnnnnnncnnnnnnnnnnnnnnnnnagtaaaaagctnnnnnnnnnnnnnnnnnnnnnnnacnnnnnnnnnnnnnnnnnnnnnnnnnctcaagttnnnnnnnnnnnnnnnnnnnnnnnnnnnnnnnnncatttaaatgggcggtgnnnnnnnnnnnnnnnnnnnnnnnnnnnnnnnnnata

SEQ ID NO: 7662 - DNA, 766 bp, Diabrotica virgifera
  misc_feature (231)..(246): n is a, c, g, or t
ggacccccccttccgccggtctagtggagtactagagttaggcgatgttttctagaaggcaatatgacctatcagcaatggggataggtttcattgcggtcctttgtatgccgatcaggagaagatagcacctccaagagacctatggatgaggggtcgcatcatctaccgtcaacatgataaaggatacaatacactatcatccccgtagaccaaactgacattccagannnnnnnnnnnnnnnntaaatctaagtggagaacaatattcgttgattctctcgtgttttgacctaggaaactaccccctaacgattccagactgttccgtgtgatgagatgcattcctgcatgaggacttataaggcgatctcaagatacgcacatgtatggtccctaataccttaggagtgatcacatctctctcgtatttcatcagatacagaatggagtcgcgatgtggttttcctcaagacgacaagacgaaacgctgtgacgctcctggaatatgcaggtcttaaaaatcaggtggctgtcttcaaaaggggggtcaaacgagtcttatagacgatttcgtgtagaaccccgagaacattaaccagaatttctcctaaaatgtggcggaagtggccattttgggtgaaaattttggatttttattccccctagaaccaaaaggcacaatatcactaaaagacatagcatcccgctggggggggccaacttctagaagccagcaggccccattatgggaccccccccggcc

SEQ ID NO: 7663 - DNA, 580 bp, Diabrotica virgifera
  misc_feature (223)..(242): n is a, c, g, or t
agggtatgcacaagtagaattcaaaaatggaaacaaatattcttggagaaaagtaactacaactatacataatattattgtaggaaaattgtgggtagatcaacatggtgatatggaaattgtgggaaaaggtcctacggagggtataaaatgtgtactaaaatatattccttattcctattttactcgagattctcaaagacgagtcaaaggtgtagtaatnnnnnnnnnnnnnnnnnnnnaatggatcattaatggcacatgggacgatcaagacgagatagctatcaggtactggcaatacaggtaccaatggaaatgctgtctatgaatactggtccaccagttgttgattggaagcgaaaaccaccattgtccggattctgacatgttttaccattccagattgatgactgcgaattttaatgaaccccagacatggagttatctccccctgaatactaattgaggccttgactcccggacctattgcctcaaatggacggaagaaatttcaaaaataagacttcaacattccccttgaagaaacagaaaaatctcttacatctgtcacaaattc

SEQ ID NO: 7664 - DNA, 189 bp, Diabrotica virgifera
ttgacatctgagaggggctgctccctcctcttctcttttttgtcgctttattgaataggcaatttctagagaatgccagccttctaaatgatgtcatcatgacatctcccttcctaaaataataatacaacattcgctagaaaagaagatgtcaagaagttataagctattacaaaaaaaagaaagaaa

SEQ ID NO: 7665 - DNA, 430 bp, Diabrotica virgifera
  misc_feature (6)..(28): n is a, c, g, or t
  misc_feature (219)..(264): n is a, c, g, or t
  misc_feature (297)..(318): n is a, c, g, or t
  misc_feature (334)..(352): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnngaaaacaggtaaatttattttttagtgaccccnnnnnnnnnnnnnnnnnnnnnngataaatgtaatactnnnnnnnnnnnnnnnnnnngggagctcgagaggatgctagagttacgctggggtgcatgaagatggcttacatatctcgtagcgccaccaaaatcga

SEQ ID NO: 7666 - DNA, 955 bp, Diabrotica virgifera
  misc_feature (74)..(94): n is a, c, g, or t
  misc_feature (858)..(858): n is a, c, g, or t
cagggattaagatatgcaattttatatacattcacactgttgccacacatctacaatcgctttttatggagtgnnnnnnnnnnnnnnnnnnnnnttgaaataataatatagaaaaatgtgaaaataggactttcggtggtgtttggcccgttgattcattaacagtgatctgtaggccattgcgaagaactgaaggtattggtcccagtctcgctggtgattggacaccatctttgtcaaatacttgccgactgtcttattcattcgctctaccatttcatccgattgcgggtaataagctgtagtccttgtcttctttatgcctagtctatcacagattccctgaaatacatcgctttcgaagttccttctttggttactatggatctccaaaggcactccaaatcggctgatgtactctttgatcaacacatctgcaatagtggcggccttctggtctggaatagcgtagatctcggcccattttgtgaagtaatctattacgaccaacatatacctacttacaatcatcttcactttctgataggagcctttattttccggtacgatccgttactcgtagcacaagtagtacatttcttacaccagtcctttacatcgttggaattattcatccaataaaaccgttcccgaattctctgaaggattttctttacaccaagatgccctcctaatggactgtcgtgtaactgacgaagtacttcggctattctgctcttttgattcaccaattgttctctccgctgaagcgtcatcattttccaatactcgttaagcaagctgtcctccatgataatagagtccctcttggcccatacggcttgatatttcttgccnagatgatcgacgattttcttttgtccattttcgaattttctggatctaaaattggcccatttcgcattttaattacttacgacactaaaacaccaaa

SEQ ID NO: 7667 - DNA, 685 bp, Diabrotica virgifera
  misc_feature (333)..(350): n is a, c, g, or t
aagatggacaggaacagtggattaccatcgaatcaactgccatatctatgttcttccaggtacatgataaagatcttgtgcccgtcaccaccgctgaccaacgtgataaagatgagacaggtttcttgattaaccttattgactctcctgcacacgctcatttctcatcgaaagtagtaaattgtgcatctggtgtatgtgtactcactgaaactgtactccgtcaagtgtattgcagaacgtattacctcaattttattcttgaacaagatgcaccgcgccctcttacaattactgttggagtctgaagaactttaccagactttccaacgnnnnnnnnnnnnnnnnnncgccattattgccacctacaacgatgattcaggtccaatgcgtgaactcaaagctgaccccagcaacggctcagctggatgtggatccgggctcctgggtcgggatatcgctctcagacacttccccgagatggatgccgacacgttcttcatctgagcgagtaaactaatgaaccgtgtgagaggggagaacttcctcaaacgctgacatctcacatgtatgctacacctcgatggtgacctcacactgtcatactgtatgcacgtcctacatgcactccactcgacgctagactccatcatgccctacactagagaataatatcaatcactcc

SEQ ID NO: 7668 - DNA, 1004 bp, Diabrotica virgifera
caccaattttctaaatttcgaactgccaactgcccccatgttatacaacaacatttaagtcctgcaatcaaaaagtcgtacaaattttgcttatttttaatttagaagtatggctttacgttcacaccatatgaggtattttaggttatgttcgaacatcaataactttggttttgtaagattttcttccaccgctggagtctcaaagaaaggattagtcttgggcgttcgtaccagtagtactgatgaagttatactgactccggcagcaacaaaatataatgaaatatctcaaggaaagctcctacaacaattcaaactcgctggaaacgaaatcaaagcaggaaaatgttttgtattttgggggttagatccagaatataatgctgttgctgttacgggacttggtaaagacactgacaaacaagatgacattgaattaatatgccaagaaaacgaaaatgtaaggatagctgcttctgccggatgtcgagcactggagtcggtgggggttaaaaatatcgacgtggaggacttttgtaatgcagaagcagccgctgaaggaagtaatttaggcatttggaaatttcaagaatacaagtcaaaaaaaagaaagcttaccacaagtacagctttctcaattaaacggttctggagttgctgaggattggcagaaaggagttataaaaagcagaagcacaaaatttggctagaaaattagccgacacgcctgcaaatctcttgacgcccaccatttttctccgaacaaggcccatagaattttaacgcctttggggaatcgatgggaaaatttacaaaaaacaatggggtgaaacaacagaaaatgtttctccttttcctagggtaaaaaagggatccggaaagcccccgaaaattttaaaaaattccctaacaaaaaaaaggggtttttttgggaacacccttaccttgtgggtggaaaaaggagttacgttttgtggtgggaggaaaaaattttaaaaact

SEQ ID NO: 7669 - DNA, 914 bp, Diabrotica virgifera
  misc_feature (701)..(722): n is a, c, g, or t
ctcttccccgcgtccctctttcgcgcgagcgattcagagagatgtctatactgcaggcgcatgctgccctacaccattctcctatatgattgagatatataggtaaatagatagcttattatgtcaatagaagcaccgaggttgctagtagaaatgcaaataaaatttctgtgacttttatgtcatgacaaaatttactaaaatatccctgaatgaccgagagatactcagagatatgtatgacggagttgttgatgaatgttaaggagtagaatctccttttatacacattcacaggtggtgaaactgcagtaatcttaggtgaagtgcggcggaggggataactaagtgtcgaaataggtgctacctacacgctttccgggaagacatgtgtgagggtattaaatgttaagtacatgtatttaagaactagggttgtaatgctggcggcggaggacggaacgagaaaagaaaacacctatatgggtggaaatgtttatgggtgtggatgttgagttacgtataaactattgaattacagtattggataataagactcaacctgtagtaccggactgccatggagcggggggaatttgcctcatattaggaacccatggctaaattgaggggttaaaaaatatctagggagaggtaactgacataaggtttttgttcgagagaaggaagattagatatcnnnnnnnnnnnnnnnnnnnnnngcgaaggggtcccaagtcccagaagtaaaacatgtagaggttgagatatttttctttcataaaacccaagaaaaattcccatgatgctctcgaagatccacacgttatacctaaaaattccttctcgaaaaacttccaaactgaacatttttccttcctcctcaagaatgaaaaataaatatcccggaataa

SEQ ID NO: 7670 - DNA, 845 bp, Diabrotica virgifera
cagcttcattggtgtcggtacgaccgcctttgaattaagcaaaccatcgtataacggttgtaatcgatggagcagagtcccggtaacactttttgaatccattgtttataaaaatcacaaaagtagtgtcacttcaaacactttaacccggtaaataataatcttcttctttagtttagtggcctccacctacttgggtatttaaaaaatccccttatataataatcctaatgacacgaacattttgacagtatgtttttgaaggttaggactaccaaaatgacaaatgaaaaattcattagagtcgccatctcatggtcaagcccgggacttattgacgaccgacgtgttagatttagtttagctgtatgaaaaataaatattgtcctccttattttcttgaagcgatcgttaatagagcctatatgataatgcaattatatcaaatgaatcatttttatttatgattgcggtaattttacaaacataaacatcaactcttgatctctaaaatttgtacaaagttgacaaacttgaattacggttacatttacaacggttgtctactccgactaaccaatgaacattaaccacgcgattacgtcacgagagtacactaatttgaatcgtaatatgattaatcagtatttttatgtctttgatgcacggaaaatagtaaagataggtgtaaaataaagatgtttagtggattataatacctaattatggaaaactgttgatatttggttgcctcggtacttaaaactaatcaggacgggttggtcatggttatctaacggttttcatcatttttcatcatactggatttactgttaaatatatac

SEQ ID NO: 7671 - DNA, 339 bp, Diabrotica virgifera
  misc_feature (18)..(40): n is a, c, g, or t
  misc_feature (42)..(55): n is a, c, g, or t
  misc_feature (130)..(158): n is a, c, g, or t
  misc_feature (164)..(190): n is a, c, g, or t
  misc_feature (272)..(294): n is a, c, g, or t
gttcccccacaaaaactnnnnnnnnnnnnnnnnnnnnnnntnnnnnnnnnnnnnnggggggcgcgcagtgggggtaacctccaaaattggaatctccaaccaaccgggaaaaaaaccctctggaagaagnnnnnnnnnnnnnnnnnnnnnnnnnnnnncacagnnnnnnnnnnnnnnnnnnnnnnnnnnngttattggggggggggggattttttccccctttttttaccccccggcgcaaaaaaaaaaacatcgcgcgcccccccctacannnnnnnnnnnnnnnnnnnnnnngatatttgttggtgtgggggtcgcgtcttcccccccctcctcccc

SEQ ID NO: 7672 - DNA, 712 bp, Diabrotica virgifera
  misc_feature (59)..(59): n is a, c, g, or t
  misc_feature (105)..(105): n is a, c, g, or t
  misc_feature (131)..(163): n is a, c, g, or t
  misc_feature (226)..(245): n is a, c, g, or t
  misc_feature (297)..(325): n is a, c, g, or t
aaaaagcaaagagaaaaaagaacacgaacgacgcgggccgagacaagaaccccacaggncgcgaaacagaagaaaagacccaggcagcagaaacccgaaaacaanaccgaagagggaacaacaaagaaacnnnnnnnnnnnnnnnnnnnnnnnnnnnnnnnnnggcaagacagaggaaacaaggaggacagctgaacaaatttctatagataatccaaactttgannnnnnnnnnnnnnnnnnnnctccagactgtacggaaattgaacaacgtccttatgaagtgaaggtgaaacnnnnnnnnnnnnnnnnnnnnnnnnnnnnngtatgtaatacagaaaaaacaattagtacacatatagaagttgcgatagataatcctacctttgatgcaactgaaaatgaagatgctccaaactgtgttggaattgaagaaatcccttatgcagtgaaggtgaaaaagaagaataaaaagtcgaaaaaattctagaacttgacattccaaatttttgctgatacgcattaagattcaataaatggatctcaaataaaagaaaatccgaatgaagtacaactaaatattaagattatgaataagaacgataacagtttggctaaagataatgcttctttttgtaaataccccaaaaactcctatccatagggtggactccttatgaatggctaacccaagaaaaacaacaagggaaaa

SEQ ID NO: 7673 - DNA, 602 bp, Diabrotica virgifera
  misc_feature (170)..(187): n is a, c, g, or t
cctacaatttttaccaaaaacaagaacgaggggcctatcttcgggaaggggggaacgcccgggggcaaaaacaactggtccctggatcccgggagagggggggggcccaaaattagggttttcggccccaaaagggtttaggggggggggaaaccccggggatttggacnnnnnnnnnnnnnnnnnngaaaaccccccccttagggcccctttaaaaaaagaagtggaaagtttttcgagaaacagagttggttggaagggaatttgggttaccccaaattacggccatacgggggaatggcaaactcttaacaggaagctcaaaaaggccctggttttataccccaggggggttctggaaaaatctttaccgggggccaaatcccgacccagaaatttggagggggtttttataaaaaaacagacagagggaaaatactcggctctggaacatgagggggaaaagggggaagaaaaaggtttaaaattggttacggccaaaaagccccaaaaaatggctaattttgcttttgactatgccactaaaaacaacgggaagaaggttccggtggtccataaggctaatattatgaaatggggag

SEQ ID NO: 7674 - DNA, 776 bp, Diabrotica virgifera
  misc_feature (3)..(22): n is a, c, g, or t
  misc_feature (593)..(610): n is a, c, g, or t
atnnnnnnnnnnnnnnnnnnnnctcgggaggttgcaaccaaagaaagtattccacctgttgtcaatctggtggtatgggaacgatatttattgtcgttttctgtgctacttcgattgataacttattttgtttttcggtagatggctttagttcatccgcgacatttcgttctttgcaattcggaaaggcccaaagtatgatacctggggaaatcggagagaagatgatatgggactactgatgaggaaaaaacctccgaaaccggtatagactcttcctgcactctccgatttaaccagagtattatgcagctgctgcattttcgtgttgcaaagaaattgaaaatgtttatacattctaccacttgattttggatggttaggtgttcgcttgaaactaaatttgtcataaattttactcaccgaaaaatagtgcgggtacagagttggccctgtacgacttcattttgtatccaaacatgaaaagtcactcgttgggaaaaaaattgagttcatcgtcgtcatggaagcctactttgcaggcctcgagaaaacgtatttttaagacgggttaagacgttcagccccggcannnnnnnnnnnnnnnnnngattgctaatctgaaattaattttacttaaattatcaaatatgggcctttaaataacccacaatataattcccattcaaatttagtctcaattgtgtattaatttttatgtagcaataaaagtgagagccgcggatgactcacccggtctgaggggcagatgtcgt

SEQ ID NO: 7675 - DNA, 722 bp, Diabrotica virgifera
  misc_feature (9)..(70): n is a, c, g, or t
  misc_feature (72)..(84): n is a, c, g, or t
  misc_feature (89)..(140): n is a, c, g, or t
  misc_feature (200)..(222): n is a, c, g, or t
  misc_feature (284)..(315): n is a, c, g, or t
  misc_feature (438)..(474): n is a, c, g, or t
  misc_feature (533)..(552): n is a, c, g, or t
  misc_feature (554)..(566): n is a, c, g, or t
caaaatggnnnnnnnnnnnnnnnnnnnnnnnnnnnnnnnnnnnnnnnnnnnnnnnnnnnnnnnnnnnnnnannnnnnnnnnnnnaattnnnnnnnnnnnnnnnnnnnnnnnnnnnnnnnnnnnnnnnnnnnnnnnnnnnncccaagaaatgggtaaaggttcattcaaatatgcctgggtactcgacaaacttaaggccnnnnnnnnnnnnnnnnnnnnnnntgatattgctttgtggaaattcgaaacagctaaatactatgtaaccatcattgatgcccctnnnnnnnnnnnnnnnnnnnnnnnnnnnnnnnntggtacatcacaagctgactgtgctgtactcattgttgcagctggtactggtgaatttgaagcaggtatttcaaagaatggacaaacacgtgaacatgctcttcttgctttcacccttggtgnnnnnnnnnnnnnnnnnnnnnnnnnnnnnnnnnnnnngactgaaccagcatacagtgaatcacgtttcgaggaaatcaagaaggaagtatcctcannnnnnnnnnnnnnnnnnnncnnnnnnnnnnnnnttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttccccccatct

SEQ ID NO: 7676 - DNA, 608 bp, Diabrotica virgifera
atctgtcgatatcaattgattaatttgcggcgaggttgctatattacttatgttttagaaaatgtataatgttagcaagtccactgagtgccgctgcgccgataagaacgaactgattgtcccgaatgttataggatgcgatctaatactacctagcccttccgctattggaacgttaatcgagaagaattatacttaataatataagacctaagtaaaactaatgacctaccaacatctaactgaggtagtaccattatgatatacattgtaggtatcacaagggccgcgctcacccctgatgataacggagtgtttgatctcgaaataaaacatatgagaaaaagccctaatggtgccatataagatatcatccaatgtactgtcgtcttagtaccattcatcagaaaaaatatcccaagagagatttggagatgatacaaacctattaacgttgataaaaacactctcacagacctgtacatttcttccgatgatatcctgccaattgctgaatacttggacttaattttcaccggtgccttcgcatgatctcacagtgaagtagatctcgactatcggctgcccgctgatttctttgaatgtgc

SEQ ID NO: 7677 - DNA, 1201 bp, Diabrotica virgifera
  misc_feature (9)..(51): n is a, c, g, or t
  misc_feature (59)..(134): n is a, c, g, or t
  misc_feature (139)..(171): n is a, c, g, or t
  misc_feature (181)..(589): n is a, c, g, or t
  misc_feature (599)..(801): n is a, c, g, or t
  misc_feature (813)..(813): n is a, c, g, or t
  misc_feature (822)..(822): n is a, c, g, or t
  misc_feature (830)..(830): n is a, c, g, or t
  misc_feature (837)..(837): n is a, c, g, or t
  misc_feature (854)..(897): n is a, c, g, or t
  misc_feature (961)..(979): n is a, c, g, or t
  misc_feature (1053)..(1073): n is a, c, g, or t
  misc_feature (1080)..(1100): n is a, c, g, or t
  misc_feature (1137)..(1191): n is a, c, g, or t
ttcgtatcnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnncatcnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttaggnataaatttnattatatnataattnatttaatttgggggggnnnnnnnnnnnnnnnnnnnnnnnnnnnnnnnnnnnnnnnnnnnnataaaaatttttgatccccattttttttgatttataagaataataacccttagggataacagcnnnnnnnnnnnnnnnnnnnggtcaaatcgaataataaagatggggccccctccatggtttggaattaaagttttataaattggtggtaacagnnnnnnnnnnnnnnnnnnnnngtttcannnnnnnnnnnnnnnnnnnnngtatttggggtttttaaaccgggggggggaggccccnnnnnnnnnnnnnnnnnnnnnnnnnnnnnnnnnnnnnnnnnnnnnnnnnnnnnnnaaagggcccc

SEQ ID NO: 7678 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (166)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggtttctannnnnnnnnnnnnnnnnnnnnnnnnnnngaaagg

SEQ ID NO: 7679 - DNA, 584 bp, Diabrotica virgifera
  misc_feature (34)..(51): n is a, c, g, or t
tcgacccccgcgttccgcacgagcatggttgacnnnnnnnnnnnnnnnnnngtttgatcttgttatcgacagaggacacgttctcgcgttgtaataagacacgaatgtagaagcatcaacaaatttctcatggaaccgcgtacttgtctgaccggaaccagcatgccagttacccaacttcacaggagtatcacggaagacgagtagctactcagatatgacgataggcgcgatgcgaagccctggagaacttgaatccaagatatccaatcccaaagacagatgtcagactcgtgcaaaatggaccagtacaaggttataccactgcggaaggcaagataacaacagatttctgaggtcctcacgtttctggaccttcctggtttattggcagagactatgaaagaaactctgcacgttagccctgcttttaccgatgatggtgttccacttggcgagtctgttcatttctaccagagctccatttccaccaaagatctggtggacgcgatacggcaagttcgtgacatcaactatttttttaatcaagacacttagtcatcacagaggcaacatgaatagac

SEQ ID NO: 7680 - DNA, 392 bp, Diabrotica virgifera
  misc_feature (18)..(18): n is a, c, g, or t
  misc_feature (24)..(24): n is a, c, g, or t
  misc_feature (74)..(74): n is a, c, g, or t
  misc_feature (112)..(112): n is a, c, g, or t
  misc_feature (128)..(128): n is a, c, g, or t
  misc_feature (162)..(184): n is a, c, g, or t
  misc_feature (194)..(366): n is a, c, g, or t
taacagcgtaatttattnggagangtcaatcgataataagatcgggactcgatgttggattaagtttataattntgtagcagtatattaattaagtctggtcgactttaaantttacatgatctggtntaaacgggtagggccccggttgggttctatcttnnnnnnnnnnnnnnnnnnnnnnngaaagggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctaagagggaaaaggaatataaaa

SEQ ID NO: 7681 - DNA, 373 bp, Diabrotica virgifera
  misc_feature (2)..(136): n is a, c, g, or t
  misc_feature (143)..(180): n is a, c, g, or t
  misc_feature (200)..(213): n is a, c, g, or t
  misc_feature (216)..(238): n is a, c, g, or t
  misc_feature (246)..(268): n is a, c, g, or t
  misc_feature (310)..(329): n is a, c, g, or t
  misc_feature (343)..(362): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnaatttaaaccggtgtgagccaggctggtttctatctttaagnnnnnnnnnnnnnnnnnnnngataggaccacatnnnnnnnnnnnnnnnnnnnngtagataaata

SEQ ID NO: 7682 - DNA, 379 bp, Diabrotica virgifera
aacgtcgtcgtcaaatcatcacatcgtcggtcctcgcgcaatctggtgggacatttaatttaattgaataagcctaaatcaaggggtattttcggataatgcagcatccggagaatctgcatactggcgctaatcgaccatgaatcccactaccctggactaggagcgatgaagagacgtaccatcatcgcgatatcaccaaaacgagcacgaggaaactgcatcaagatatggattcctcaaacagttactggacgtgcgcaagattgaccagaacaaggttgatcaactgagcaatgcacgatgacgttgtctttctgagggccacacatattccggcccgttctggattattggcacagactatgaaaaaaattca

SEQ ID NO: 7683 - DNA, 558 bp, Diabrotica virgifera
  misc_feature (2)..(359): n is a, c, g, or t
  misc_feature (366)..(403): n is a, c, g, or t
  misc_feature (423)..(436): n is a, c, g, or t
  misc_feature (439)..(461): n is a, c, g, or t
  misc_feature (469)..(491): n is a, c, g, or t
  misc_feature (521)..(552): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7684 - DNA, 495 bp, Diabrotica virgifera
atatattggaaaaaatgtcgaaagttgaatttaaacaagatatgcccccacaggggggctacaatccaattaactataaaagagttccagccaaaactttatttggaggatgggccttaatcgggggctaccttggcatgactgcaggagcggcgtatttatattatttaaacgttaaggcagtaaaaactcgagaacttgaattaaagggcgccagcttagcgctgtatccaatacttatggctgaaagagaccgtgaatatatgaagcaattaaggagaaatagagatgaagaacgtgaattaatgaaaaatgttgaaggatggcagacgggtacatggtatggtgaacccatctacaagactaaagacaaagatactcttattcatcccctattccatgaatattacattcacagttcttacaaggactacactgttcgtgcaaacgttggtttgatgtcttaaatttttattctattgtaatttagtagcg

SEQ ID NO: 7685 - DNA, 1158 bp, Diabrotica virgifera
  misc_feature (1064)..(1106): n is a, c, g, or t
caaccagtggaagtgtgggagtagagccagttgtcaaaagaaatactcgcgagcatctcgcgagtttactaacataacctacaaaaactttttgaaaactttcagataaggattatttattaaactagtggataatttgtgtgttttgtgtaatagtgaggttttactgttcctcctttggaattttatgttgaaatgtgagttttatgataacagtgcacaatggttgataatagttgcgttatagaaggaactgtgaaatttcgagatggcaaaaaatggaaatcgagatggtgtgtcatgaggaaattatctccagttgcagactgtttacacctgcagctgtacagagactccaaagacagatacaaacagggccaaaccaaagcttccctttcgctggaacattttctgggattggagactggttttactttagataaggaatcaaatacggtagctatattatgtcaagatgtcgtcgttgttctagcatttgacaatcgggaaaggcttatgcaatggcaggtaaaattaagttcccacctgaacgacggtcctcatttcttagtcctagtgtcttccgcaccaccaaagtccagattgcctccgggtcctgctcggttgcacgttcaagaaagaggattctgcctaactacgggagttccgcccagagtggctggtcagtggcttattagtaatttaaggagatatggggtagttgaggggcgattctgcttcgaagggggttcaaggtgtataaaggggggaagggttgtacgtactacttaccgatcagggagaaaaaatccccgaccctttgaagggggctttcggaagggaatttggattttttccaggaaaaagggccgggttcaaaaaaaaatggtccggggtggggaaggccccccgaaaaggacaccatgccggcgccccggggaggaataaggaataaaaaattaaagggaaacctcccctttttttccccgggggggatttcccctttcccccgaaagagggaagcccatattctgggggtggggggggaaaacaaattcacaaannnnnnnnnnnnnnnnnnnnnnnnnnnnnnnnnnnnnnnnnnngacgggaatccacaaacatccctggggccacatgcaagaggtccccctcctt

SEQ ID NO: 7686 - DNA, 766 bp, Diabrotica virgifera
gacaaatcaaattatcgcaacttactttaaaatatcgaacaggcccaaagtacattctcttttcccaaaaacgatcaccttcgtaatcagtgaattagatctattaaccgtgaaaattttacagtaactcgctagttcagtggtatcgtaaaaaacattttgattcgaccaacatattgaaactaacttctttaccgaaatttgacatatccgaagttgaaagagaatgcaatcccaagcatttttgaaaatcaaccttcatatttatttaacccaaaaccaccaacaagaaaaatcctgaaactagacgtgctgaaataagtctctgggaagaaaatattgtaaaggaatttgaaaatgaagaccttatcatagctttcaatcaacttgtacatgttagtgagaagattgagttaaaaaactgacagataaaagttgtagaagaaaggatttgtaatacattattaaatattgacagtcactgcagtgatgagtgcatgtaagttacagtaaaacctgccatatccggatcaatgtggcgacagaccgatccggatatcaagactactacttcttttacagtctctgaaacgttttctccttcatacattccagtaattaacgccgtcaataactttcgtcaatagacatgttttatagattatataatacattatttcgccttctgttagtacgttgtccaacaacagccgttcttggtagatttcggtagatccggacggcgcagaaccgtccggatatgaca

SEQ ID NO: 7687 - DNA, 680 bp, Diabrotica virgifera
  misc_feature (2)..(472): n is a, c, g, or t
  misc_feature (479)..(516): n is a, c, g, or t
  misc_feature (552)..(574): n is a, c, g, or t
  misc_feature (642)..(666): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctccgatgttggattaaagttataattggnnnnnnnnnnnnnnnnnnnnnnntgtccgacttttaaaattttacatgaacctgaagttaaaccggggtggacccaggtttggtttctatnnnnnnnnnnnnnnnnnnnnnnnnngcacaaaagggacc

SEQ ID NO: 7688 - DNA, 738 bp, Diabrotica virgifera
gacaagtaacgccgatagaagaacgagcgcgtcagttcctcagtaaaacattattgtaggccatgatagtagccataaacttagtatgaaatcaaagctttgttaaagttaagacacattgaatcctgttaaattgtccgtaagaatcaagcaaacagctgttaaaaccctttcctgtggcgttttgaatattactatgaaaatgcctggcaaccagaaagcagataacagggcactacgaatacgaggaaaattcctactttacggaaggaattgagaacaacgtagttgaagattttaatacggcccccgaaaatgacttttcggagtacatgtggatggagcacgaggaggaattcgataaggaggtcatgcaaagactagaagaagaggcattaatggaagaatgtctgcaggcattcatgaatgatgaaaataatttggcgaatactcagctccaagatgtgaactctgctcagtcccaacaaagtgttccggcaccagagagcatcgcgaattcaaagttaaacccagaagcagcggaattcgtaccctcaagtcgacgggctacccaagttccgacgtcatcatcttaaattaatgttcacacagaatgagatctcacgttttgtatataagaagaaacgttatgttctcttgagacgattttttgctttgctgtgagataagtcaagagttgatttggatggctgttgaatatatagtgctacattttcc

SEQ ID NO: 7689 - DNA, 762 bp, Diabrotica virgifera
  misc_feature (408)..(431): n is a, c, g, or t
aagccacatccagtaggtgaaaatatggctgtgataatggaatacagagattaaatttttaacttatgatattttatgaactgtatataatgtatttttatcactcttttacttgtttattaatgttgtggacgttagtgaggtattctttagtagttatttatagcagttttttctttagcaaggttctgaaactgttatcttgtggcgggcgactacgaactcccccacgctacctagattttaatgggttcagttttatagtaggattaaaagcgactacaaactgccccacactacctaggtatttagataatatttttgtgaacatatatagtttttattttactttatttacttattttactattgtattcaaaaaggaacccaattcccaaagtatgagcnnnnnnnnnnnnnnnnnnnnnnnngaaactataacaatataatcgaacaaagtttatttataaatctacattaacttatatacaataaaaaacactacagttaaacaataacaatgcttaattctaatgtctgattagtgattaaaataagtaagaactatattttagattttaaaagttagctgcataataattgcaaactgacttaatgaagtctaatttagtaatgttttgattaacgtaataatcatttagcctattttcaataaaatcaacttttctttttgccgttttatcaagttttttttcgaatctatgtgcagttctaattttcacatatacttctgcttgaaaa

SEQ ID NO: 7690 - DNA, 385 bp, Diabrotica virgifera
  misc_feature (11)..(33): n is a, c, g, or t
  misc_feature (224)..(297): n is a, c, g, or t
  misc_feature (302)..(367): n is a, c, g, or t
ccctttcgtannnnnnnnnnnnnnnnnnnnnnngataaaaaccaacctggctcacaccggtttaaactcaaatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnactagttctaaatcgcga

SEQ ID NO: 7691 - DNA, 82 bp, Diabrotica virgifera
ctgctggttgttttaatccatgacctgaacaagaatgaatctagtttcatcttgatacttacttcacaccaatttcccatac

SEQ ID NO: 7692 - DNA, 250 bp, Diabrotica virgifera
  misc_feature (170)..(220): n is a, c, g, or t
cgtagatgtgcccagcgcatgctctcaatttgaacactaaattacatatctaccagaatcaatcctaaaggaaaggtatcgcaacttattgttatcaagctcgcatacagacggtggccattttgcagcttttgaagctccaaatgttcttgccaaagatacttacgacnnnnnnnnnnnnnnnnnnnnnnnnnnnnnnnnnnnnnnnnnnnnnnnnnnntttgtatatttatatgtttttattataagt

SEQ ID NO: 7693 - DNA, 697 bp, Diabrotica virgifera
  misc_feature (2)..(31): n is a, c, g, or t
  misc_feature (658)..(658): n is a, c, g, or t
cnnnnnnnnnnnnnnnnnnnnnnnnnnnnnncaacaacaaacctaataaaaccaatttttatatgtacaataaaacagtaatggtcacttaatatttatgcaacataagcaacattctttctctcgatgtgggatcgacaaattggacagaattcattaattcctaatgcacaatcttcacataaacatacatgaccacaaggtaataggataatttctttggggttctccttacaaactacacaaatttgattctcatttaaatcttcatccctaatttttcttctcctttctttccgggacaattctaattgtgatctttgctgttcttcactttccttttctgattttatccttaagtattttttaactataaaacccgatatgactataccgattgaaccaaacacaatacacataattctatagtttgatttagagctattaagtttttttaataacgaaagaattcccatattcgttagataaaatgattcaccttccgtaggtggttgcagttttagattgccatctttttcagaaactagttctccaattcctgttattacactaccagttcggagcattttttcctgtgattgtatcccccctttgacgtattccagcaaaaaagctccagatatgatcaataacgctnagcactgttgggtgaaaattatcagaaatcacatccata

SEQ ID NO: 7694 - DNA, 571 bp, Diabrotica virgifera
  misc_feature (317)..(339): n is a, c, g, or t
  misc_feature (446)..(503): n is a, c, g, or t
taaaaataacattagttttttgtattcttatttatttttttgatgtagaatggtgtgtgcataagcgacaatatctcaagttcttgattctttcgacgccagtgaaaactggatagtgtgttcagatgtaatcaacactattggagatcaatctggttgtttatctggttgtcccgtagctgcagcttcggcgatgagtgacagaggatgcatacgctcccaagcaaagtttagagtacctgtttctgctgaaaatctaatggtttgtatcgcttccggatgcgacggaggatctctggaagatgaatggtgcttannnnnnnnnnnnnnnnnnnnnnngggaggcctttatggaagcatccaggtttgccagccttattctcttccaccatgtgaacataatacaactgggactaaagtgcaatggagaattttgaagctaaatnnnnnnnnnnnnnnnnnnnnnnnnnnnnnnnnnnnnnnnnnnnnnnnnnnnnnnnnnngtgttgcttcaaggccatcgtattcctgcactacagtagccaatatgctgaaggaaatgttgtccaat

SEQ ID NO: 7695 - DNA, 415 bp, Diabrotica virgifera
  misc_feature (18)..(52): n is a, c, g, or t
  misc_feature (54)..(216): n is a, c, g, or t
  misc_feature (223)..(260): n is a, c, g, or t
  misc_feature (280)..(293): n is a, c, g, or t
  misc_feature (296)..(318): n is a, c, g, or t
  misc_feature (326)..(348): n is a, c, g, or t
  misc_feature (378)..(409): n is a, c, g, or t
ttttttttaatcaccccnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7696 - DNA, 994 bp, Diabrotica virgifera
  misc_feature (2)..(53): n is a, c, g, or t
  misc_feature (56)..(73): n is a, c, g, or t
  misc_feature (81)..(100): n is a, c, g, or t
  misc_feature (104)..(175): n is a, c, g, or t
  misc_feature (198)..(250): n is a, c, g, or t
  misc_feature (266)..(330): n is a, c, g, or t
  misc_feature (338)..(434): n is a, c, g, or t
  misc_feature (436)..(505): n is a, c, g, or t
  misc_feature (521)..(579): n is a, c, g, or t
  misc_feature (635)..(647): n is a, c, g, or t
  misc_feature (649)..(718): n is a, c, g, or t
  misc_feature (766)..(833): n is a, c, g, or t
  misc_feature (878)..(975): n is a, c, g, or t
gnnnnnnnnnnnnnnnnnnnnnnnnnnnnnnnnnnnnnnnnnnnnnnnnnnnnagnnnnnnnnnnnnnnnnnnctttctcnnnnnnnnnnnnnnnnnnnngaannnnnnnnnnnnnnnnnnnnnnnnnnnnnnnnnnnnnnnnnnnnnnnnnnnnnnnnnnnnnnnnnnnnnnnnctctcccacccccccctccctcnnnnnnnnnnnnnnnnnnnnnnnnnnnnnnnnnnnnnnnnnnnnnnnnnnnnnacaacccccccttttnnnnnnnnnnnnnnnnnnnnnnnnnnnnnnnnnnnnnnnnnnnnnnnnnnnnnnnnnnnnnnnnncggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnntgggggagggggtgtnnnnnnnnnnnnnnnnnnnnnnnnnnnnnnnnnnnnnnnnnnnnnnnnnnnnnnnnnnntaccctccctccgctcgtgggggtgtggggggtgtgggtgggcggggggggctgtnnnnnnnnnnnnntnnnnnnnnnnnnnnnnnnnnnnnnnnnnnnnnnnnnnnnnnnnnnnnnnnnnnnnnnnnnnnnnnnnnnngtccgccccggccgccgggggcgcgggtgggccgggtggggggggtgnnnnnnnnnnnnnnnnnnnnnnnnnnnnnnnnnnnnnnnnnnnnnnnnnnnnnnnnnnnnnnnnnnnngcagacgggggcgggggcgcggggcgcggggcgggccccgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtgtggtgggtgtgt

SEQ ID NO: 7697 - DNA, 669 bp, Diabrotica virgifera
  misc_feature (26)..(65): n is a, c, g, or t
  misc_feature (70)..(89): n is a, c, g, or t
  misc_feature (112)..(141): n is a, c, g, or t
  misc_feature (153)..(166): n is a, c, g, or t
  misc_feature (168)..(184): n is a, c, g, or t
  misc_feature (302)..(320): n is a, c, g, or t
  misc_feature (533)..(551): n is a, c, g, or t
  misc_feature (553)..(568): n is a, c, g, or t
  misc_feature (591)..(607): n is a, c, g, or t
  misc_feature (609)..(627): n is a, c, g, or t
attgtcatttattctcgaataatacnnnnnnnnnnnnnnnnnnnnnnnnnnnnnnnnnnnnnnnnctccnnnnnnnnnnnnnnnnnnnnccattttatctttctagccgacnnnnnnnnnnnnnnnnnnnnnnnnnnnnnncactattactcnnnnnnnnnnnnnncnnnnnnnnnnnnnnnnntacacccaaagaattaacaatttttatcgtacaatgaatcatcttaaataattcttttgtaacgacatgttattcgcctctacctatatctagttttttgcgaaatacatcacattcnnnnnnnnnnnnnnnnnnnctaattaaatattcttatattattaatctgcaatatctttagggatgagctgaacaataacatctttattaaaattctagtttctctatcaaaattacgattaaaaattctcgtattttaaactatgttattacttattgtgatatattattatcttgatttcttataacttttttattagaatccaaatttgaatcctttaaatctactatnnnnnnnnnnnnnnnnnnngnnnnnnnnnnnnnnnnctagaaatatataggcttaatcnnnnnnnnnnnnnnnnngnnnnnnnnnnnnnnnnnnncaacatgatctttttgtctcatatatgaagtctcgcctgccc

SEQ ID NO: 7698 - DNA, 733 bp, Diabrotica virgifera
  misc_feature (324)..(543): n is a, c, g, or t
caccaggagtggagcctgcggcttaatttgactcaacacgggaaacctcaccaggcccggacaccggaaggattgacagattgagagctctttcttgattcggtgggtggtggtgcatggccgttcttagttggtggagcgatttgtctggttaattccgataacgaacgagactctagcctgctaactaggcgtatttcgacatcccaaaggcccgtcggtggagtttcctgctcttgctgcacgcggtttttactgtcggcgtacacacaattcttcttagagggacaggcggcttctagccgcacgagattgagcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactaccgattgaatgatttagtgaggtcttcggactgagcgcggtggcgtttcggcgtcgtcgatgtttcggagagatgaccacacttgatcatttagaggatgtagaagacggaacaaggcttccggacgagtacctgtcgaaggatcattatcgtggtctcactaggccacgtgctgcactaaatta

SEQ ID NO: 7699 - DNA, 622 bp, Diabrotica virgifera
gctcctctaataattttataagaatctaatccaattcgcctaaccctaaaatgcttcctaaaggacctagagctctttgaacatgacgatattttacttagtattttcttagatgcctccagaacagaatctagctaaaatgaacaaaaagtgatccacctatttgacttccagagctatttaagacctcatagttaaagatggctattgtcggatgttcttcaacatcaaggccacctgtcaagggcgaatcaccctcctctgatgtccaaaagatgtagggaaatgcctaatgctgaggaaattgttagatcagtagatgattacataccgcctgcgatacaaaacatcaacctgatatccgatgccctataccatgtgacaaagatccacatgttttcaaagatatcaaaattgccgcatcagctcttttaatcatagacatgcatgaaaggcctggaggaaccctcgaggtaatgggattaatattacgcaaactacatgtgaatactatgattgtcatgtgctcttttgctttgccagtgagatgtacagaatactcgtgatactgctctcgcccatccttatgagtatatgactgcctacgtcgaagcacctcaga

SEQ ID NO: 7700 - DNA, 447 bp, Diabrotica virgifera
  misc_feature (9)..(32): n is a, c, g, or t
  misc_feature (43)..(64): n is a, c, g, or t
  misc_feature (311)..(331): n is a, c, g, or t
atctaaagnnnnnnnnnnnnnnnnnnnnnnnnccctttcggannnnnnnnnnnnnnnnnnnnnnggatagaaacccgccgggctcacaccggtttaaactcagatgatgtaaaattttaaaaggcgaacaaaattaataataaaggtgctacaccaattataaactttaatccaacatcgagggcagaatctttattatggatttgagctctccaagaaaattaccggtgttatccctagggaaattttttcttataatcaaaaaaatgggatcaaaaaatgattaattactataataggataaaaaaagnnnnnnnnnnnnnnnnnnnnnccccaatgaaataaatttattgtaaaagtaaatttaatactaaaaagacttattagtaattgtatgaaatcctatttcaggatcgcgagcgatcgttgtaaaggatataaggttac

SEQ ID NO: 7701 - DNA, 871 bp, Diabrotica virgifera
  misc_feature (19)..(43): n is a, c, g, or t
  misc_feature (729)..(729): n is a, c, g, or t
aacgccccaagaaaagaannnnnnnnnnnnnnnnnnnnnnnnntctcctctctcggtgctaaacgtaaaatccgaaaagtcggagaagaaaagaactcttgacgattcagctttgggggaaaaggaggtaaaagtcatatcattacgaagtgaagacttcactggcttgggattcaacatttgcggtaatatgcgagaaggaatctacatcaaggatgtgttacatagaggtcccgcctacgattccggtaaactcaattcaggtgaccgcataaacagcgtaaccatcaactttgaacacatggtatatgaagacgccttggctatcctcagttatgctagtccctacgaagtagtcatcgaagccaaaggcggcaaactgatccacaatgtacctggtcaaggaggccagcccggccatcctgtgtacaagagttcttcccatttggatttatataacgttgacaaaaccggaaagaagaagaacgatagcggatccctggactcgaactactccagcttgaaaaaatccatcagcaacatgacgacgttggaaagaaaggagtcaaactcaccgagaatcaacgcaacccccaagaaaatcgtcaacaacataaaccccgaacatcttaaagttcagctagaacaaagaatcgacaatcatgccaaaggaaaagatcaagagcccatggagatggaaactcagaagacggagaataagtttcctanatttgggataagagtgttgccgtctgagcggcagacgagtccaaaaagtgctgaacaaaacgacaacaacattaacatagagaagcatttggaagctaagccgatcagtatagacgaagtggatgactccaagctacctcct

SEQ ID NO: 7702 - DNA, 913 bp, Diabrotica virgifera
  misc_feature (805)..(805): n is a, c, g, or t
  misc_feature (831)..(831): n is a, c, g, or t
  misc_feature (858)..(858): n is a, c, g, or t
  misc_feature (867)..(867): n is a, c, g, or t
  misc_feature (878)..(878): n is a, c, g, or t
ataagaaataagaataataaaacgagcaaaaatagattattttcgtgtatatcaatttatcaattattcaacattttttaacggtagggtacgcagctaacgattcttatcgttttatcaaaaggaacgtacatcgactcgcagcttatccataaatatcgtaagctcgtaaatcgaaaatttattaaaagtgttatcggcttttcgtttttatatcgaatagaacagcatattatagagctttaggtagaaatgtctacagaagcctgatattgaatcgtcagaaataataatgattgcaaaatgctatctctagaattagataccatagatgattttacaacacaactaatgcagaaaaaagtggacaaatggagctgtaagaaacccatcccaaatgtgtcctatggtgttaaatatattgataatcatagtattgcagatttttcatgtttagacataacaagaataaatgaattattccaacaagccattgaaaaaaatgatacctcttcagttttagaattgataaaccaatgtatatctcatcgattgtgtccgactttgtcaaatttactctacacatttatctgtatgttcacaaagtggagatattgctacgataaagaagatacaacttttatataaagaaaccaatgtccatattctagaaactcattcaaattttaaacactatatagctgaagctatttggattaagggaaatgttcaggaagctttaaacctattcaaagaagtatacaaagataatgtgttactgagacgtagaaaaagattgatgttnaagaatttaattgtagacatcatagnaaaataggagtgaagctgtactagtanatttagtanattttgcaganacttttagcaatgagtataaagattattttcctct

SEQ ID NO: 7703 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7704 - DNA, 819 bp, Diabrotica virgifera
  misc_feature (362)..(381): n is a, c, g, or t
  misc_feature (693)..(693): n is a, c, g, or t
cccgggtgttggcctttatctagaatctagataatgaagttacaatcaaaaatcgacagttcacgtagtttaaatagtagtaaatgttgattaattttatctgataagtaacaattgtagataattttgttcctataaataaatttttctcaaattacaatgtggaaagccgccgcaggtcatcaaataaacatcagtaacgacaataatgaggacgatgaatgggaaactgatcctgattttgttaatgatgtggacgaacaacagcaaagatggggctcaacgacggtggagggctcagggaggacggctggggccatagatatggataaactaaggaaagaaactgaagaatccgatgnnnnnnnnnnnnnnnnnnnnttggaagagggagagcacaatccctcatacgggtatggaggtaaatttggaattgaaaaagatagaatggaccaaaacgctgtaggccacgattatgttggtaaagtagaaaaacacgcttcccaaaaggattattctacaggatttggtgggaagtttggaatacaatccgatagaatagataagagtgcagtaacgtgggatcataaggagaaaatagaaaaacacgcctcgcagaaagattacgtgtctggatttggagggaaatttggtgtacaaagtgatagacaggataagtctgccgttggttgngaccatgttgaaaaagtagaaaaacatgaatcgcaaaaagattacaaaacccggttttggaggcaagtttggagtacaggcagatagacaagacaaatcggcagtgggatgagaccaccacgagag

SEQ ID NO: 7705 - DNA, 830 bp, Diabrotica virgifera
  misc_feature (410)..(441): n is a, c, g, or t
  misc_feature (773)..(791): n is a, c, g, or t
caatattttttgtttcaggttccctcagtaaggctgaaaaaaactattcacaattagaacgtgaagccttggctattatcttttgcgttaaaaaatttcataaatttatttatggtagatcttttattttggtctcagaccatcaaccgttaaaaatactttttaacccagatcgcaatatttcagtattgtctgcttcacggattactagatggaatgtcattttatcagcctatagctatactatagaatatagaaaggggtcaaagatgtatgaggcagacatgttatcacgattacctttgagtgacgtaactggtattgatagttcaattaattcatttaatttaacagaggatttacctatttcatatgaggatgtagctaaagtctcatcaaaagatggtatnnnnnnnnnnnnnnnnnnnnnnnnnnnnnnnngttggccaaataaatgtggagatggtgaacttaaaccatatttcttgaaaagaaatgaactttctattgaaagtcaatgtttgatggtaggtataagggtggtaatccccactgtattacgtgaaagtattttggaattaattcatgaaggacatataggtatcgtacggtctaaaatgttagctagagcagtagtgtggtggccggggttgcaacaggatattgagacaatgatcaatagttgtcaggtatgtcagataacgcaaaataattctgaaaaagctttagtgtcttggcctaaaactgaaaatgtattttgaacgaatacatgnnnnnnnnnnnnnnnnnnncaattgtacatttttaattattgtagactctaaatccaa

SEQ ID NO: 7706 - DNA, 805 bp, Diabrotica virgifera
  misc_feature (216)..(236): n is a, c, g, or t
  misc_feature (586)..(586): n is a, c, g, or t
cgagagagttattgacgaatatcagcacagcagccgtatgaatgcagttttagtctactctgaaccaaaatgggaataatattcagtgcgaaatgtacatctaccaataggctcgatggaaaaacagctattataacaggagctaatactggaataggtaaagaaactgccaaggatttttacgagagaggtgccaaagtgatactagcatgtcgnnnnnnnnnnnnnnnnnnnnnagcagtagctgatatccaaaaacaatgtacagttaaatcaaatctaggcgaactcaaagttgtagaattagatttatgtagtttagaatctgttcgtaagtgtgcaaaggagttattagaatcagaagaacgaattaacttattaatcaataatgcgggggtgatgatgtgtccgtatagcaaaactaaggatggttttgagacgcaatttggtaccaaccatttggcacattttctttttactttactattattaccaaaaatatgcaaaagcatgccagctagaatagttaatgtatcgtctatagcacatacagcaccttttggacctatggacttcacggatttanactttgagaaaagaaaatataaccctgttcatgcttatcaacaaagtaaactagcaaatattctttttaccaaggaattagccaggagactgacagaaaaggacataactgatgtccatgtctactccttacatcccggagttatacgtaccgaacttggccgacactatgattccatgtttccaggactaacctggggtgtacgacaatatcttcgga

SEQ ID NO: 7707 - DNA, 368 bp, Diabrotica virgifera
  misc_feature (3)..(39): n is a, c, g, or t
  misc_feature (41)..(116): n is a, c, g, or t
  misc_feature (256)..(273): n is a, c, g, or t
  misc_feature (312)..(363): n is a, c, g, or t
cannnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnntaatagaataaatttaccttaaggataacagcgtatttttatttggagagttcaaatcgaataaaaaagatgcggaccccccatgttgggaataaagtttataattgggggaagcagttatattttttaagtctggtcgnnnnnnnnnnnnnnnnnnctgaatctgggttttaaaccgggggggggggcccggggnnnnnnnnnnnnnnnnnnnnnnnnnnnnnnnnnnnnnnnnnnnnnnnnnnnnggggc

SEQ ID NO: 7708 - DNA, 821 bp, Diabrotica virgifera
  misc_feature (649)..(666): n is a, c, g, or t
gtgaaagttgtcagtaaattgcaaaaatgtaaagtgataaaaattatcaagtttatttctaatcatatattatagtgcaattatggcgaaagactacaatagtagtggtgaccagggttctccgtattcaaatcaagaagatactgaacagtcattcgttggaaaagtcaaatcaattattagtaatacaccactgagaaggtggttcggaagacaagacgatagtgttaagccaacaataaggagacgtgaagaagacgattccgaagacgacacagaacagtttcgacccccagcaaaaagagcaaaatttgtggtcagtcgcgaagacgtcagtgtttcacacataaaatccagtgatagtatcaaagacaaattattgataaataggaattatagttttctggagccagtagcaggtccatctggtttacaaacacgaaatttacttaacaatgttaattcttctataaatagtgatataaatgtacagttgtttagtagtgactttttaaatggacataaagactctgatagtgaggaatccacaagtggttattcttcggtagctaggattgggagcaaagagcatgtttgtcaaagcgaaggaagctcaaagcagccttcccctcggcaaaccacctcgccnnnnnnnnnnnnnnnnnntgaaaccccaactgtaaatatggcaaaccgttccctgtttgtggataggactgcaagtccacagctcagcacatcgatgagcttaagagaccccaattttacgcatcaacttttggttcgccaaactttttcgatcaaacgttatccacagaaaa

SEQ ID NO: 7709 - DNA, 751 bp, Diabrotica virgifera
  misc_feature (36)..(56): n is a, c, g, or t
  misc_feature (505)..(529): n is a, c, g, or t
  misc_feature (580)..(609): n is a, c, g, or t
  misc_feature (633)..(650): n is a, c, g, or t
atttaattaaacaaatcgatcagtgcgacaccgacnnnnnnnnnnnnnnnnnnnnngtggtcaagtagagagccggtacttacgaacgacagtctggatatgcagcacaggatctgcgtactattcgttttcttaataggtttttctttcgtcaaaatggcaccttctccagcgctggtgctggaatgcctaaacgaagattgtgatatggactcaggcccggtatgtgcgatagacgagtctggattacctcaaacgtttgacaatcgatgttcggcgaggctagcattctgtagatttggctcattttatgccgaagtaaaaccaggtgaatgctgacagcagcttaggctagtggcagaattccagcaacttttaagctttcccagtattgtttcaacagtagaagaatgattgttctgttcaaattttttgtatacgatttatacccacacttagttagtagaggaaacagtgttgaagaatactctaacatttacgcaannnnnnnnnnnnnnnnnnnnnnnnnacaaaaacatatttattgaattagaactaaggattgtttccaaaaaagtgnnnnnnnnnnnnnnnnnnnnnnnnnnnnnngatgtatggatgtacctacaatgnnnnnnnnnnnnnnnnnncaattcagtatcataaatataagattgtatgtagccaaagattttgatttttaccaacttaataaacgaatttggaagtaaagatacggtgaaaggaaaaa

SEQ ID NO: 7710 - DNA, 782 bp, Diabrotica virgifera
tcaccttttaaccttttgacaatcaacgatttatatttcactttaactttctgttttggttgttcttccaatttttcttcttcgggttcttctgtaaatgcaataaaccctgtatcatcagtttccattttgggtttatccttaacttcccgtttatatgtatcatcaacttccatgttgttatcattaacttccattttgtgtgaaaattttgcccaagccgtattacttgatgcagaaactatgcctagacttttagttcaacatctcatagaccaagctgttctgtatacagtaccaataatatgtgttactaacctgaaagaaacattaaaatctgtgacaggaataaatagtgtaggtgtcgcatttagcaaggagataacgtctgataattcagtaaatttacttatagaaaagatcagccatatatttaagactttacctacacctgaagaccatataaattataacaggtccttggaaccttatgtgacagaacatgaatccgaggaaaaagaagctcctaagaaagaaattgtgaaagtagatgtagttcagattagaaaaaaggtgtatctgataagaagagatccaaagtctaaagccttttatatccagagtttaaaagaaacgaaatttttcccacaaatggaaagttagtggtaacaacgtggaagttgtttgaatacatataaacgggccagtaaaagcgtcgggacctagaagggaaacggggcgttccggagattaatttccttttacagaagatcccgaagaaa

SEQ ID NO: 7711 - DNA, 765 bp, Diabrotica virgifera
  misc_feature (2)..(15): n is a, c, g, or t
  misc_feature (20)..(566): n is a, c, g, or t
  misc_feature (573)..(610): n is a, c, g, or t
  misc_feature (630)..(643): n is a, c, g, or t
  misc_feature (646)..(668): n is a, c, g, or t
  misc_feature (676)..(698): n is a, c, g, or t
  misc_feature (728)..(759): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7712 - DNA, 175 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (134)..(134): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgangttaacccgtggaaagccaggttggtttctatctttaatta

SEQ ID NO: 7713 - DNA, 589 bp, Diabrotica virgifera
cgcacgcgtgcgtcaaccagtgatttccgatcagaaaacagctggcgttacaggtatccttaaattgtgtctactgagagatagttactattgtgaaaatagatgatatttgcataacatacataattattttatctcccttgtatatcaagcatgattaattaataatacaatattaatcatttccaaaattaacacacttagacaataaaaatcattcaagacacttctatacctcagacacttatttcgcattgaaacgttactaattttcaaatatatcaaattccttaagaactaaaccacctatatttactaacaatatattaataatcaccgtatttatctattattaacattaaacctccccctgaataacattcaaactataattttattataatgcaatacttaaatatccacgacgagtcccatatgtcataatttaaaatacgatatgattcatttttatatattactatttctactttgaatatattctttaataacatatcaactcctagttctgtaaatatagtaatgaagacactatcagaatctaacaaatgtatacttagaagaaatatat

SEQ ID NO: 7714 - DNA, 864 bp, Diabrotica virgifera
  misc_feature (797)..(815): n is a, c, g, or t
gggaccatttgaggtttctgtctaaaaaataccaagaaattttacagaatcaacggtactgatctggctattattaagaggcaaaggttgaatagctcctttataggataatgctactgttttatctacggtaaaagagagtaaattagagtcaggccaggtctttatcgtcagtagatccgaagttatagtttcatgaagagatgcaatagttgagttgctccaagtgatactggtatcatcagcaaaaagaaaaaatttcccattgatttttaagttagtgatgtcatttataaagataaagaacaggagaggacccaatactgaaccttgtggtactccacatacaatgtttttgagactagagtcagtatcatttgctctaactagttgtttcctattattcaagtaggattggaaccaattcaaagaaatacctcgaattccatagaaatttagttttttaatcaagatgtcgtgatttacacaatcaaaagctttagcatagttatccaaccaaccttagtttgttagtaactaattatccaaaaaatcgacttcaggaaacatcgagttctaaactactcaaaaatcgaaactatataacttcgaaggctcatagattgctcgtagttctgccgaaaagatcgatttaatatctctatttgtaagtactgggagtactgggacttagccctaacacaaataatattaaattcttgcccattgtaacgagcacaacatttttaatctgcgggatatgaaagcttttaaataatagctcgtaatttggagcnnnnnnnnnnnnnnnnnnngcaaggtggggaggccagctcaacagggatcacttaaacaacatggcag

SEQ ID NO: 7715 - DNA, 582 bp, Diabrotica virgifera
gtgtgccattgtcaatagatttttgtaacttggatcaaaactaataagttaataagcttgccaacttgatatttttaaaatgctagcctatttagtaaaagaagctcttcccaattatttatctaatttgccaattccagatacaattggaggatggttcagtttaggattaaaggatatagtagctcttgttcctccagcagctgtagtagcgggtgttggttatatgtcatataaagcattttgtccaaaaggccgttgtggatcaaagccttcttgcagtgtagtaaatcctggaatactcaaaaagagtgacaaagttgttgactctgttgatatagaagatattgctgataaagcagtgttctgtagatgttggagaagtaaaaactggccctattgtgatggtagtcacaacagtcacaacaaagaacaaggagacaacgttggtccactcattgtcagcaagaagaagtaaccggtatatacgtgtatacaagtttattttgtgtagtagaaataccatggggtatgttgtttacaagtccttattgattgttgattttataacattatttccag

SEQ ID NO: 7716 - DNA, 589 bp, Diabrotica virgifera
  misc_feature (2)..(31): n is a, c, g, or t
  misc_feature (40)..(52): n is a, c, g, or t
  misc_feature (54)..(390): n is a, c, g, or t
  misc_feature (397)..(434): n is a, c, g, or t
  misc_feature (454)..(467): n is a, c, g, or t
  misc_feature (470)..(492): n is a, c, g, or t
  misc_feature (500)..(522): n is a, c, g, or t
  misc_feature (552)..(583): n is a, c, g, or t
cnnnnnnnnnnnnnnnnnnnnnnnnnnnnnncgcccaccnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7717 - DNA, 581 bp, Diabrotica virgifera
agcgcgcttaaaccacgtttgtttattttatattctctaatcctcagtgaagcgaaaaaatcgcagagaggacagagtaaatagtttttgattactatagtgtaaaaaagaattatctctacatcaaaatggcagaagaaatcaatccaaaagcttatccattggctgatgccacattaacaacaaaaattctaaatcttgttcagcaagctatgaattacaagcagttgagaaaaggagctaatgaagttacaaaaacacttaatcgaggtatagctgaattcatagttatggcagctgatgcagaaccattggaaatcttactgcatttgccccttttatgtgaagataaaaatgtcccatacgtttttatcagatcgaagcaagctttgggaagagcatgtggagtttcaagatctgtgattgcatgcagtgttacaattaacgaaggttcacaattgaagcctcaaattcagacgatccagcaggagattgaacgcttattagtataagttttgggtacaaaaatataaaaattaagttttatgttttctacattttttctaaatataagatttaag

SEQ ID NO: 7718 - DNA, 488 bp, Diabrotica virgifera
  misc_feature (408)..(439): n is a, c, g, or t
ggaatcgattaatcggtctgcattgtttaattggtgctatacacattgggagtaatatgttgatgttgcgaggatttctataattgtatatttgtgttgtaattactgaggaagtatatattcccgtatttggaaacaacactaccatcatcacatcttatattaaaatttgaatcctcgaaagacatcctaataactagcattgcctttaaatattgaagactgacaaggaacaatagttggaaggaagtaacaattttgacaggagggatggcgagtggaattggggcatcctgactaacgtggaaatacgttctggatattgttggacttttatttgcgaatttgggaatactcctcatatgtatggaacctgtttaaagttatcttggaaaaggttaaagcctnnnnnnnnnnnnnnnnnnnnnnnnnnnnnnnnaatataatggtggcatacataataggttttaaatgcattattattgtcg

SEQ ID NO: 7719 - DNA, 907 bp, Diabrotica virgifera
aaacttgctatttttaactaaaatgatacgcgcacgccatcgtataaaaatagatcagtaatccagtgtcgctctctttcggtttaattctattattttatttgcattttattcagtacttttactaattcaattttgtacgtttttcagaacaactaaaacacttccaacatggcggacgatgaggttagtattacatcatatgcagtcgtctttctcgagtttaaaaggtaattatccattgcatgctcaaacaaaactaaacttttaaacttttaaacttttaaacttgtagtttatatttaaggagtctacttaaaagacaagtagatatatagaaagcgcttaaattacaaataaaaaaacatatatttctactatagttagaaacgcttcttgagctgtcttttgcatcagtttttgctgtaaaagcatctttgagaaaggggctgtagtattatttatacttagaatgttataaagtattttagtgtaagtagatattggtatgtgctaacaggagttttagtttttgctttgtaatatttgtatcatttataatgtgcctttgttgtgttgctagtccgtagctgtagatggtagagtagaaagaataacacccaaaaatcattagtacacttgtttttaaatttcatttggttggttttaagtcgttttgataaaaaaatacatttgcatactaaaaatatcatcaaaataaaatgtaaaaagaatatatagttaattataattttcaagttaagagatttaacttacttcttatttactttttaggaggagcttgttataataatgggttatattagtaattgtatatgtacttagtatacttacatacttttcataaaatctttaagtttaaacttttaacggttcttctttttct

SEQ ID NO: 7720 - DNA, 794 bp, Diabrotica virgifera
  misc_feature (185)..(227): n is a, c, g, or t
  misc_feature (469)..(505): n is a, c, g, or t
  misc_feature (756)..(756): n is a, c, g, or t
agcatttaccgtagatttcaaatattcaggagaagagttcatagtattcatctacgtcccgtcgaatcatttaaaactacaaatctcgcctttactctttcagtttcatcccggtgatagtgctcgtgataattccaaacaatttttcggactatacaataccggtaaatgaaggactctcgagnnnnnnnnnnnnnnnnnnnnnnnnnnnnnnnnnnnnnnnnnnnaatcgtcaactttaaaattcttacgtgttcagtcaaggatttggcaacatctatacggcaatctagtgaattttggtaattattatgtatttgttcaagaacttggcaacaccgtacgtcactctagtcaacgtggttcggcaggtttgccgagtttaaaaagacatattgcaatgagtttaagagcaatttgaacaaaaaacacatcacaattgtctaaagaacacaaagtgtttttgtannnnnnnnnnnnnnnnnnnnnnnnnnnnnnnnnnnnncatcaattttgattggatttttaaaaagtggcataccgttataatgcctgattagtcagcaatgaattcatcttaatatcagtgtaatatgatttctctataatgaaataatcaaacaaaagttaacaagtacactaatttaatgaacatttttaacataaaaatgtaacaacaaaggtgtttaagaataatctgtgtttcctccagaagtatacgtaaaatacagcttgacgctgccttggcattcttanaattaaataccaatattcgttttggggcaatagggatc

SEQ ID NO: 7721 - DNA, 65 bp, Diabrotica virgifera
  misc_feature (25)..(50): n is a, c, g, or t
cacgggaaaaaatcctttgaaaagnnnnnnnnnnnnnnnnnnnnnnnnnncccaatggatgaacc

SEQ ID NO: 7722 - DNA, 894 bp, Diabrotica virgifera
  misc_feature (297)..(312): n is a, c, g, or t
  misc_feature (338)..(338): n is a, c, g, or t
gttattagtgcattaggttcaaaatgtacacattacggagctccgcttgtaaacggggcccttggcaatggaagaattagatgccctcggcacggagcgtgttttaaattatctactcggagatattgaagaatttccaggtttagattcacttccgtgttatcaagttactattgaagatgaaaatgtgaaagttagagctaaaaagagcgatttgatttccaataaacgcattaaacctatgggaggaaaacttgcgacaacggaagagtctattgttattattggaggaggacnnnnnnnnnnnnnnnntgctgaaactctcagacaagaaaaantttggggggtccattactatgatctgtaaagaaaatttcgtaccatatgatagagcaagattaagcaaagaaatgggattagacataaatactgcagtgttccgaaatgaggacttttatcgaaaatataacatagatatattaaaagacatcgatgcgacaaaggtggacactaataagaaaatagtggtgtttgaggaacaacacaaaagttcctttaactaagttgttcattgcaacaggaaatagaccaagaagaccctgcacttctggatgtcatttgaagaatgtgatagtgttgagaacatacgaagaagctaaagaaacaaatgcaatactttcaaaggaccaagaagtggttattataggaagtagcttcatagcaatggaggtagccgaatattgtagggataaagtaaaaaaaatatctgtagtgatgcgtgatgatgtacctttcaagccagttttaggtcccatgataggagaagcggtatgaagctctttaaaaagaatggtgttcattttatcccgaaaatggaaatagatgcaatcaatg

SEQ ID NO: 7723 - DNA, 659 bp, Diabrotica virgifera
  misc_feature (593)..(610): n is a, c, g, or t
  misc_feature (636)..(657): n is a, c, g, or t
catgggttttacgtcaattggcaatacatagcgaatatcaggatcaaatttatgaagaaattatatctgtattaggagatacacaaaagcaaccagacctgaacgacctaaatgaactaaaagtaatggaacgatttattaaagaaactctacgtctttttccggcggtgcccttaatagcacggtcgttggatgaagatatagaattaaatggatatttggttcctaaggaggcgactgttgatgttctgatttatgacattcatagaaacccgaaatattggccagaacctgagaaatttgatcccgataggtttttgcctgaaaattgtgtaaatagacatccattcgcttatgtacctttcagtgctggacccagaaattgcattggtcaaagatttgcaatgtttgagatgaaggccattatttgtggaattatgcagaatttctcagtgaaacttgctgataaaaatgaaaaagttgaaataataactgatttggtactaaggagtgcacatgaaattaatttgaactttctacctcgtaactaatattttcgttgtgtgaactgaaacgatcaaataatttgttannnnnnnnnnnnnnnnnngctgtgttattgtattttgttggcgnnnnnnnnnnnnnnnnnnnnnnat

SEQ ID NO: 7724 - DNA, 123 bp, Diabrotica virgifera
  misc_feature (19)..(117): n is a, c, g, or t
ggtttttctcttcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcc

SEQ ID NO: 7725 - DNA, 81 bp, Diabrotica virgifera
cgactcctatagggaagctggacgctgcaggacggtcggatccgggcgacacgcgcgattatgcgtagcgctatttaagtg

SEQ ID NO: 7726 - DNA, 402 bp, Diabrotica virgifera
tgtttattttgaagtctatttcaagatgagggttgtgtctgcaattgtggcattcctctgcgtcgtccttttgataattcaaactatatccgcggcacctgcgcccattcctgggggtggcggtggcggaggctgtggtggcggtggcggcggtggcagtggtggtggcggtggcggcggcggctgtggcggtggaggtggcggtggccgctaacgtataattaaaatacctaattttacatgtggaaactataaaattgtatagttattgtatattgtaaaattgttttgcaattagggtatttatttctattttttgatattatgaataatactctattacagtagtacctatgtgataaatttaaaaggaatattgtaccaataaacttttttttgtag

SEQ ID NO: 7727 - DNA, 879 bp, Diabrotica virgifera
  misc_feature (313)..(334): n is a, c, g, or t
  misc_feature (691)..(708): n is a, c, g, or t
cgaccaccagacgataaactcagattacaaaagaaattagtgacaccagacgaccagaccagctgaagccggaaatcatcgtacaagtaacacaagaaacatgaattcactaaccagacagttatttaggactgcgaaaaaggcaggagcgcgcaacttgagcgtttcaggagtaaggagacaggaaccacagcccgctgaattgggtgcgcaatttgccagggcaccattgacacatttgactgaagatgaacaggtcatgaaagacacagttgcccgcctggcacaggatcaaatcgcccctttggtccgnnnnnnnnnnnnnnnnnnnnnngtgaaagactccgtgttgaaaatgttgttcgaaaatgggcttatgggtatagaaattgattcggactatggcggtgcaggatgcaatttcatgaccacggtactcacagtcgaagaaatttcaaaagtcgatcctgccgtagctgcccttgtagacatccacaacaccctcgtgaacactgtgataataaaattaggtaacaaacagcaaaaggaacaatatctaccaaggctagccacagatatggttgcaagttttgccctctcagaaccatcctcaggatcggacgccttcgccctcaaaacaacagccaaaaaagacggatctgattatattttgaacggctccaaaatgtgnnnnnnnnnnnnnnnnnnagctggagtgttcctgatcatggctaacgctaatccttctgcgggatacaaaggaatcacatgctttatcgtagacagagacacccccggcttcagcgtagccaaaccagagaacaactttggatcgtagcttcagggacctgcatggtaacatggacaacgtccgagtac

SEQ ID NO: 7728 - DNA, 716 bp, Diabrotica virgifera
  misc_feature (48)..(72): n is a, c, g, or t
  misc_feature (79)..(92): n is a, c, g, or t
  misc_feature (94)..(106): n is a, c, g, or t
  misc_feature (123)..(161): n is a, c, g, or t
  misc_feature (178)..(196): n is a, c, g, or t
  misc_feature (240)..(264): n is a, c, g, or t
  misc_feature (327)..(346): n is a, c, g, or t
  misc_feature (351)..(377): n is a, c, g, or t
  misc_feature (379)..(392): n is a, c, g, or t
  misc_feature (428)..(454): n is a, c, g, or t
  misc_feature (458)..(477): n is a, c, g, or t
  misc_feature (479)..(494): n is a, c, g, or t
  misc_feature (498)..(523): n is a, c, g, or t
  misc_feature (526)..(543): n is a, c, g, or t
  misc_feature (545)..(577): n is a, c, g, or t
  misc_feature (605)..(622): n is a, c, g, or t
  misc_feature (635)..(663): n is a, c, g, or t
  misc_feature (678)..(697): n is a, c, g, or t
cttaacgatagttaattcagtatcgtgagagaaatctctttctttttnnnnnnnnnnnnnnnnnnnnnnnnntacctcnnnnnnnnnnnnnncnnnnnnnnnnnnncatcatctcttcttctnnnnnnnnnnnnnnnnnnnnnnnnnnnnnnnnnnnnnnnttcggtaaaataaatcnnnnnnnnnnnnnnnnnnngtaacgaaacgttatttcgtttttaaatatcatctaattttttnnnnnnnnnnnnnnnnnnnnnnnnnctcacaatctctttctaattaaatcattttctcttcttcatcttaaatctttttcagggatcnnnnnnnnnnnnnnnnnnnncttcnnnnnnnnnnnnnnnnnnnnnnnnnnngnnnnnnnnnnnnnnatcttttaaaataacgtaatcattcactttcacacnnnnnnnnnnnnnnnnnnnnnnnnnnnttcnnnnnnnnnnnnnnnnnnnncnnnnnnnnnnnnnnnngagnnnnnnnnnnnnnnnnnnnnnnnnnncannnnnnnnnnnnnnnnnngnnnnnnnnnnnnnnnnnnnnnnnnnnnnnnnnncggttattaaaaacacgtcttttggtannnnnnnnnnnnnnnnnncgcccaccgatannnnnnnnnnnnnnnnnnnnnnnnnnnnngctaaggagcaaatnnnnnnnnnnnnnnnnnnnncggaatggaagggtggatg

SEQ ID NO: 7729 - DNA, 967 bp, Diabrotica virgifera
  misc_feature (15)..(36): n is a, c, g, or t
  misc_feature (39)..(53): n is a, c, g, or t
  misc_feature (154)..(175): n is a, c, g, or t
  misc_feature (451)..(465): n is a, c, g, or t
  misc_feature (638)..(709): n is a, c, g, or t
  misc_feature (841)..(841): n is a, c, g, or t
  misc_feature (852)..(888): n is a, c, g, or t
  misc_feature (949)..(949): n is a, c, g, or t
atgcactttgggggnnnnnnnnnnnnnnnnnnnnnngcnnnnnnnnnnnnnnngtctttagaaaaaagatggaaactacaacagaagaattaggtaaaactagtccaatcaagaatgatttaaataaagattccttagagttagatacctcacnnnnnnnnnnnnnnnnnnnnnnccaatttgaaaactgtgacgttgcatatagaaaaaaatggttattggaggaacatattagaaaacataataaagagagacctttcgtatgtacatcgcctgactgtaataaaacattcacgaaagattcccatttaaaacgtcacaaagttatggtccatgaaaagtcttgtgaacaaatatgtgactttgaggattgtgggaaaatcttcaataataagtacagtttgaaaaaacacaaaactaaagttcacaacaagaattattcctttatttnnnnnnnnnnnnnnnaaggattcctcaagaggtgccatctaacacagcatatgtttgtccacactggagaacctccattcaagtgtcatacgtgtaatctcggatttttgttatcaagagatttagctaaacacaatcgaaatcacaaaacctacacatgtgaatgtggagaaatttttgatcgatgnnnnnnnnnnnnnnnnnnnnnnnnnnnnnnnnnnnnnnnnnnnnnnnnnnnnnnnnnnnnnnnnnnnnnnnnatttagtgataaaaagaacttgcacgcccactataaaatttgcagcagcaaattccgaaaaacatttcaatgtccttacttgaactgtaccaaagtgtatcagtataatagaaatctgaaggatcacataanaagtaatcacnnnnnnnnnnnnnnnnnnnnnnnnnnnnnnnnnnnnnataattgtgagagagcattttcgcatcagtgtctttttaacaggcatatcaaaaacatggnagctaagaagacagcatc

SEQ ID NO: 7730 - DNA, 781 bp, Diabrotica virgifera
  misc_feature (679)..(679): n is a, c, g, or t
gcagtggcggctcgtggctttagggacagggtcggcaaggtttcgtctcctcagatagataagagacaaacgcagagagttgattttaaccaacgaaaaactacacaaatcgatgaaagtattttcggaaaacgttcacagaggtttgaaaaaagaaacacacccaacatcgatcgtgaaacgttttccaacatacgtgcaagatcttccaaacggaacagaaaacggcaaatttctagccctagacctgggtggcacgaacttcagagtcctcctcatcgagctcagtggcgaacactttgaaatgaaatccaagatcttcgccattccccaacacattatgttaggatcaggcgaacaacttttcgatcacatcgccgagtgtctggctattttcgtcaaagaagagcaggtggccgaccaaaagctacctttgggtttcacattcagtttccccttgtcgcagaaaggattgacagttggataccttgaaagatggaccaagggattcaattgctccaacgtagtgggaaacgacgtggtgcaaatgttgaacgaagctattgaaagacgtggggacgtacagattgagatatgtgctattttgaatgacactacaggaacactaatgtcttgcgcttggaaaaatcactcaacacggataggttctaatggtggngtacggctccaacacttggtttacgtggaaaaacaagcgaacgccgaaacttgggagcgacgtggacatgggctctgggaacgtgctgataaccctggaatg

SEQ ID NO: 7731 - DNA, 940 bp, Diabrotica virgifera
  misc_feature (780)..(780): n is a, c, g, or t
gaacaagggttgcttagaattggtcattgtatccaattccgaatttattttggacgtattttttttcacccctgagaaaaaaaatttcaccccgtattttccaatttgtgtaaaatggaggggatgtagagttgtaaagtttttcttatataatgatagacaatttcaactacctattgtcaaattttcatccttcctttatttttttggaggttttcgtaaaattttgcgttcccttatcgggctatttttaattggttcaagagtaaataaggacttttggttatgaaaattcattgtgtgtggttggtgttatttgttgttcgtgaatttgtaaggtaagaatatcaaattattaagatatttactgtcaacgggccattccaagactgacttttatgacaccaatatggccgatgggagacaaacattgtatttgtttatatttgtaccacattgtgtttcttaggttttttatgtttaatagttttattttccgaacattttgttgttgatttgataaatatagatccattttctctcaaggagtctgagttaacctacagtggagccagttttcaagcgtaactaacatgggcataattaattatctagtgcttagtaatattttatacacaagtcaacaagtgcagtgttctttttactgatcttttagatcaaatggactgatcttttaaagtgtgtgttaatgttactgacagaaatgtattagttaatttttccattgtaatatctgttttgacggtttttactatttgncaaaatgttgtcttctgctatgctaacttcttcatttttcaccgtttctaaatctactgagataacaatgctttgctagtacgaggatatgtccggtttctctaaaaatcgtctcatacttataatggatttctgtcaaaatgcctatttatggatatat

SEQ ID NO: 7732 - DNA, 654 bp, Diabrotica virgifera
agaggagtgtaaggaacgaacacgaatcaataggactaagccggagagaagtaaaaaataaagttaaaaataagaagggaacgtaagatcatctcaacaaacgaaataataaatcaaaaaacctcgacgaaacggcctaaaatcgcaaatagcgacgtaaggagcgcgtcgattctcgccaaacaagcactcttcatctctcaccgactcaagaaaacgcgcagagcgccctttcgatccacctaggagctcacaggacacagagaagtcgatcttaactccattaacaccttcatcgcggtcggcctccgcttcttcttctttctccgttttctcggggttagctttctagcagtcgtgtcgtttcggcatcggtaatatcccacacaacaataacgctagaaactcgcttcggaacattcctcaaagtataattctttcccatctactcaaaatacgtgcggtagtatataaatagtaactcagtatcatcaaatagaagggttatagcactttccttcggaacttctaaaaagtataattttcggtacacacaacaaagaagtggcgttagtacattctaagtatcaaatataagaacgtttaagtaacggtaagtagtacacactcagcatccggctcggcacattcgta

SEQ ID NO: 7733 - DNA, 511 bp, Diabrotica virgifera
cccacgcgtccggacttttgtattttacatttttttctgattctgtgaataaggcaatttgcaggggggtcgaggtatggtgaataaccctgtacaagtgtacactaatttttttgatcaggaatgtatcaaaataaatcttcgttttttgaaataaattcatttattcatctaattttgttatttaataactttgagcattggttcgacagcctcaccggatgatacgctacacagaaaacaattaatgctaggatattctaaaaattcattcaagaagaatgtctagttcaaagtttatgttaagattgcggacttatccacttgtcaagttatacaatttttctataatctcaaatatttggaaacaacagtccgtaatcagctaaggcctttacatatacttcacaaaacatctactaaatactatatgtattactgtaacattttttttgcgggatatttcctataaaaagacctaaaggttattgtacgttcgtttttgttcctt

SEQ ID NO: 7734 - DNA, 907 bp, Diabrotica virgifera
  misc_feature (51)..(73): n is a, c, g, or t
  misc_feature (637)..(637): n is a, c, g, or t
ggaatataaataattaagttggtgtccagtttgtgcattcatctgttagtnnnnnnnnnnnnnnnnnnnnnnnataaaaaacattgtaataatggacgataaggcgtcgtgtaaggagctggatggatggatagaacagttaaatgaatgcaagcaattaacggaaaatcaagttaaaacactatgtgataaggctaaagaaatattgtcaaaagaatcaaatgtacaagaagtgaaatgcccagtaacagtatgtggagatgtccatggacagttccacgatctgatggaactgtttaggataggaggtaggagcccagacactaattacctgttcatgggagattatgtagatcgtggatactattctgttgagactgtcaccttattggtagcactgaaagtcaggtacaaagagagaattacaattttgagaggcaaccacgaatcaagacaaatcacacaagtttatggattttacgatgaatgtctaaggaaatacggaaacgcgaatgtatggaaattcttcaccgatctgttcgattatttgcccctaacagcgctcgtcgatagtcaaattttctgtctgcacggcggattgagtcctagcatcgacaccttggatcacattagggcngcttgatcgtttacaagaggtacctcatgaaggccccatgtgcgaccttctctggtcagaccctgcgaccgcgggggggctggggcatctcccccccggtggagccggctacaccttcggacaggacatttcagaaacgttcaacataccaacggtctgtcttaagtatctagggcgcatcactcttccttgaagggtaacaattggtgtcacgaaaagaacgtagtgaccattttcagcgccccccattattgctaaccgatgcggtaa

SEQ ID NO: 7735 - DNA, 712 bp, Diabrotica virgifera
  misc_feature (29)..(46): n is a, c, g, or t
  misc_feature (281)..(340): n is a, c, g, or t
attgtcaaattgattattgtgtgttatannnnnnnnnnnnnnnnnngtgcattttatttgtcaataagatttagatcatccacatccataccgaataatcgttatgagacaagtgcattcaatatctcgtgaaatcttctctcttagcacacttaatctatccctccgtaagactactgtggaacacgctcgatctctccttcgttcatgatcttaggcaactacttcgctgactcacggaacaatgacgtacaccgtgtcatcctcttttattctcctcnnnnnnnnnnnnnnnnnnnnnnnnnnnnnnnnnnnnnnnnnnnnnnnnnnnnnnnnnnnngcctgttataatcgactggagctagaaaattgtggtccttatcccatcattgctaccgagtttgatatcctggtatatcattaaatgatgtatatttctccactgaatgatgtgatttttaacgaggatacaaactcacactctatcgtgcaggtggctctgtaatatggtatgaccacccgcctttattataaaatccgtcgaatgatactgcctaagaattataaacacgtagtcgtatttttcctgcatcatggaatcctataccgtaagataagcattatatttcatgatgtatctacatcgattcggagacattcacgatttttttactgcattgataatgatgctctctatgatattagcttctca

SEQ ID NO: 7736 - DNA, 231 bp, Diabrotica virgifera
  misc_feature (11)..(42): n is a, c, g, or t
  misc_feature (50)..(182): n is a, c, g, or t
  misc_feature (192)..(227): n is a, c, g, or t
ccccccccacnnnnnnnnnnnnnnnnnnnnnnnnnnnnnnnncccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaccannnnnnnnnnnnnnnnnnnnnnnnnnnnnnnnnnnngggg

SEQ ID NO: 7737 - DNA, 512 bp, Diabrotica virgifera
  misc_feature (370)..(370): n is a, c, g, or t
  misc_feature (391)..(391): n is a, c, g, or t
  misc_feature (415)..(415): n is a, c, g, or t
  misc_feature (430)..(430): n is a, c, g, or t
  misc_feature (438)..(439): n is a, c, g, or t
  misc_feature (452)..(452): n is a, c, g, or t
atttagtccactgtacaaatgaaccaaatgtttcaattccacagctagcaaatttgttaatagaaagatcacagaatacaaactgggtagtagtttacaaggcattagttacagttcaccacatgatgtgttatggaaatgagagatttactcagtacctagcatccagtaacagtacatttcaacttagcaacttcttagataaagggggacttcaaggatatgacatgtctccatttattagaaaatattcacgatatctcaatgagaaggccttatcatacagaactacagccttcgacttttgcaaagttaaaagagggaaggattgatggcatgttaaggacaatgaacgcagataaattattanaaactcttcccactttacaanatcaactggatatcctattggaantttgatgttccgcanatgatttnnacaacggagtgantaatatgtgtttcatgttgctttttagggatttatacgcttatttttgctgtataatgat

SEQ ID NO: 7738 - DNA, 880 bp, Diabrotica virgifera
  misc_feature (395)..(425): n is a, c, g, or t
  misc_feature (848)..(848): n is a, c, g, or t
aatgttgatgagaataataaataacttgcaaaagaaacttaatgtttacggatatttcgtagaatctataatgctagaactggctgtaagtttgctatttagaatgaagggtgttaacaaacacttatcaaacaagaaaactgcaatgtttccccatcttatggcatgcatacgactttaatagtatatgtatttgataagcaactcctttgaagtagctattgtttctttagtaatcgatgaaatcgataaaatataattaatatatttgaattaactaagtaacaaccatacttactagagaaaaacatgatattatggaaataaaaaaatattggcaagcggaagtaaagctttgggagcgtggcatacagatgaagtccaaaagcacaacnnnnnnnnnnnnnnnnnnnnnnnnnnnnnnnataaacgtcaaaattcatagttaacaaagtatcaaagatatgccgtattgtttatccttgtttaacttattgtagtttctatgaaccagcggtttaattttgcgatactagtttcggtaagtaaaaaagaaatctagtataataaattattcgtgaattattagaatctattcgttattagaatctatggaaattaataaattgaaaaatacatatataattatgaatgaacaactcgagacaaacagctccccactcctcaacatcttcagttaaagactttaaaaaggcaaacacatagtaaactagtaaactaaatcactcgagaaaggcactctgccgaaacatctgtagtcacatagttataataaattttgtgggagtatagaaaacaaacgttttcagtgttttattggtagatanaatgaacttcccatcagtaacggtcgaatcat

SEQ ID NO: 7739 - DNA, 897 bp, Diabrotica virgifera
  misc_feature (693)..(693): n is a, c, g, or t
  misc_feature (782)..(782): n is a, c, g, or t
  misc_feature (820)..(820): n is a, c, g, or t
  misc_feature (837)..(837): n is a, c, g, or t
  misc_feature (855)..(855): n is a, c, g, or t
  misc_feature (879)..(880): n is a, c, g, or t
cggatacttaacactaagaatacaaaagctagcaatttgttcgattttctgcattatttgttgataatatgttacttattagtgctactacttttattattgttaaaaattagaaagaatagattattatacggaaaaatcaaatattacataattacagaatcttacctatataaaaacttaggtataatctatcaattaaaccatatctgacgttgagttgattttaacccagggaagtgagatttatctgaactttgaataatctagatatctgacaacttttgtaggtattgcagacccatagaaagtaaatctatctattcatcaatagagagcaacaacagaatattacctctgaattctatactactgcatggattttaatgaaattttgggaatagcctctacttatctcataattcaaagtctaccctatgccgatgtgcgcttgtatcttgggggtggttctcacctggtgaaaatttttttggattaaataactgggggctagagaacctaattctaagcaaaaactcttctataattttgttttgaaaactcaatactggttgagttatacgtgactaaaaagttgccattttcatttgaaaatggtcaactttttggggacggtttttttgcgaatatctaccttaaaaattatgcatctaacgaataaaactgtataanatatttttgtaacttatgaaaagtcgagatgaagagattcgtttctttatgagttttctcgttgtaattcagggggaaataatggtggngtgaaaagagagattttttttggtgcatgctgaaaatncggtgtattccatattnaacagaaaccaggtcgantttttagggatgtgatgctaccanntatcttttgtagtactt

SEQ ID NO: 7740 - DNA, 68 bp, Diabrotica virgifera
  misc_feature (31)..(62): n is a, c, g, or t
gagtttaaaccggtgtgagccaggttggttnnnnnnnnnnnnnnnnnnnnnnnnnnnnnnnngaaagg

SEQ ID NO: 7741 - DNA, 765 bp, Diabrotica virgifera
atccgtgtcgctttctagtacttgggccaggttcgttaatgtcttcatcactagatatgtttgaaatattttttcttgcgtttctattccgatttcttgtttgtgtagatgaaataatgtcatcagtatccatgctatcggaaacatcagactcagctgtttgattgttagctgcatgttctatttcattattatcttcaacagtgctgtggtcttctattgttgacatccattcagtaaggcaacatggacaattatgttgattttctaaatatctttttaaacaatatatatggaatgttttatagcatgattcacatgattttccccagaatacaagttcagaacacaaattacatattgagtcgggcaagtgggtttttaaatatgctgtaaattctaatataagtctgggcccaagatatacataaggattcttattgataaaatatccatttttaatccattttcttaaaacctggcccaattgaaaactttagtaacagaaattaatagagaaatatcaaaacaatcctacaaattagcatttaatacttgcgaagttaccaatgaaccttatttaatatggcttaatacaaaaaatgatgatatagcaaaatttcagataagttattctgctctggagcttgaatattttcatgtgattcttcaagagattttacgttcagatgaacataggataactttcattgtatgcttaatttaacttctacacttacagcatcttacagtacagaaagtggg

SEQ ID NO: 7742 - DNA, 978 bp, Diabrotica virgifera
  misc_feature (5)..(33): n is a, c, g, or t
  misc_feature (35)..(56): n is a, c, g, or t
  misc_feature (58)..(70): n is a, c, g, or t
  misc_feature (98)..(118): n is a, c, g, or t
  misc_feature (140)..(162): n is a, c, g, or t
  misc_feature (164)..(177): n is a, c, g, or t
  misc_feature (179)..(201): n is a, c, g, or t
  misc_feature (207)..(235): n is a, c, g, or t
  misc_feature (247)..(301): n is a, c, g, or t
  misc_feature (303)..(715): n is a, c, g, or t
  misc_feature (717)..(746): n is a, c, g, or t
  misc_feature (750)..(822): n is a, c, g, or t
  misc_feature (826)..(850): n is a, c, g, or t
  misc_feature (852)..(882): n is a, c, g, or t
  misc_feature (884)..(911): n is a, c, g, or t
  misc_feature (922)..(965): n is a, c, g, or t
attcnnnnnnnnnnnnnnnnnnnnnnnnnnnnngnnnnnnnnnnnnnnnnnnnnnngnnnnnnnnnnnnnccattgtgagagaaattttatttcttannnnnnnnnnnnnnnnnnnnngtacctcgcgtatcagggatcnnnnnnnnnnnnnnnnnnnnnnncnnnnnnnnnnnnnncnnnnnnnnnnnnnnnnnnnnnnncatccnnnnnnnnnnnnnnnnnnnnnnnnnnnnngtatgaaacgtnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncgcnnnnnnnnnnnnnnnnnnnnnnnnnnnnnnnnnnnnnnnnnnnnnnnnnnnnnnnnnnnnnnnnnnnnnnnnncttnnnnnnnnnnnnnnnnnnnnnnnnncnnnnnnnnnnnnnnnnnnnnnnnnnnnnnnngnnnnnnnnnnnnnnnnnnnnnnnnnnnngggtgattacnnnnnnnnnnnnnnnnnnnnnnnnnnnnnnnnnnnnnnnnnnnngatccattttttt

SEQ ID NO: 7743 - DNA, 906 bp, Diabrotica virgifera
  misc_feature (228)..(248): n is a, c, g, or t
  misc_feature (327)..(346): n is a, c, g, or t
  misc_feature (411)..(457): n is a, c, g, or t
  misc_feature (597)..(617): n is a, c, g, or t
  misc_feature (744)..(744): n is a, c, g, or t
  misc_feature (824)..(824): n is a, c, g, or t
  misc_feature (843)..(843): n is a, c, g, or t
  misc_feature (859)..(859): n is a, c, g, or t
  misc_feature (873)..(873): n is a, c, g, or t
tttggtactttaggaataatttatcgctataatagcaattggcttattaggttttattcgtttgagctcatcatatatttacagttggaatggatgttgatacccgagcttattttacctcagcaactataattattgctgtaccaaccggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatcaaattanaaaaaaaaggacacgatacaactgccactggaataatcatggggattttacgtcaattgggcacacataacgaatatcanggatcaattttatgaaganatcataactggtattnaggagatgcacaanaaacagcagaccctgacgaccctaatgactaaa

SEQ ID NO: 7744 - DNA, 642 bp, Diabrotica virgifera
  misc_feature (11)..(114): n is a, c, g, or t
  misc_feature (116)..(147): n is a, c, g, or t
  misc_feature (166)..(221): n is a, c, g, or t
  misc_feature (239)..(320): n is a, c, g, or t
  misc_feature (323)..(361): n is a, c, g, or t
  misc_feature (378)..(409): n is a, c, g, or t
  misc_feature (444)..(462): n is a, c, g, or t
  misc_feature (467)..(487): n is a, c, g, or t
  misc_feature (497)..(532): n is a, c, g, or t
  misc_feature (554)..(579): n is a, c, g, or t
  misc_feature (604)..(631): n is a, c, g, or t
cctcccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnaaacacaagaacgcaggannnnnnnnnnnnnnnnnnnnnnnnnnnnnnnnnnnnnnnnnnnnnnnnnnnnnnnncccgccgcgttttttatnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnnnnnnnnnnnnnnnncccctctcctcccttcnnnnnnnnnnnnnnnnnnnnnnnnnnnnnnnnccaccaacaccacttttctctcttccagcggtgcnnnnnnnnnnnnnnnnnnntgcgnnnnnnnnnnnnnnnnnnnnnaaaagggaannnnnnnnnnnnnnnnnnnnnnnnnnnnnnnnnnnnccccaccccccaccaccaaaannnnnnnnnnnnnnnnnnnnnnnnnnccccacaccaccccaagctaaagcnnnnnnnnnnnnnnnnnnnnnnnnnnnnacgccgccggc

SEQ ID NO: 7745 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7746 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7747 - DNA, 695 bp, Diabrotica virgifera
gtaacaaaaattaaattaagatgttaaaaatgtaatctcactccctgtgtaccaacacatacagtcctaaacaggccaataccgtatacttaaacttggggtattcattcattaatatagtaaccatgcctacataaggcaaaaatcctcttgccctgcattccacagaagatatctattattcttaacgaattatacagaataaccatgttaaagtatgatgaaacagagtcttcaaaggcgaagatcaaaatattcgcctagtacatagatattgatgtctccttgaatacaatcatatttgaacagatgtatggacatagagaaacaaatttagataatatgatcaaattccagttaattaaagaatgttttacacaaaggagactctatcaaaatcaatgtatcgatgatattatggataggccagtattaatcgatcgagaagaagatatgatttcggactattttacggaacataaagatctaggcatatttccgttatatatataaagatgaaattagaaagagatttatagactacgaatgatactaacgcaatatccgacttaaaagacaatgttattataagagatgatgacaaaactccaactggatcttctttaatgttgaagactctctggctgccatccgcaacgatatgtaatagtatgcaacaacactccctagctttg

SEQ ID NO: 7748 - DNA, 149 bp, Diabrotica virgifera
  misc_feature (82)..(82): n is a, c, g, or t
  misc_feature (93)..(93): n is a, c, g, or t
  misc_feature (109)..(109): n is a, c, g, or t
  misc_feature (116)..(117): n is a, c, g, or t
  misc_feature (128)..(128): n is a, c, g, or t
caacgagatgggatgtggaatcgctgcaaaaatacgagtacctgctaatcaaatcaaagaaattgatatgagtctagtttgngacatgcctancattagctttcctaanccatgannaaacttacgancagttttatactgaacagttt

SEQ ID NO: 7749 - DNA, 640 bp, Diabrotica virgifera
agcatcctttactttaagtagaacagatctagaagcgagaattactaaaccaaaatttgttcccgaaaaactagattttcaactgtatgaaaaatttgaagatagctagcgcatgtccaaaatgtggggaaacggagcgtttagtcgcggcactttggtgtgtctcgcgcttttagtttatctgaaagatagtagctgtgtgactacaaacagacgagagcacttttcgcagttacctcagcggaccggcttttcaacaaacagaaacaatcagaggaccggtgtaaaagtgatggatccttcatttgagaatgctgggcaagtggatggtcttgaaatatggagaattgaagacttcaaacctgtgccttatcctaaaaatcaatacggcaaattctacacaggagactcatacattatactaaataccaaaactacaagaagtggtgccaaagtacatgatcttcatttttggttaggtgctgaaactagccaggatgaacaaggatcagctgccatatatacagttcagttggacgagcatttgaacggagaaccagtccaacatcgtgaaaaccaaaaccacgaaactcaactgttcttatcttacttcaaaagcggggggtattcgataccttcc

SEQ ID NO: 7750 - DNA, 799 bp, Diabrotica virgifera
  misc_feature (555)..(573): n is a, c, g, or t
ctccgtagcggaacatgccttagaaaaaagaaaccgtagagaggtcgtgcaaaaacatcgatctcataaacgtaatggtacacgtggaaagaaaatatgtaacgaaaaaacgaacgttaaggatgcgccatacgaaggatcagacaaagacaattcagatgtattacaacgactccatttatctcagcgaagagctttgctacgagctgctggcgtgacaaggatagatatgacagaaagtgatgagtgtaggaatattcgaacatctagaatgttatgtggatgtggatgtaaagaaaattgtgatcctgatacttgttcctgtagtcagtcgggaatcgaatgtcaagtagatgcagatcattttccatgtaaatgttccagagagaactgtaggaacttaaaaggaagaatcgagtttagtaaagatagagttagaattcattatacacgtacacttatgaggacaaatctcaataaacaagaagactggatggcgagattggatggagaagacataacacccgtactacagcagaaccaaagtttcgcggnnnnnnnnnnnnnnnnnnnttttaacccttagtctcccgacgggactttttataaccaccaaattcaagtacccttaaatcccaagcggtagagtatattttttaagaatggtttgttaaatatcattttattagtaattcactgatggttaatacttcaaatgtgctttcaacgattttatggtaaatacacaataagattttataagtactttaaaggatccttgggaaggaactaatgcttt

SEQ ID NO: 7751 - DNA, 796 bp, Diabrotica virgifera
  misc_feature (747)..(747): n is a, c, g, or t
  misc_feature (791)..(791): n is a, c, g, or t
gaggtaaataagatcattggagaataccaaggaggttttagaccaggaagatcaacaacagatcaaatatgtttattaaaactaatacagaacaacagctacgaacaaaatttgggactacacatgttgttcattgactttaaacaggcttacgactcagtggaccgagatatgctatatgaagcaatgagatccttgggtatttcaggaaagctggttaaattagtgagaatgacgctcaacaatacaaaaaacaggataacactggaaggaaatttttcaaaacaattcacagtgaataaaggactgaaacagggtgaccctctatctacagacttatttaacttggtactagaacacatagtaagaaggataaaaattaatacaagcggtaccatatttaacaacagacagcagtttatagcttacgctgatgatctagtcatcctaacaagaacaaaggaacatctccaaaaaatattccaaaagttcgaagcggaagcaaaaaggtatggattaagaatcaaccaaggaaaaacacaatacatggtaatgaaaggagatataaataaagaggataactatataaaaatgaaaggagaaggagatgaatataaatttaaggaagtagcagaattcgaatacctgggagtgactgtaaccagtactggaagggaagaaaaagaaatagataaaagattattgaagggaagtcgagtttggggggtgtcttaaacacgatattanaagcaaaaaatgtatcaataaacgcgaaaatcagaatgtatganacgat

SEQ ID NO: 7752 - DNA, 590 bp, Diabrotica virgifera
gcaggtaccgagttcggcgttccaccccccaccctgtcgtcgtgaacacaatataatatcttgggaataacaattaactaaaggtctaattgtgcctatcgaacgccacgactttcctttgggcatcacagtgcctaatagaattcaccagatcctattcatcagccaatggattggatcgagttgggcttgcggtgaggagtatcgaatgagcttgttctgtgtgaaaaacatatgccaattcgtgtgggagacacccttaaggtttagtgtatagtgctaaggagacatccaactgccagcagatgttggatcgcgacgtggaagacatgtgtcatgagctgggatgaaggagcgccatttccgatgtagcggatattgcgtagagacgagcgcttgcacaaaatatggggccttgtcacgttaaaatcgagagtgtatatggatctcatcgtcaacaaggtcctgaataagatgtaacgtcagctcttggtgagatgggatatcagcttggtagcccaagagaaaaagcgctaggattaaagggaagagcatatgggagttgtgaaatcgaggatattgcgcatgag

SEQ ID NO: 7753 - DNA, 718 bp, Diabrotica virgifera
  misc_feature (5)..(27): n is a, c, g, or t
  misc_feature (181)..(198): n is a, c, g, or t
  misc_feature (204)..(264): n is a, c, g, or t
  misc_feature (304)..(389): n is a, c, g, or t
  misc_feature (396)..(413): n is a, c, g, or t
  misc_feature (415)..(458): n is a, c, g, or t
  misc_feature (460)..(656): n is a, c, g, or t
  misc_feature (660)..(713): n is a, c, g, or t
tttcnnnnnnnnnnnnnnnnnnnnnnntctttttcagtaaatagtaatagaaaaattcttcatctctcacgatagttaatctcgtatccgtgagagaatctttctctttcttctaaaagaaaaatcttatttttcgtacctccgtgtatcagggatctatctcaattaatcaattatcatnnnnnnnnnnnnnnnnnncttaannnnnnnnnnnnnnnnnnnnnnnnnnnnnnnnnnnnnnnnnnnnnnnnnnnnnnnnnnnnncgaaatcgttattcgtttttaaatatcatctaattttttnnnnnnnnnnnnnnnnnnnnnnnnnnnnnnnnnnnnnnnnnnnnnnnnnnnnnnnnnnnnnnnnnnnnnnnnnnnnnnnnnnnnnncgagctnnnnnnnnnnnnnnnnnncnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatnnnnnnnnnnnnnnnnnnnnnnnnnnnnnnnnnnnnnnnnnnnnnnnnnnnnnngccgc

SEQ ID NO: 7754 - DNA, 514 bp, Diabrotica virgifera
  misc_feature (347)..(377): n is a, c, g, or t
gatccagatgcccagctggctctggccggtgcgcatgtcgtcgaacgtggcggccaggtcgtgcaggccgcgcgcgttgttctgcatgtcgatcaggtggttgatgagttccagcttgccgctgacctcggtgatctcctggcgttcgacttcgcgcttgagggcccagaacagggtggcgcccgcgacgctggagaccagcagggcgatgacgcccagcagcagggtcaggcgcgcctgcatcgagcgcacgcgcggcggtttcattcgcgcgcgggctccggccgcgattcgagcacgtagcccatgccgcgcacggtgtgcagcagcttggcctcgaacgggtnnnnnnnnnnnnnnnnnnnnnnnnnnnnnnncacgtcgatgacgttggtgtcgctgtcgaagttcatgtcccagacctgttcggccagggtggtgcgcgacagcacctggccctggcgccgcagcagcagggccagcaggttgaattccttggcggtcaggtccaggc

SEQ ID NO: 7755 - DNA, 929 bp, Diabrotica virgifera
  misc_feature (819)..(819): n is a, c, g, or t
  misc_feature (851)..(851): n is a, c, g, or t
  misc_feature (879)..(879): n is a, c, g, or t
  misc_feature (887)..(918): n is a, c, g, or t
cttttaatggttttcaatttctctttaacagacttcagaatcagtccaatttaaccgagactgttacgagtaatgttttgtctctcatggataaattgtacaaatctacaccatttgatgttatagatgacgataaccaagttttcactcttaaaaaaatgttgacacttagttgggcttgccaattgggccatcctgagtgtctcgtcatgtcacgtgcttcattcttatcctataaattgagtggagtaaaaccacaaaagaacttgcgcagtacaatatattgtacagctctgcagacaagctcagaaagagaaaattgggactttttgcttaaggttcataacgaagccgaccttgactctgagcgccctcttttgctcaaatctttagcttgtacacaaaataaagagcttctacaagaattgttgttgttgactattgctgacgattctccgattgctcgagaagattgtataacagttctgggtagtgttgctgctaattcaaacggagctgaacaagcgtttgattttgtaattaataactacgataatataactcaaaggtaccaagctacgaatacaatagcgaatattttggaaataatcggtggtgctattacaactgaagaacaagtggacaagttccgatctttcatcaatggtggtcaattaccaaaagactatgttaacgatggcgaaagagcactggaaattgcacagaaaaaccttaactggtcggaaaaacacgaaaaagatctaattaatcattactatccagagtcaaaggaaccagacgaaacctcaccatatacanggagagggagtttctataggttcgaatggttngatcattggttttatagtatcatatttnattattgnnnnnnnnnnnnnnnnnnnnnnnnnnnnnnnngggagtaaatt

SEQ ID NO: 7756 - DNA, 822 bp, Diabrotica virgifera
  misc_feature (8)..(701): n is a, c, g, or t
  misc_feature (708)..(745): n is a, c, g, or t
  misc_feature (765)..(778): n is a, c, g, or t
  misc_feature (781)..(797): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnaaagtctggtccaactttaaaattt

SEQ ID NO: 7757 - DNA, 910 bp, Diabrotica virgifera
  misc_feature (6)..(151): n is a, c, g, or t
  misc_feature (166)..(186): n is a, c, g, or t
  misc_feature (188)..(243): n is a, c, g, or t
  misc_feature (251)..(289): n is a, c, g, or t
  misc_feature (352)..(379): n is a, c, g, or t
  misc_feature (394)..(615): n is a, c, g, or t
  misc_feature (622)..(642): n is a, c, g, or t
  misc_feature (660)..(700): n is a, c, g, or t
  misc_feature (749)..(786): n is a, c, g, or t
  misc_feature (819)..(848): n is a, c, g, or t
gttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctttttctgtcnnnnnnnnnnnnnnnnnnnnngnnnnnnnnnnnnnnnnnnnnnnnnnnnnnnnnnnnnnnnnnnnnnnnnnnnnnnnngggggagnnnnnnnnnnnnnnnnnnnnnnnnnnnnnnnnnnnnnnngaataaagtggttaatgttggaggaagaagagtaattataggatataggagagagagtagaannnnnnnnnnnnnnnnnnnnnnnnnnnngaaaaatgaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccgnnnnnnnnnnnnnnnnnnnnnagaggagagagaggaggnnnnnnnnnnnnnnnnnnnnnnnnnnnnnnnnnnnnnnnnnggtgcagtcccccctccttctttctttttctttttttgtgggggtgggnnnnnnnnnnnnnnnnnnnnnnnnnnnnnnnnnnnnnngagaccggccctcccttttgtcccctctttctnnnnnnnnnnnnnnnnnnnnnnnnnnnnnngaagggggagaggggagggggaggggggagggggggcgggggtgggggcggggggggcggtg

SEQ ID NO: 7758 - DNA, 976 bp, Diabrotica virgifera
  misc_feature (334)..(363): n is a, c, g, or t
  misc_feature (717)..(717): n is a, c, g, or t
  misc_feature (720)..(720): n is a, c, g, or t
  misc_feature (738)..(738): n is a, c, g, or t
  misc_feature (845)..(845): n is a, c, g, or t
  misc_feature (850)..(851): n is a, c, g, or t
  misc_feature (914)..(914): n is a, c, g, or t
  misc_feature (924)..(924): n is a, c, g, or t
ggcatgctatgattttgtttttaggttataacttataaatttgctcaatttgctcggttttttaatagatgaatgtttttagttccaacaattccaaaaagatacaatgaatatatcatcaccagtacatagaattttgccttgtaacaattcatcaattttggaaagaagtatagtcataaataaaacgaaacattcagtcaaacaagacttcttgtggttcactattaacattgcatttctgtctgctattttatatgatttgcacacagcatgttatacgtattcaaattacatctattttgccgaatgcttgttggcaacagttttgagnnnnnnnnnnnnnnnnnnnnnnnnnnnnnngttaagaacttccctgcctttccgtgaacctctcataatcaatgaagaacagaagaagctcctaggtgttaaagactcagatcctaattacagagtagtaaaaacaccaagtaagagtccaactcctcaagatagtagcacatcaacacctataaatatcacctttaagaaatcaagtatatctcaatttgagcctgacagtttaaactactctacgtcctctccttcgtggatttattttaaaggaacaccagaccgaagctctggtcatttctcacctacgtcttctcctaatttttcaggcatccctaaataaatcttctttccgtgatatttctccggtagaatttatcnggngacgaagatgctctaagnaaatatttgaaagagcataaggaaatcgaaaaagttaataaactagccagtaaaaaacagaattcttcaaatttattaagttctttttggagccatcctgtcacacnaacanngctaagatgtatcagaatacccttagaaagtgtcaatacccactttcgtcacaattcattggngaaaacaccnagcagtcccaattttaaaaggtgacgacaaggtctgcgagtcctgctcaaac

SEQ ID NO: 7759 - DNA, 911 bp, Diabrotica virgifera
  misc_feature (557)..(584): n is a, c, g, or t
  misc_feature (784)..(784): n is a, c, g, or t
  misc_feature (788)..(788): n is a, c, g, or t
  misc_feature (799)..(799): n is a, c, g, or t
  misc_feature (837)..(837): n is a, c, g, or t
  misc_feature (848)..(849): n is a, c, g, or t
  misc_feature (864)..(864): n is a, c, g, or t
  misc_feature (891)..(891): n is a, c, g, or t
gcttccataatctgattttatttttaatcaagacttaatttttatcaatattaacaaaacgtctattagataagtatttatattttaattgtaaaacaaaatagggtatcgtatcaaattttatcgcgaaaaaaatcaataaaaaaactctcggatcgtgcatttagtggataatttattaatacatacgccaagacccaagaaaaagtttgtgaatctttttgattttgtaaatactttgttaattaaaactttgttaactttatgaaataatagattgatatattcgatgtttgaacaacaaaaacagtgtgccctttttattattttctcctatatttccttttcatacatttatggctgtttcttcaattttaaacctatcctaactatacagaattgtttattagtctcgtcagggtataaaaagacaaaatttgagaaaagatacctctgaatatatttgtatctaaactttttatcttttagcagttagttctatttaatcagtgaccagaatatggtattgacttcatccgtatttaaacggcttagcnnnnnnnnnnnnnnnnnnnnnnnnnnnnacattacaacaaatttggaaacaaacaatacactgagatttgtcatgtccaaaacaaaacctaacaacacacaagaaagatcaaagaactgcatctataaaataccctgtgaatgcaacaatttctatgtgggagaaacatcaagaccactaagtgtcatgagaaacgagcatgaaacatacataaaaaacaagagagtntggntcaatcacaanattagcaaacatgcctggaaacacgatcacagagtacnatggaaatatnngctcatagtcatganagaaacacagcaaaaagagaaaaatcnaagatgcagctctcatctga

SEQ ID NO: 7760 - DNA, 926 bp, Diabrotica virgifera
  misc_feature (2)..(702): n is a, c, g, or t
  misc_feature (710)..(710): n is a, c, g, or t
  misc_feature (712)..(712): n is a, c, g, or t
  misc_feature (734)..(735): n is a, c, g, or t
  misc_feature (792)..(792): n is a, c, g, or t
  misc_feature (884)..(914): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttagngnataacagcgtaaattttattgnnagagtcaaatcgataataaagattgcgacctcgatgttggataaagtttatattggntgtagcactatatttataaagtctgttcgacttttaaaatttacactgatctgagttttaaaccgtggggaggcccaggttgggtttccatnnnnnnnnnnnnnnnnnnnnnnnnnnnnnnncaaaaggaccaa

SEQ ID NO: 7761 - DNA, 788 bp, Diabrotica virgifera
gcttcttaagaagtaatcgtaacgcttaagaagtaatctcggttagcagcctcttccgattcactcctagacataaacctccgtttcgaggtatctcggttccagtttctccttactttttctttaattttgtcgatccacgtttttcgtgattttcctagtagtaaagcttagtttgccgtttgctatccatcgccattcttattcttctcgtaatttccgcagtttaattttgtttccctcgctttattttatgccccaagtacacatactcttctacattttcaatgtttctatgatcaagagtgcaactattagtcctactttttgttatatacttgttttaattctattaacatttctatacgaaatactagaagaatgtagcacaagagggtgtctataaaactgtacagtataacattttatcttaaattttttacgttatctggtcaaggtgttcttacaagttacttgtttaaatggtgcatctctgtattgtataacttaacaactgtgtattgtataactgtgtttagttagttagttaaatttagacacgttttaatatgatttttatttggttctatttagttactggcagtacatatacagagctgcgctagtaatatttcctattattagtattttttacgggatcttgaaataagaaaatgtgatgtctagttattagtttacttttataagttataatatatcgatggaaatgatgtaatggaaacatgtctgtgtatataaaatagattattcatgattattagagactg

SEQ ID NO: 7762 - DNA, 656 bp, Diabrotica virgifera
  misc_feature (20)..(67): n is a, c, g, or t
  misc_feature (74)..(99): n is a, c, g, or t
  misc_feature (104)..(126): n is a, c, g, or t
  misc_feature (133)..(209): n is a, c, g, or t
  misc_feature (263)..(288): n is a, c, g, or t
  misc_feature (301)..(338): n is a, c, g, or t
  misc_feature (340)..(556): n is a, c, g, or t
  misc_feature (558)..(619): n is a, c, g, or t
cccccggggggggagaacannnnnnnnnnnnnnnnnnnnnnnnnnnnnnnnnnnnnnnnnnnnnnnngagagtnnnnnnnnnnnnnnnnnnnnnnnnnnggggnnnnnnnnnnnnnnnnnnnnnnnccgcccnnnnnnnnnnnnnnnnnnnnnnnnnnnnnnnnnnnnnnnnnnnnnnnnnnnnnnnnnnnnnnnnnnnnnnnnnnnnnccccctcccctcccggcggggagaagaaaaggggggcccccaccaccccccctnnnnnnnnnnnnnnnnnnnnnnnnnnctttctcccaacnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnntctctctttccttcctctcttcttcttctttcttatt

SEQ ID NO: 7763 - DNA, 469 bp, Diabrotica virgifera
  misc_feature (80)..(123): n is a, c, g, or t
  misc_feature (284)..(298): n is a, c, g, or t
cgcgagcagtcagtgtgttttgtgaggtgttagctatgatttctacgagctcaaaaatagcttgagttagaatcatgatnnnnnnnnnnnnnnnnnnnnnnnnnnnnnnnnnnnnnnnnnnnncatctattgctcgatcggtatccatatctgataatacattatgcacatgctgttattagacgactccccaatggattatcgcagagggccacgagtttatattcgtagattatgaaatcttcctccacgcagatcacataactatcttaggaatatcccannnnnnnnnnnnnnnttagacatatcctgttggctgtgcatacgagcaacaactctaccacactaatcgtacaattattccgatgtattacaagtattcagcggatcagagggaccaggaactagtctatcacgaactaactattattccgatcactgtagatgagagatcttgataatcctaaac

SEQ ID NO: 7764 - DNA, 920 bp, Diabrotica virgifera
  misc_feature (794)..(794): n is a, c, g, or t
agaagtcaacgtgttttgtgtggtgccactataatttttaggagctcgaaaatagtttggctttaaccaagaaatgcctggtttaccagaacaaatttattgcgcggagcagatcacaattcctccatcgtttccatatctgttaagacagtatgcaaaggctgctattagaagtcaacccaatgatttattgcagtggtccacggcttattttcgttgcttatcactcttcctccaccagtcaaaccacgtctagaatatcccatacctcgcgatcattacggaatcactcctggctggctaaaggcactactctaccaactaaccaacaataagaccattcattttaagatcctgtgggatcgatggatcggagcttgtctacctcattatacccttattcaaattttgtgtttgggaggtttcgataatcctaaagagataccatggttgaggtttattggactgtgtgcggcccatttaacagatagtttgacggaatccatgaaacttatatgcgagataatgaccgaagaacccgaaggtgcctcagctatgattcctttcgcaacatttatggatttgtataaatttctcgccaacatagacgcttctaaacctcaatggttaaaaaatatgtattttaccgattcattactgagtttgtatagggaagtatcagaaaaagaagttaaagaggaagtaaaagaagaggttgtaattgaagaggaaagtgaaaaaagtcaactgctcgaaaaatcagaatctgaagagctagaaaaggagttaattanaagaggaagtatcctgtccaagtttaggaaaagatgatccactacgatgttgactactatatttcacatgtttctgaacaagaagcagaacaggaacatgagatggaggaaggctgaacttcaaaa

SEQ ID NO: 7765 - DNA, 152 bp, Diabrotica virgifera
  misc_feature (53)..(86): n is a, c, g, or t
atcaaccacaaaagacaacatgtgtgacgacgatgttgcggctcttgtcgttnnnnnnnnnnnnnnnnnnnnnnnnnnnnnnnnnnccggagatgacgcaccccgtgccgtcttccccctcatcgtcggtcgcccaaggcatcaaggtgtca

SEQ ID NO: 7766 - DNA, 453 bp, Diabrotica virgifera
ggggtagctgagcccggctggcccgcttgccccttttcccccgatcacgaaatccatgactctttatttcttatctatacctggatacatgacattcctacattcctagaattgcttcctggaatcttgctatattttctataatagaccaaatcccattactccattccaaagccccataacctaaaaaaccattaatttttctacctctaggtctcgggattggagaaagagagaaaaaaatagcaaagacgaaatgtctaaactctttgagggtttgggtgaaaaggagaaaagcgcacatggcacacctcccgtcttcccgttgcggtattgactgagttggtgagaaagttatgacatgatgccgagccgccagacgcggagacgtgattaaagggctcattgtacaccggctgcttgactgaattgccgctgaatcaatacgatcgt

SEQ ID NO: 7767 - DNA, 769 bp, Diabrotica virgifera
  misc_feature (51)..(68): n is a, c, g, or t
  misc_feature (182)..(199): n is a, c, g, or t
  misc_feature (726)..(726): n is a, c, g, or t
attggtataaacactgaaagtttattaacaactagaacacagtatacatcnnnnnnnnnnnnnnnnnnttagttatttgtttagtagggaacacgaaccttttggtcattacttgtgtctgagttattttgtaccctgcactaattagaaacgcacttagtaaattatactacttttttggnnnnnnnnnnnnnnnnnnggtagtcatagttcgtgaagattttaacaaatttgtatttctcgtcgaaactgtgagtttttatatttatacataatttttttcagatttatgaaaaaaatttattaagttattgcatatgaaacactttacaaaagttactttttgtagacaaattgtttgatgataccagtcatagacagttaccatttattgttgctgtgaacatttttatcttttttgttattgatatgtcattgtggtcatatacattctatattagaattgacctaacttaaaatatatcgccaagtatttttcgacaagaactaaaaacgtttttgaaacattgctgcctgtaaaatgtggtagcttcgtctgttatacaaatgcaggttatttcttttgttgattgtttttatgtttatatagtctatttttggttgaagttagtttactaggctttaaaaccattgttgaaattaaactaaaattgttacaggttaaacactatatattgaattagattctgcatatttgtagttcanaacagtaaattaatatacgagtaataaaatcaagatccatttt

SEQ ID NO: 7768 - DNA, 676 bp, Diabrotica virgifera
attttgtggggtgaagattagttgaaggggaaaagggtttttgcgatcagcatgtatgggatgttgttggagagcgtccagcactttgtgcagctggaatacggcgaagatgtttggcagcaattattaatagaaacagactataagttcactgtatttaatacacatcaaacctatctagacaatatcatgtcttccttggcagcggccttagcaaaggtcacttcactctccgtagatgatactatgatgttttttggacgatgttttgtacggttttttagcaattatggttatgacgttaccataaaggcaactggtagatattttacagactttttaagtagcatggataaccttcatgctcagtttagggtgtcatatccaaagatgaagagcccctcaatgtatttgactgatgttgataacgaaggctgtgttttggtatatcgcagcactagaaaaggatttactcaatatatacgaggtcagctgtatcaaatagctactgattttttcaatttaagtctagaaactcgggtaattgacactgtgaataaggtaacatcggatgcaaggaatttgacaatcgttaccttccgattggacttcgataattcacagaatatattgcaacagcacgcagaaaaagtgacgcacataaaatgccgacctc

SEQ ID NO: 7769 - DNA, 572 bp, Diabrotica virgifera
  misc_feature (356)..(374): n is a, c, g, or t
  misc_feature (509)..(547): n is a, c, g, or t
ggaaatcattggaaattgcaaatttgacaaatgaaaatcgcaatgggagggagcgcacaatatttttggttacattttggtggaggttgttcctggcgtcgtcctttgcagcacctgataggtttcgaaaattcctgaattatatcctaaaatcgaactatttttcacccacagcctggggtaatagtcggaatgaccaaatgggataaaataagaaataatgagacaataacatgtgaatgatcaggtaatactaaagtagcatttaaaaattcacttttaataacagaactataggaccagtggccctgcctattataccaagctgcgatggtaagtttgatgcgacgatgccnnnnnnnnnnnnnnnnnnncttttttcttgtgggatcttaatgcaatttactatttttattgggaataaagtaccatcaaattattggatctaccctttttataagggttcgtggataaacttaaccaattgggtaataagaatggcactcctnnnnnnnnnnnnnnnnnnnnnnnnnnnnnnnnnnnnnnntataaggcattcattatttgaaagg

SEQ ID NO: 7770 - DNA, 557 bp, Diabrotica virgifera
  misc_feature (456)..(476): n is a, c, g, or t
ctagttctagatcgcagcggccgctcgagatcttttctattctacttcttaatcatgagaggcagcagcttatctattaatctcgcccgtgtaacgaagaaacggtaataattttccgaaagacagacccagtccaccatgaaaatggagggggagaggttccagcctctcgtataagtacaataacgaccagtctgaaagatgatagatgaaatacaggatggaacatttctaaaaactgcactgatcaaatgtctcgagaacattaatcattcactatggccgatcctatactttataatgttcagacacaaccaatcacctgtttattcaacctatacccgaattcattgcatatacaaccactttatatattgactacatcgaagctgcaggagtaaaattcattattgcctataaagataaccccataaaagccatagcaaggtatgatannnnnnnnnnnnnnnnnnnnncacatatgaattgatggatgaaggcatcaatacctatttcacaccattttgatagataatagagagacaaatgccatttga

SEQ ID NO: 7771 - DNA, 508 bp, Diabrotica virgifera
  misc_feature (3)..(20): n is a, c, g, or t
  misc_feature (53)..(75): n is a, c, g, or t
  misc_feature (99)..(130): n is a, c, g, or t
  misc_feature (160)..(195): n is a, c, g, or t
  misc_feature (206)..(296): n is a, c, g, or t
  misc_feature (310)..(344): n is a, c, g, or t
  misc_feature (346)..(415): n is a, c, g, or t
  misc_feature (435)..(507): n is a, c, g, or t
tgnnnnnnnnnnnnnnnnnnaggggaggggggtgtttttgttttgtgtgaacnnnnnnnnnnnnnnnnnnnnnnnaccacctggtgtgcggggtcctcnnnnnnnnnnnnnnnnnnnnnnnnnnnnnnnntcccttcccccccacccaaaaaaaagaggnnnnnnnnnnnnnnnnnnnnnnnnnnnnnnnnnnnncacaccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttttggtggagnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnngcccgccccccccttctctnnnnnnnnnnnnnnnnnnnnnnnnnnnnnnnnnnnnnnnnnnnnnnnnnnnnnnnnnnnnnnnnnnnnnnnnnc

SEQ ID NO: 7772 - DNA, 753 bp, Diabrotica virgifera
ccgggcatgtccctgcgccgaccccaccccgcccgcccagctcagcacacagcaataaatcaaccctgaccattccatcattgaaaaccttacacacaatacagaacttgataaaaattgtctaaggctgtagaataatcttgtcatcttgctcttctatactgccctccttagctctgggtttactttatatgaacctccattacacgcatctaggaatctacaaaatgatccatacttgcattgagcattgaggaacaagaatctatgcttactgaataaaccccatctggggaagctcctgctgacgacgctggagatgcagaagatgcttcccgaatggaataagaaaattacatgcatacttatagatgacatgtgggaaggtagtgctctaattataatgtcatctctatcgcaatatttgtgaatataatatattacttttttatacatattattactaacatttatttggctactgcaccatactgcattgtgtaatagtaccttatgtccggatgacatcaaaatgagacctgaattcccgattatagatcattatattgaaccattcagaaacgcagcccacccacactaaaatgatgcgaacatcgtcttgaacctcgtatcgccacactgttatttcgtctacagtgactccgaagttcaaattgccggacccctttctcacccccctcgattgcgccacccagacacgacacaacctaatcccagtatcatgaaatcccc

SEQ ID NO: 7773 - DNA, 519 bp, Diabrotica virgifera
  misc_feature (15)..(144): n is a, c, g, or t
  misc_feature (149)..(191): n is a, c, g, or t
  misc_feature (204)..(386): n is a, c, g, or t
  misc_feature (390)..(424): n is a, c, g, or t
  misc_feature (427)..(445): n is a, c, g, or t
  misc_feature (447)..(490): n is a, c, g, or t
ttttacaacacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtnnnnnnnnnnnnnnnnnnnnnnnnnnnnnnnnnnnnnnnnnnngggggccggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaannnnnnnnnnnnnnnnnnnnnnnnnnnnnnnnnnnacnnnnnnnnnnnnnnnnnnngnnnnnnnnnnnnnnnnnnnnnnnnnnnnnnnnnnnnnnnnnnnnggttggtgtgcccgcccccctcccccccc

SEQ ID NO: 7774 - DNA, 827 bp, Diabrotica virgifera
  misc_feature (19)..(105): n is a, c, g, or t
  misc_feature (107)..(131): n is a, c, g, or t
  misc_feature (144)..(275): n is a, c, g, or t
  misc_feature (285)..(310): n is a, c, g, or t
  misc_feature (320)..(399): n is a, c, g, or t
  misc_feature (412)..(455): n is a, c, g, or t
  misc_feature (496)..(608): n is a, c, g, or t
  misc_feature (613)..(732): n is a, c, g, or t
  misc_feature (779)..(819): n is a, c, g, or t
gggggggaggaaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnccttctcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggggttnnnnnnnnnnnnnnnnnnnnnnnnnnaccaccccannnnnnnnnnnnnnnnnnnnnnnnnnnnnnnnnnnnnnnnnnnnnnnnnnnnnnnnnnnnnnnnnnnnnnnnnnnnnnnnctccccccaaacnnnnnnnnnnnnnnnnnnnnnnnnnnnnnnnnnnnnnnnnnnnnttcttttttctcttcccctccccttcttcctcttctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctccctcgaccccaaccaacaaaaaacaacaaaagaaacgcgannnnnnnnnnnnnnnnnnnnnnnnnnnnnnnnnnnnnnnnncggccccc

SEQ ID NO: 7775 - DNA, 771 bp, Diabrotica virgifera
  misc_feature (625)..(625): n is a, c, g, or t
cccacgcgtccggaaaaatggtggactatagtttccgtggtattagaaaaggcgattttgtgttcttatttgaccggccaatgtacaagactacattttactagcattcgagatattaggagtgaacattaacacgcctctgaatgagaaaaggaaaatttatgataatttaattaggattttaaagaaacaaataccgtttggtgatccaaaactaactcagaacatcttacaaggtgccataatcctgtggcaatcatttgtcactgaaaaatctttaaaaatttcgctggacgtaactaacattacaacttgtctgacagtcaaagggagatttatgaaaaaaacatatgaagtcgaccagaaaatcattgggggagctttttataaggtctacatggtccatttccaataactctttcaaacatttgccatatcagtcagtgctgaaaaccagataaacgaatacagtgtccaaactgacaatgacgagtctttaagttttcaacaagatgaaattaagaggtttatcgtcgagtttccagcggatcctgcggacataataaggatatccagaattctcaatcacctctaccttgtagcacaccagaatggtccatagatntgaatttgctgctacactaccacacgacatcatctagagctgaccatttcaatataataaaaaataagatcaatttcgacccattcagcttttaccccagcgacgatgtggctagagagtcaaacttcaagttgattcgaaatgaa

SEQ ID NO: 7776 - DNA, 609 bp, Diabrotica virgifera
gacatcgactcgaagagaggttgtctgtggtgaatatttagttaggctgatattgtaaagatacccttgaggtctttaattttcaagatattatgatgatattctaaaaacagtgcctatggaaccgccattgtggcttcttttgtcgaatttaccttacaacgtagaataaagattaaccctctttattaaataataccttgaagttatgcaataggacaggatattcagactccccgtgattgatatcgatttctaaagtggtacggaatacatcgcgtattgcaaaacacgagaggctgtattgcaaaagatattcattcttgccacaccatttaaatcattctgactgaggattgacaaaccatcaaccatccatatagttagagtgattagataaatcatgaggatcgatacagacctgcgacctaatataagtgatactttagggctgaggctatcggtgccaagaacgaggtgggacctgatgaaaaaccgacgacattgaaggctgataccattacagttactaagctgatggagcagaatatagcccaattggaaggtattgcacacaaggtagacccaattgtgatgcctctgttccta

SEQ ID NO: 7777 - DNA, 567 bp, Diabrotica virgifera
  misc_feature (377)..(422): n is a, c, g, or t
ctttttataaaattaacgcgcaaaaacaactcatattttaattgctgaatgttatcatgaaatcatgaacaatctttgtcagcaaaagtacatgaaagatcagaagatctccaaaaaccagaagtattctcccaaagaggttacaccagcatatatgaaatggaaaatacctagggatcatacagagggacaggattatagtcgattaagaaatttgtacaaagaaaatacttataccagacttcttctaaagattcaaggtcctatcctcttatctccgggagcaataaagaattgccgcgagtcgaaaaaagaacatgaatccgaagatctacagtcttatatacctgaaagacatcagatattaagtaacgaannnnnnnnnnnnnnnnnnnnnnnnnnnnnnnnnnnnnnnnnnnnnnaatttttagagaagacaagagcacaaaaacggacgatgagaaccattattcacttcctagacattatgaagagaaaaaaaatcttcaagacattgactgcacagacatggacttatattactaatgataagataatataagagat

SEQ ID NO: 7778 - DNA, 920 bp, Diabrotica virgifera
  misc_feature (370)..(400): n is a, c, g, or t
  misc_feature (410)..(429): n is a, c, g, or t
  misc_feature (500)..(517): n is a, c, g, or t
  misc_feature (796)..(796): n is a, c, g, or t
catcttcccatcctacgacaattcatcttcccatacgacacttttgaaattatcataagtttcaatactaataaaaggttcaaaaacttaggttatgcaatatattttgggattttcttgggtacagatatattaagtggttcttatattgataattatatcaatttttcccttaaaaaccaatagttttctgacaaaaaaaatagaattgatttgaggaagatttaacatttattgtgtgttttaaatggagatatcagtttaattcgcacaaaaacccaaaacaaaaagtagaaaaagtttagcaaaattacatacttatttattgtgaattttctggaaggtgcagcatttttatcatgtagtcatnnnnnnnnnnnnnnnnnnnnnnnnnnnnnnngttttagatnnnnnnnnnnnnnnnnnnnngtccttcaagcactaatcaattaaaaatgtaccatatatacggattaaataaaaattaaacaaataaacannnnnnnnnnnnnnnnnntagaaatattcggaaacgcaaccacaacataaaaatgagggttaggtttgaaccactaacaaaaactgtcacatgtcaaccttgactttgtcgtacgagtgacgtagtcctttccctccccctcgcttccgcccacatagttacgagacaacctacctcatatctatgaaccttgatcctacacaatataaattggcagcctgccctaccatgatgcatggacctgacggaggttcccatgtcaaaaaatgatttcgggatagaactgagaataattanacagatagcagtggacagtggctgtagcgagcgggcaatgacaaaatctgaaccaggatttcgtgggaagctctaaactataatagtctgtccacaccagatgagagccattacttctgctctg

SEQ ID NO: 7779 - DNA, 750 bp, Diabrotica virgifera
  misc_feature (561)..(579): n is a, c, g, or t
atcttggatttgtgtgtctcttagtagttctaagtgtcttccttcaccttccactactacatacgctgctcttctgtcttttcctactctactattgacttctttaaactcctctgtccctttccctcctttttttttattgctgtaaggactgatatctagataatcattaagttcttcaaacttataatttgcttaatgtttttctgatataacataatgtttttagatatcactctagttagttatggttttctggtgtgtcagcaatttttctgctagctttcagctagactgtaggtgtatagctaatttctggtatagcagttgctttcttcttctcagtcctatctgtgaagtcaagttacgttaggtatttgataccttctacgcacagttccatcaattaacagtctacaaaacagtttaccaaagatgctgggtactgcctatatgaaatatgtaaaaataaattatagattctgaatatattttccgacaaaactatgtacattgtattaatacatttttatgtacttgtaagttttacataagataccnnnnnnnnnnnnnnnnnnncaaattctaattttttgccacgttatgacagataagtttgtataaacagaatataatagaaaccttgatacagttttgcatattattagtatcttgaagactatattattagcttggtgactatttttttatgccaactatgatgtgcgatatgcagaataatctttatta

SEQ ID NO: 7780 - DNA, 709 bp, Diabrotica virgifera
  misc_feature (184)..(209): n is a, c, g, or t
  misc_feature (292)..(322): n is a, c, g, or t
  misc_feature (324)..(378): n is a, c, g, or t
  misc_feature (380)..(708): n is a, c, g, or t
ttattttcttacaaaacataaaaatcttcttttactgacaaactgtaaagacacaaattttctcttcaacgaatagttcattcagtcaccgcgagagaacacttctctttctcaaaagaaaaattctccctccgtaccccgcgtaccagggatctcttcattcaaaaatctatcatttcttctnnnnnnnnnnnnnnnnnnnnnnnnnntctaaaatcttttcatcgtaaaataaatcttttaaatcaatcttttttcgtaacgaaacgttatttcgtttttaaatcatatnnnnnnnnnnnnnnnnnnnnnnnnnnnnnnncnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 7781 - DNA, 627 bp, Diabrotica virgifera
  misc_feature (88)..(106): n is a, c, g, or t
  misc_feature (333)..(352): n is a, c, g, or t
ccgaacaaagggctgcttttgacaaacctttgaaacaggttttactgaatatatatgggaaattttattcccttccccctgggttacnnnnnnnnnnnnnnnnnnncaaacaaatcttataaaaaaattaaacatatataattatggtatttttctttgaccagcatcccttcggactttgataaggcagtttgtttccttcaattatagttgggaaaacactacattaggatcttttgttaactgagcagaagctgctttgacaatgccctccctttggaaatttaattgattgaggaattttatatgatcaaaaccttcttgaaccctggnnnnnnnnnnnnnnnnnnnnctctgttttgttgcttgcacagcaacggggctcttctttgcaatatcttcagctacgccaaaagcaccttgaataaattctccttgataaccgaatactcgggaaacaaacccacaagaaaaagcttcatcagcatgcatttttcttgctgtatagcatagttctctggttaaactatcaaagccaattactttcggaaatctttgaagagaaccaacgtcagctgccaaacccacttccacttccttaacttgaaaaaatgcatccttttgggc

SEQ ID NO: 7782 - DNA, 686 bp, Diabrotica virgifera
  misc_feature (229)..(246): n is a, c, g, or t
  misc_feature (263)..(283): n is a, c, g, or t
  misc_feature (373)..(397): n is a, c, g, or t
cagaatacaaatatgttttgaagtttaaaaacagttgtgtacctacctatcttgacatgtaggcaaaaatatttgtgatagattataattaggtacaaaactagtcggtgaatacgacaataccattaaatatatcctttaaatgtctatttatttttaaagttgatattttactgttagacctgccgttgttatcatttgagagaaaatgcaatatattgagaaaggnnnnnnnnnnnnnnnnnncacatagatctactgannnnnnnnnnnnnnnnnnnnnactatgatgattcctctcttcgtgttctcagagaagtcacaaatctctatttagtctttttgagttttgtgagattgttttcactatgcnnnnnnnnnnnnnnnnnnnnnnnnnctaaaatagctctataaattttggttacttgcccgtcgcgctcgaatcaattaattaagtaccatatatacggattaaataaaaactacgcaagtaatctctattacagaggataatatagaaatatacgtacacgcaacacacaacataaaaatgagggcgaggtttgaacccactaacaaaaactcgtaacatcgtcgaccttgactttggagatcgattgacgaactccttttccctccccctcgctttccggcccacactaggtacgagccaaccctacctcagt

SEQ ID NO: 7783 - DNA, 908 bp, Diabrotica virgifera
  misc_feature (38)..(55): n is a, c, g, or t
  misc_feature (57)..(70): n is a, c, g, or t
  misc_feature (491)..(513): n is a, c, g, or t
tgtaggcgtaaatttatatatttctcaaataaataaannnnnnnnnnnnnnnnnngnnnnnnnnnnnnnngctgaagctacaattcaagagggattcctttgccccatttgtcacaaggatttgcgatctgcaaataatttaatatcccattttcaagatctacattctgaagagaaagacctacttagttccatcaaaggtatttatggaaaagttaagaagaaaattctcactgtagatgatcaagagtttgaacatttaagaaaagaaatatcccttcaagaaaaatattatctagaatacagtgaacctcaagatcctggacccacagtatcccatacagattattttaaatccataagaagggatagactagatcataagacagcagaaactaataaattgataattagattagataggttattaagagtatatgcacctgataggaaacaacatgaacaagagttagtggcttggttagatggtnnnnnnnnnnnnnnnnnnnnnnnttgtgcatcttcctttaacataacaagaaggcagcaccattgtcgattgtgtgggagtattatgtgtaattcctgttcatattttttaccatatgatacagcccagaccattgtgacacctctgaacagtggaaatagtaaagaacaaaattccaataaagaatctgacaccttaaggatatgttaccattgtttggacatgatagaaagcagaaggcgtcttcaaatagagcaagttttacaacccattatttgtcagttatacacgcatttacaaaagatgaaaagtcaaattgaaacttctgttgaaatgtatttaaagatgtacaactcgatcatatctggagaaacacatatattttacaagatcttcagtctctgagaactacaattgc

SEQ ID NO: 7784 - DNA, 672 bp, Diabrotica virgifera
  misc_feature (2)..(44): n is a, c, g, or t
  misc_feature (52)..(632): n is a, c, g, or t
  misc_feature (639)..(670): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcannnnnnnnnnnnnnnnnnnnnnnnnnnnnnnngg

SEQ ID NO: 7785 - DNA, 631 bp, Diabrotica virgifera
  misc_feature (8)..(83): n is a, c, g, or t
  misc_feature (89)..(191): n is a, c, g, or t
  misc_feature (196)..(237): n is a, c, g, or t
  misc_feature (240)..(289): n is a, c, g, or t
  misc_feature (293)..(361): n is a, c, g, or t
  misc_feature (371)..(391): n is a, c, g, or t
  misc_feature (402)..(524): n is a, c, g, or t
  misc_feature (527)..(541): n is a, c, g, or t
  misc_feature (564)..(610): n is a, c, g, or t
gggaaggnnnnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgnnnnnnnnnnnnnnnnnnnnnnnnnnnnnnnnnnnnnnnnnnacnnnnnnnnnnnnnnnnnnnnnnnnnnnnnnnnnnnnnnnnnnnnnnnnnntgtnnnnnnnnnnnnnnnnnnnnnnnnnnnnnnnnnnnnnnnnnnnnnnnnnnnnnnnnnnnnnnnnnnnnncacccccgcnnnnnnnnnnnnnnnnnnnnngagggaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnagaggggaaggagaagagaaggnnnnnnnnnnnnnnnnnnnnnnnnnnnnnnnnnnnnnnnnnnnnnnnacacctcatataatattattg

SEQ ID NO: 7786 - DNA, 856 bp, Diabrotica virgifera
  misc_feature (448)..(468): n is a, c, g, or t
gcaaatagatttattggtgacagtagaactcgctttatttgggaaaaaagtttttattaagccaataaaaaccgaaatcattgttcagaagaaatctgtaacctatgtattactctccgctactactcactatatgatgtcccaacgtcgaaaataacgtagtctcatacgactcatctacttataacggaactacgataacatatagtccaagagagatgcgagctttaagtctaaatctcttatttacatgatggaggattaacatgtagatattatagctaactccacaattgatattgtacttcatgatacctaattacagttgttgcacattctcattatggattatctatactgagatgtatttgctattatagaggtaaggatccaatgatttcctttacttacagagtgtaactattcaatactttatttcaatagttcnnnnnnnnnnnnnnnnnnnnnctgaaaaattaaccttcttccctcaacattttttaggattaataagaatacctcgacgatagtgcagattatccagatgtatttatattatgaaagattgcatcttctattgtatcacctaatttctttaattggggcattattcattaattattatgatttgacaagccttttcttatcaacgaagaacgagtaagacctttaggaataacttctttaatctgaatgaactacaattttaaccctccagctgaagaccagatattctgaattgcccatattatcatcccaataggaaaaacaagggacaccgatacaactgccactggatattcagggatctgacccccatttggcaacacataacgaataatcaaggacccaattt

SEQ ID NO: 7787 - DNA, 861 bp, Diabrotica virgifera
  misc_feature (7)..(28): n is a, c, g, or t
  misc_feature (44)..(63): n is a, c, g, or t
  misc_feature (65)..(102): n is a, c, g, or t
  misc_feature (104)..(159): n is a, c, g, or t
  misc_feature (188)..(222): n is a, c, g, or t
  misc_feature (268)..(292): n is a, c, g, or t
  misc_feature (354)..(373): n is a, c, g, or t
  misc_feature (384)..(405): n is a, c, g, or t
  misc_feature (595)..(614): n is a, c, g, or t
  misc_feature (748)..(766): n is a, c, g, or t
  misc_feature (825)..(850): n is a, c, g, or t
gttgccnnnnnnnnnnnnnnnnnnnnnnggggacctattttccnnnnnnnnnnnnnnnnnnnnannnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnngggggaagttaaaaagggatttaaaaccnnnnnnnnnnnnnnnnnnnnnnnnnnnnnnnnnnngaattaaaaagggtaaaaaatttttgggttaaaaactctcgggggnnnnnnnnnnnnnnnnnnnnnnnnnttaaacaaattccccctttaattttggggatgaaaaggggaggcactaattttaaagggggnnnnnnnnnnnnnnnnnnnncaattttggannnnnnnnnnnnnnnnnnnnnnccaattttggtttggattaaaacaaaccttatacctataaaaagttttgggctttttccaaaaggaaaatggggggattggtttttatttgggttggtttcggcggaaaattttttcgggtggaaaattttagggggggggaaaaacctttcatcaaaagggattccctttattgggaaaaaaacccgannnnnnnnnnnnnnnnnnnnggtttgttgtgggttaaaagaagttttcaaaaaactgttttggaaaaaggggaacgggggggaaaatccttaggggcgcaaaaaaatttggttaataatttttttctctttttggggagggaagaatttgggcnnnnnnnnnnnnnnnnnnnggggtaaattttcccccctgggggggtcggggaaaaatttgtttttttgggaagttggnnnnnnnnnnnnnnnnnnnnnnnnnnaaggggtgttt

SEQ ID NO: 7788 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7789 - DNA, 471 bp, Diabrotica virgifera
  misc_feature (190)..(214): n is a, c, g, or t
  misc_feature (220)..(238): n is a, c, g, or t
  misc_feature (273)..(300): n is a, c, g, or t
  misc_feature (310)..(328): n is a, c, g, or t
tttgtccgaataaatatgccattttaattgcctatttgtctattttgtaaaattcatattagggtgttcaggaagcgtatacagggtgaaattttttctaagacccgaacgaactagttttttaaggctggacctgatttttttctagtttaaataaatcagttgattgggtagtaacataaactaaatnnnnnnnnnnnnnnnnnnnnnnnnnataaannnnnnnnnnnnnnnnnnnatggttcactttaccaaactttcaattcatagtcnnnnnnnnnnnnnnnnnnnnnnnnnnnngtaatcgtgnnnnnnnnnnnnnnnnnnngccattttaattgcctacttgtctaatttctaaaattaatattagagtttttaaaaagcgtatacagggagaaattttttctaatacccagacgaactaattttttggagccggatctgatttttatctagtttgagtgaatc

SEQ ID NO: 7790 - DNA, 107 bp, Diabrotica virgifera
aagggcacagcgatcaggttatcgctagtaaggtgccccataaccgcaacgaaaaaaacgtaaaaatactaaataataataatggcaccctttaaaatgttatggtt

SEQ ID NO: 7791 - DNA, 277 bp, Diabrotica virgifera
  misc_feature (2)..(78): n is a, c, g, or t
  misc_feature (85)..(122): n is a, c, g, or t
  misc_feature (142)..(155): n is a, c, g, or t
  misc_feature (158)..(180): n is a, c, g, or t
  misc_feature (188)..(210): n is a, c, g, or t
  misc_feature (240)..(271): n is a, c, g, or t
cnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 7792 - DNA, 770 bp, Diabrotica virgifera
  misc_feature (2)..(17): n is a, c, g, or t
  misc_feature (19)..(61): n is a, c, g, or t
  misc_feature (69)..(179): n is a, c, g, or t
  misc_feature (192)..(690): n is a, c, g, or t
  misc_feature (695)..(744): n is a, c, g, or t
  misc_feature (746)..(746): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgnnnnnnnnnnnnnnnnnnnnnnnnnnnnnnnnnnnnnnnnnnnnnnnnnnanaagctttaattttttaaagacgag

SEQ ID NO: 7793 - DNA, 944 bp, Diabrotica virgifera
  misc_feature (210)..(230): n is a, c, g, or t
  misc_feature (741)..(763): n is a, c, g, or t
  misc_feature (846)..(846): n is a, c, g, or t
  misc_feature (913)..(913): n is a, c, g, or t
gccccagcaccaaacagtggttatatttaaagttcaatttacattgttaaattgtaaaattgaaaaggcttaaagccaatgttaatggataccttcgatgacaattgaagtacttccacattttatattgtcacttgacagacgtcagtagaccacgatggttgtttaagctttcgtgtacggattcttctgaattctaaatataaccannnnnnnnnnnnnnnnnnnnnaaccgtcttttcaatttcattggtgggactacttgttctattttgggttcactgatggtggactggtgggtccgaggacgttctgaacacatttatgtggtccgtttggattttgtaggatttttgattggattgtacctgccaataagaagttttttactgtgatgttttctaacctaattgttgctcttatagttgcattattttgatttactgtgtaatagaaatcaatcactcgatatttaaagcttgtatagatgtggataaccttctccgagccccaaaattttgcaattgtgttgggcagtgtaacgttaacaaatgatcacttttgtatttaataatcatcacaatttttgtagaagagcgcatgcgctatcgtgtagtataccacatgtatttttactgactgctttgcaatatctaatttcacaaatatcaaattttatcaacatagctatgagaggaactaaaattcgtttcagataactaaacggacaaatgtcacaannnnnnnnnnnnnnnnnnnnnnngatttctattttttcctttagggctattcatcgccgtcattttctcgtacttttgacatatggcgtatatattgtacgtcatnatgtcgggagtacgagaaaaatgtcgaaaataatagccctattttggattttgatgtcattttcttnggagatatactgtcagctgcttcttcattac

SEQ ID NO: 7794 - DNA, 299 bp, Diabrotica virgifera
  misc_feature (103)..(129): n is a, c, g, or t
gatggcctgcaaggcctggggcgccatgctttcctgggagatccagtaggcggcgctgataaaggtcaggttggccaccagcaagacggtggtcaacaagacnnnnnnnnnnnnnnnnnnnnnnnnnnnaaccggtagattttcgagacgctggcgcagtggcatcaaggttttcgctgcaaaggaacaagcaggcagggtagcgcgtgcttcagtcgctgggcaatccgcgtgcagacagttgctgtaccaggcggacctgaagttgttgcaggtgcggcaaggtcagttggtgacgt

SEQ ID NO: 7795 - DNA, 610 bp, Diabrotica virgifera
aagatgaagggtatgcctgcaacagtggcatccctctgtgtcgtccttttgatattcaaaactatatccgcagtaccttctaacccaataggatatggtggaggggatggaggtcgtaaaggaggaggcagcggttatggccgaggtggtgatggagaagacgtcggtgacggccgaggcggtcgtggtggaaaaggcggttatggcggagtaggtggtgtatttgaaaggagtgacgaaagagtcggcggttatggtcgaggcggtgatggcggagacggcggtgacggccaaggcggtcgtggtggacaaggcggttatggcggtgtagttagaggcagtgatggcagagatggcggttatagtcgaggtggtgatggcgaagacggcagtgacggccgaggcggtcgtggtggaaaaggcggttatggcggagtgggcggtgtatttggtcgcagtgatggcagagacggcggttatggtcgaggcggtgatggcgaaaacggcggtgacggccgaggcggtcgtggtggacagggcggtggaggaggtggaggtggcgggttcggcggatggggatttggcggtggaggcggtggaggtgctggag

SEQ ID NO: 7796 - DNA, 794 bp, Diabrotica virgifera
gctatttgtataacaagggaggaaagtgctacttttcctcccgaggaaatcattcaagggaggaaaaggcactttactactcccatgttatacatatggtttttacaccttcctcaaataacaagtcatttttttatttttactttatttatgtaactaaccaacaaaatgtattaaaactaaaactaacaagtaggtacaatataactgtcaactgtcaaatataagtcaaattattaatgtaaacattgttaaatcaaaatatcaatttactattttttaccattctgcaaaatacagggtgttttataaataaccgttaaaatgtatagatacttacgtaatagaaaatagatattgtacagggcgtcaataagttatatttcatgaatgaaataccatgacgtcacttttacttttcctccctagggaggaaaagtacaactttgctccctacaatcaggtccggaaaagtatactttcggtagaggtcggtggaaaatactattttataaatgcaataaacacaattgatttgtttttgtgccaaattgcaaataaaatgtgacaactgtcagatttaactaaaatgtcatgttagaataaatgttataaatgtatattatcacggacttaccttttttctatcatttgtgacgcactgaaaaatcctaatgaaaacaagcataacctagtttaccttaatttctatcgacactcacttcatctttcctcgttagaggaaatgcatgttggtatatattatggggtagggggccccaagggggggattt

SEQ ID NO: 7797 - DNA, 482 bp, Diabrotica virgifera
gctcgatgtcttctttcttggagtatgaggttttgtggtattatgcagggtagtttaaaggatgattacggttttttgtaggttgtgtagcggacttcacaccgtgtagagttgtactggtttgatgttgaaaactccatttatgttcaagtgatttttaatatggtgtattgttatcggggattaataatatggcgaaatgtttggttttggtgtgcagggttggtcggggctcggaatgggtattttctgagttttcttagatggaacaccctgtgtttttgtattgtagtgaaataatattttgtagtgcttttttgtttcttgaccattccctgtacctaactgctttgatttgtgggttattcgtggttcttttagacattaattgcaacaagaagtatgtgagattttgttgggtttgacgtgaaagggttcagtcaaataatttttcgaatataaactcattgttgatctccact

SEQ ID NO: 7798 - DNA, 444 bp, Diabrotica virgifera
  misc_feature (164)..(181): n is a, c, g, or t
  misc_feature (189)..(213): n is a, c, g, or t
acgcccgcgaccttttaaaagacggaagagttacacgaccagagaattacgaaccggtgacagcagacgctctagctttaaaaattttctctagagtctcagcaccacgtgaatcaagaattattaactacaaataaaaaatttactcaacttcgaactgctannnnnnnnnnnnnnnnnncgaaccannnnnnnnnnnnnnnnnnnnnnnnncttattgagatgaaccgatattcaacaaacaaacatatgccacacataaaacaaagaaactaaatgcaatcatcagcaacagatctatgctcaaatcactctagaaactataaatatccacgaaggcgtaaggatgagccaataaatcaaaacttactatcatttaatattaacctaacaaatgagaataaacacagtcagagatcacgacctcttaaaatacatgcctca

SEQ ID NO: 7799 - DNA, 462 bp, Diabrotica virgifera
  misc_feature (2)..(60): n is a, c, g, or t
  misc_feature (64)..(188): n is a, c, g, or t
  misc_feature (190)..(257): n is a, c, g, or t
  misc_feature (360)..(379): n is a, c, g, or t
  misc_feature (387)..(408): n is a, c, g, or t
  misc_feature (432)..(449): n is a, c, g, or t
gnnnnnnnnnnnnnnnnnnnnnnnnnnnnnnnnnnnnnnnnnnnnnnnnnnnnnnnnnnngctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnccttaggggaaacagcggaatttttattggagaagtcaaatccaaaaaaaagaatgggcaacccgccggttgggattaaaggtttttaatgggggggaccagnnnnnnnnnnnnnnnnnnnngtttcccnnnnnnnnnnnnnnnnnnnnnnggtttcgtggggttttataacccnnnnnnnnnnnnnnnnnnggcggggggggtg

SEQ ID NO: 7800 - DNA, 763 bp, Diabrotica virgifera
atatatcagccagaagtactgaaaggccacagctccaatgtcaatattgtagatggcctctacagagatgatagcagtgctgttgtagtaagtgtatctatggatcaaactgccaaaatatggttaagacaaaattatcaaggtgactttgtattaaatcaaacactcaattttggattccatataggattaagtctgagattaacatatttaccaaatagtgatgaattgttattagcatgtgccctagatgattccaaaattcatattttttctcaaagccaatcggacaatttacattttgaagaagctaccaagttggcaggtcatgaagattgggtaagaggattggattttactagagatggcgatgacttaattttggcatcatcatcacaagacgccttcatccggctttggcgtatatctacaaaaaacctaggtatagaagttcttgaaaatgcccggttacgaacaaaatccgacaccttcaacgtatacctggaatccgtaatatctggccacgaaggctggatttattctgtacagtggagtccagatggtaaacaactgttgtctgcatccattgataagagtatgattatttgggagtacgacgaaacttcagaattatggctagaaaaaattagagtaggagaaattggaggtaacactcttggtttttatggtggactgttcggaccagatggcgatacagtccttgaacacagttaccatggcgccttccacatatggaaacact

SEQ ID NO: 7801 - DNA, 218 bp, Diabrotica virgifera
  misc_feature (29)..(48): n is a, c, g, or t
  misc_feature (96)..(110): n is a, c, g, or t
  misc_feature (112)..(127): n is a, c, g, or t
cagaattttatttctaagttaaaacagcnnnnnnnnnnnnnnnnnnnnaaaaacccttatacaaattcataaaattcttcaataagttttcttacnnnnnnnnnnnnnnncnnnnnnnnnnnnnnnncaatctgcggtgaattaaaacaacacatcttcattttttttcattttcatattattacttaacaacttttttttccacttcaaatcttttc

SEQ ID NO: 7802 - DNA, 337 bp, Diabrotica virgifera
ccttaaccgacaggatgtagcttcacgttacaaccagatgctcctccatcactaggtactgatcaaaaatattgttctgtacatcatataggatcgatatgaatttttagaaaagaataaatcgtttgagattgtgtgtataacactcccaggtaattgtttcccccattaaagtgtttgtaaatgaacatggccatatggaactaagggatgttttggcataagaacaaaataaggtgtatgaggttttcttggatacacccctgatttgtggatgagcgaaagcttgaaaattaagattcctttttgaaacgaagtattagattataatttttaa

SEQ ID NO: 7803 - DNA, 650 bp, Diabrotica virgifera
  misc_feature (8)..(462): n is a, c, g, or t
  misc_feature (464)..(637): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactgtcttta

SEQ ID NO: 7804 - DNA, 961 bp, Diabrotica virgifera
  misc_feature (149)..(171): n is a, c, g, or t
  misc_feature (693)..(693): n is a, c, g, or t
  misc_feature (812)..(812): n is a, c, g, or t
  misc_feature (884)..(885): n is a, c, g, or t
cctcttccgtaatgaggttatgactgtgtgttggggtgtttgccggttttatctgtttttaactttagaactaaacaaatttctttgtttggcggtcgttttccaaataacaccaaatattatatcaattttacattttttcatttccnnnnnnnnnnnnnnnnnnnnnnnattgtttaaaaaactgttcgttagaacaccataatatttaattacacaaaactttgttttagcaagaaattatgaattcatgtactccatcaatttcaacaaaccctgaagaagctctctgccatatttgcagcaaaatatttaaaactcggtcttcactaaatcgtcatatcaaaaaaatacataaaatagatgagccgactaacaatatgaatcaaaatcacattatttgtcccttatgtgagcaagatactaattttaatagtcatgagaagttacgaaaacatctccaggaccttcaccaagtgagtattgaacttataacatttgaattttctagcaaacaagaatatgagacatggaaagatatgcagaaaattgagacaagttatgtatctcatagaacaattcgtagaaaggaacataagataatgtactatgattgtaacagaagtgacctacaaggatataaacccaactataaaattaggacagagaaagctggtggatcaattaaaattnaaaggagtgtgcccttccaggcttatttgcaaactgagagaccaaggacaagttttccgtcagttattggaaaacacatgctggacataaagaagaattaagaaccatgcatctgtcanaagcagaagaaaaaaatggttgtagaaaatttgatagctggggtgccacccagtagaatttttaaagattcnnagaaagtggaaacaccacactagatagacttgctgtaataacactcagatctcacaaattgtcacaaagtatatat

SEQ ID NO: 7805 - DNA, 888 bp, Diabrotica virgifera
  misc_feature (46)..(818): n is a, c, g, or t
gtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagacttcaaaaacccccactccgacaaaagcaaatggatcactcctgaccaactttcttgacctct

SEQ ID NO: 7806 - DNA, 709 bp, Diabrotica virgifera
aacgtagtaatatggactttcaggggctattatcaaaaatataaccaagaacgaaactggattcaaacgatacagatataaatccattgggaaggaagataacattagatgaaatatcatggatcggatctttgcagtatataggcgcaatggtaggaattctgcccttcgccgttttagctgatgtaataggaagaaaacctgtactgctcttattggccgtaccgcacattatatcgtttctttcttttgcttttgcaaaaaccatcggttggtattatgtggggcgcttcttggggggagtttccttgtcttcggtgtacatcatattgccgatgtacgttgctgaaattgcagaagattcctataggggaatgttactaatgtcctacagcacatttgctagtttaggtgacttaattccgtacgtattaggcccttacgtatccgttttatggtttaatatcattttggctgtttttcccatatcgttcttggttatatttttgataatagcccctgaaaggccatattactacgttaacaaaaaagaagaaaaggcggaaaatattcttaaaaagctaagaaagacgaaaagtaagtacacagaccacgaatggaaattgaatgaaagtaagcgagataaggttagaaattgacaggggggactttttaatactctacagaagaagtacggcatcaaaggatt

SEQ ID NO: 7807 - DNA, 992 bp, Diabrotica virgifera
  misc_feature (381)..(406): n is a, c, g, or t
  misc_feature (803)..(804): n is a, c, g, or t
  misc_feature (865)..(865): n is a, c, g, or t
  misc_feature (941)..(941): n is a, c, g, or t
gtcggcagcaaaaaggcgctggcttgtcgcctgtcggttttgatagacatctttttgtagttaacagcggcaacaaaatgtagtccgtacaggcagattaattatgaattcgaattaaagatcattgattttgttgctccttcgaaagcgcagacaaagaaggaggttcagcctgaactgcagcaatgaaagtgtctgtgtcgaatggctccatttttgtcaacactgctttcaaaaacaacaaacacgattgtacttttttcgctactaccggagtttcaaagtggtttcgtgtgaaacgagaatctctacaattatcgtggaacctcgttaacttggattaatcgggaccgcggttatcgaaaatccgggttagccggnnnnnnnnnnnnnnnnnnnnnnnnnncggtatacttacagataaactccgttataattgaaataacatgaaaaatatatatgcacagtacacgtctaaattatgtatagttgtatagagtatagagtatgttcatttctcttaatcagcttgagtgctgattcctgaataattggtccagacactggtaaaccacgttcgcgttccgcacaaaaccacacatacaaagcgtcgtcgagagtctcatttttagctttattagctttgcaccgattgtccaaactgtcttttgttatcattttgaaacaaaagtcttcgattttagttctatttttcttccaatccgatactgtagatgtaccgacaccatatgatgctgcaattgtttttaaagattctcctttatcaattctacctaatgctnncttgtttcttttccattgtcacgacacattttttaccgtttttgttgccatttacgtagancaaaaaaacacgcaaacacaaaaatctgaatagatttacgaacgattacagaaacgaaagcgacaatacgactgtnactacacacatacggtctcatttgcaacgaaagaatgttttaatagtcttt

SEQ ID NO: 7808 - DNA, 113 bp, Diabrotica virgifera
tgggatcgagaccataaaatatccacactaggccaaagtattactatcttaatttttgtaatttattacctgtgcaaagtaagactattatattattaggctaatactatggg

SEQ ID NO: 7809 - DNA, 91 bp, Diabrotica virgifera
  misc_feature (2)..(14): n is a, c, g, or t
  misc_feature (23)..(67): n is a, c, g, or t
tnnnnnnnnnnnnnggtgattannnnnnnnnnnnnnnnnnnnnnnnnnnnnnnnnnnnnnnnnnnnnttttttgatcccattttttttgat

SEQ ID NO: 7810 - DNA, 279 bp, Diabrotica virgifera
  misc_feature (16)..(86): n is a, c, g, or t
  misc_feature (88)..(118): n is a, c, g, or t
  misc_feature (128)..(231): n is a, c, g, or t
  misc_feature (234)..(259): n is a, c, g, or t
aaaaaaaaccctgggnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnaccctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnngcggggggggcgcgggcccc

SEQ ID NO: 7811 - DNA, 887 bp, Diabrotica virgifera
  misc_feature (198)..(236): n is a, c, g, or t
  misc_feature (654)..(654): n is a, c, g, or t
  misc_feature (771)..(771): n is a, c, g, or t
  misc_feature (791)..(791): n is a, c, g, or t
  misc_feature (833)..(833): n is a, c, g, or t
  misc_feature (861)..(861): n is a, c, g, or t
atagaaaccagtatcgcaaaattaaaccgcctgtccatagaaaccacaataagttaaacaaggataagcgatacggcatgtcttgatacattatttactaataattttgacgtttatcattttcagtgacattagcgcatttgttgtgttcagaaatggtttttcatttattttatattacatagtaatagtcggtannnnnnnnnnnnnnnnnnnnnnnnnnnnnnnnnnnnnnnccaatagtgaaagaaaatcaaacacttcaataaaataactttataaaatacgtccaccgggataatagccatttcctaatacataattcttcttcgttctctctttgttgactttacattgacagttcatgtcaacgtatgtttcacttaatgttttgatttaacttgtttgcaaatgaattattatgtttgtgcaaagctccaaagaaaattggaatatctcagacatattacacatgtagagagatacatataacttgcttcaattgattatgcaggaaaagattcaagaaaaaaaaagcatagatagacgcagaatatcgtggcggcgcaacctgagagagtggtacggatgtacatcaaaggaacttttcagagcagccatctctaaagtcagcatagctatgatgattgccgnacctttgtcgcggacgtggcacttgaagaagaaagatcgaacggaacaactgtatttactttattcatgaatctcgaggtcttccacatctctattactgctgctcattctatctcnccatgacactggttttcttntttctttattctccccatccgttggtaattcccgaattcgtnttataccgtatggatctctccaaactanaaatctattgtagtaaactataatct

SEQ ID NO: 7812 - DNA, 100 bp, Diabrotica virgifera
cctccccccaatttttaattatgtttattagtgcctctgaggctttcagttttgattcaagtactgaaagtagtggtaatagtgacgaagcaatgcctgc

SEQ ID NO: 7813 - DNA, 144 bp, Diabrotica virgifera
  misc_feature (9)..(51): n is a, c, g, or t
  misc_feature (59)..(84): n is a, c, g, or t
  misc_feature (89)..(119): n is a, c, g, or t
taccttggnnnnnnnnnnnnnnnnnnnnnnnnnnnnnnnnnnnnnnnnnnncgaatttnnnnnnnnnnnnnnnnnnnnnnnnnnctggnnnnnnnnnnnnnnnnnnnnnnnnnnnnnnnggaatggtattttcgttttaatata

SEQ ID NO: 7814 - DNA, 308 bp, Diabrotica virgifera
  misc_feature (13)..(38): n is a, c, g, or t
  misc_feature (47)..(87): n is a, c, g, or t
  misc_feature (92)..(104): n is a, c, g, or t
  misc_feature (107)..(129): n is a, c, g, or t
  misc_feature (135)..(154): n is a, c, g, or t
  misc_feature (160)..(200): n is a, c, g, or t
  misc_feature (226)..(244): n is a, c, g, or t
  misc_feature (253)..(298): n is a, c, g, or t
tgctcgccccaannnnnnnnnnnnnnnnnnnnnnnnnncataaggannnnnnnnnnnnnnnnnnnnnnnnnnnnnnnnnnnnnnnnnggggnnnnnnnnnnnnngannnnnnnnnnnnnnnnnnnnnnnagggcnnnnnnnnnnnnnnnnnnnngaaacnnnnnnnnnnnnnnnnnnnnnnnnnnnnnnnnnnnnnnnnntggggggccccccgctaagaatacannnnnnnnnnnnnnnnnnngggcggctnnnnnnnnnnnnnnnnnnnnnnnnnnnnnnnnnnnnnnnnnnnnnncggggggcgg

SEQ ID NO: 7815 - DNA, 960 bp, Diabrotica virgifera
  misc_feature (633)..(651): n is a, c, g, or t
  misc_feature (754)..(754): n is a, c, g, or t
  misc_feature (766)..(767): n is a, c, g, or t
  misc_feature (779)..(780): n is a, c, g, or t
  misc_feature (786)..(786): n is a, c, g, or t
  misc_feature (819)..(819): n is a, c, g, or t
  misc_feature (859)..(859): n is a, c, g, or t
  misc_feature (876)..(876): n is a, c, g, or t
cttcttttttgggcttgtcccccactttatttaaaatatatctcgaaagtgctttaaaaagatataaacaaaaatgcagaacaatgaacaatgggaataccactcaccaacactatggtctatacgcccaacttggcagaagatcaagtaataatggctcaagaatatgacgatttaagctatatcccaggcaaccaagtgacgtcaagaacgtcgaggaaacgtcagtttttggttgaatatatacacgtgtttgaagattacgtggtataaatgtcttttgtaggtgattttaaatacgtaagattaatgacgttaaaatacgcctaaaaacacgttttcatttcaggcatcctaagtctgacagtcacaaaattgggaggagcttaaaggcttaatgcttatgacttcaagaaatgtccattaagaagtgtttcatttattgtttaaggatttgtgtaataaaataagacttttcatttagatatttagttgaagaaccgtgttaattaagagcttttcattagtttttctcaagtgagtaagtttaatacaataattcatcttgaaaactgtttggaggttatgttttaatttgttttggatgtgttattgagtttaattaaattaacnnnnnnnnnnnnnnnnnnnttatatggttgtttcaattttgacaccgtaagtatatataaaaagtgaaaattctatacctggtaggtatgtggtatttgagggtattctaattctatatatnttagagagtctnntcaatttagttnntgcttntagcctatgagctaaatgatttaaaacggttanataaaaaattgcaataccaacaatgcccatgcgaaataanttattgtgtatctttanaaccataaaatggaacatctaaaaacgacataaaaaactacgttttgatatcacgtattttaaaagttgataaaatacgtcaat

SEQ ID NO: 7816 - DNA, 744 bp, Diabrotica virgifera
  misc_feature (58)..(81): n is a, c, g, or t
ctacatgtatggtactgctttagttgtgttttgacagattcgttcaataatatcattnnnnnnnnnnnnnnnnnnnnnnnnctttgaagatgttgtctggtggctatatattggaattgtgcaatgttttttattctggacaggtaaaaaagcgctctgttcttcaaagaatggttggcaacattaaaactgcagtaatcttaaaagatgtgtccatgttggtacattctggtgaggtcctagcagtgctgggatcaaaaggtagtgggaagaaagccttacttgatgttatttcaagacgagcacaaggccctataagaggacagatatatctgaacaaccatccagtcagtatgggtttattccagcagaaatgtgcatatgttacacataaatgtgattttataccaggactaaatgttgaacagacgttgtattatactccgactaagttcactggctatttaaaaatgtctaaagtaaagcaagtgatagcagatttagcattgtcacaagtcgctaaaaaatgcgttgaagatttgacaaaaagtgaatacagaagactgatgattggtgtccaactaatcaaaaacccagtggtactattactagacgaacccacctgggatctggacccactaaacacatacctaataatttcaatactttcaaatgcagctaaaaagtatggaactgctataatcttgacgatggagaagcctagatctgatgttttcccgttct

SEQ ID NO: 7817 - DNA, 782 bp, Diabrotica virgifera
gcataattacatttaaatcgttttgtaacccctacatcgactgtccaacttatgcacttattcctccatcagaaggtgatccaaacagtattagtcttcaccaaatacccgaaccagaatataagtgcaaaaagtgcgatttaagattatcaacagatagtgcagctgtaatttttgattgtacggaatgttttgatgtacaaccttttcaagttgaaacgaatgtaacacagacggatacagaagaaaagagtattttgtacaaagttttctttgtggaaattgcaaattacactggtcctgaaataacggaatcagaatattttgacccctaagttgagaacttgcatgttatatacgcattgaggttatgtataccattgtcaaattctaaggaaaaatcattttaggatcaatcatgtggtctagtaaaatcagcagaacttccttcacgactctcgatatttaccgaagaataactcgaggagtaactaatctagcaaaatcgagacaagcatctacctccgatatacatttgtttaaagttggagaaaagtatcacggattcgaagcaaaacgcatagcaagtattcccgagctgaaaacgaccgccttgtacttattacacgagaagaccaaagcccagtacctgcatttatataggaatgattcgaataatgtattttctgtcaatttacgaacgacaccgatgaatagcactggtttgccgcacattttagagcacaccgtgttatgtggatcggaaatattcctgtacgtga

SEQ ID NO: 7818 - DNA, 140 bp, Diabrotica virgifera
  misc_feature (49)..(70): n is a, c, g, or t
  misc_feature (74)..(74): n is a, c, g, or t
  misc_feature (101)..(102): n is a, c, g, or t
aagaagaaatatgtcagctattggtgtggtgtgtgtttatcgtttatgnnnnnnnnnnnnnnnnnnnnnnctanaaaacttgttaaataataaatatgatnnaatttggaattgttaattaaattcattagagtaaaaat

SEQ ID NO: 7819 - DNA, 698 bp, Diabrotica virgifera
ttttggccgattattctatgtgactacaggactagcagagccttttttagaaggataagaaatagagagagataccgagagacaagctgagaacgatttggtatgaatccggactcatatatattagtcggagtatctgacttcacaaaaagggtgtctacagcatacttacggtacacaaaagtgcttccaagattgtttgtattgaatgtgttgttttatttatgtatggaaggctgaagatgtgatcgagacccatgagaagtgccttaataagtggttggcatagcaggacggaaccaaagataccaaagaagacctaaggtacgtcggaaacccgcttacacaaagaggccagcctgaaggaggtagttcttcggttatcgcgcgatagaacgatcggtcatggaagtactgactttgaggtattccatagcaatagtacattgcagagaaagcaggcaggagatacaagcaagcgatcagacctgcaggggagtcggccagagacactcagtacagccaaccgtaatggttaccactcgcgaacatccatcttgaattttttaacggagtagtagatggtgctgcactacgcgcagacaatatgaactatcaacgtgtaaatacaatatgcatccaccacagccttatcaatttttcctatcttttccatatacctaatttccagctactcc

SEQ ID NO: 7820 - DNA, 432 bp, Diabrotica virgifera
  misc_feature (229)..(253): n is a, c, g, or t
tccaaaacagtatttttaacgccattcactggcacctccccaatttggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcaatactgattctccattacgnnnnnnnnnnnnnnnnnnnnnnnnnaacaacaaagcctcacacagtattggtttactgtggtggcttttggctagagaggttctccgtcttagaggaatcattccacgagataccaaatgggatgttgtaatagatcttttcttctaccgtgaaccatagagaggctgagaaggtacaaccagctgccaaagaagctgtggctg

SEQ ID NO: 7821 - DNA, 944 bp, Diabrotica virgifera
  misc_feature (187)..(231): n is a, c, g, or t
aaacaaaatccctctgatggttcagacagtcaacaggaaaaaattaaagtaccggcaaatatgcaacagcaaatattacatttacaaaatatcaaaaacgttactttgttaagagcttcgcctactggaaatgtaggcctaagcccactaactacagcctcaggggaatcaccaattgaccaagctnnnnnnnnnnnnnnnnnnnnnnnnnnnnnnnnnnnnnnnnnnnnncagtctggattgcagataaaaacgcaaggtaatcttagtcaggctcaacaacaacaaattctacaaacaatcaaacagaagatattacctaatgctagtcttctggcgaatccacaacaaattatattgaaacaaaaaagcggactgatcaatgtacagaaatcaggaatagtacctgttactacccaagtcgttggacagcagaaacttagtactgatttatcaaaacaatctagttcaactcaaggcccagttgttgccaaagtgttaacaaatgcagcaggacatgtgatatcagtggaaggtctacttcctcaacaaaaaccaaccagcattttggcacaaggtgcaactttgcgagtatctggatcaaaaacgggtcaacaaaacctcatacatctcacaggaacctcgaaagcgaacgcgctaactcagctaaccgttggatctcaaaacaacattctcacattaacaacccagccgaaattcgtggtggcctctcaaacaacaacagtgacatcgtcaacgacatcgtcaaaatcagcttctaggtcgtcaaataaggcgcaaaccttaacaaaactaaacacaaaaggaaatcaacaattgatcaacaccaaagtaatacaagcgctcgatggacaaagtctaaactagttgttaatcaacagaatcaaataaagatatcaacgggtaaaaactctcctcactca

SEQ ID NO: 7822 - DNA, 737 bp, Diabrotica virgifera
aaatgacagcccacgatcagatgagggctatgttatatcagcttatgggaacaggaagaaatggtgaaagtaacaaattccatgttaagttcaatgataccagagtgtgcaaatcatttttgctcagttgctgtccccacgagattttatcttccacaaaacttcaattatctataataagatgaggaataggtgtttggttttgtatcgaatggatctgggtgaatgcccaaaaatacacgatttggcgctgcgagcagattttgacaaggcccagcaatccaaggactacttctatgatttagatgcaatggaacatttgcaagcgttcataggcgattgcgacagacgtaccgagtcagctaagcaacgtttggcggaaacccaagaagaactgtcagccgaggtggccgtcaaggctaacagcgttcgaactagcagagcaaattggtcaaaaattagctaaagccgaacagttgggagaagaaggatttgtcgatgagagcatgaagcttatgggagaggtggaagaactaaggaaaaagaagctagacgccgaacaggagtaccgcaactcgatgccggccagcagctaccaacaacaaaaattgcgagtatgtgaagtgtgttcagcctacctcggtattcacgataatgaccgacggttagcggatcattgcggaggtaaacttcatctagggttcatcgaaatcagagaaaaactggcagatctagag

SEQ ID NO: 7823 - DNA, 280 bp, Diabrotica virgifera
cttcgtccgcctggagacaagccactccaaaagcatcaccgacatatactgggcagcggctgcccagagttactcctctggagcctgatgactggcataatgtcatgtatataccacacctctcaaaattcttgcccatggatagctcacctggaaatgtcctatatgccatggctattttcccagcgacaatactcctgcttgccacgaaggctgtaatggagtgcgaatgccgtatcctgcatctcaatctcatggtctctcagtgccatctgcactc

SEQ ID NO: 7824 - DNA, 898 bp, Diabrotica virgifera
  misc_feature (344)..(361): n is a, c, g, or t
  misc_feature (365)..(382): n is a, c, g, or t
  misc_feature (650)..(676): n is a, c, g, or t
  misc_feature (861)..(861): n is a, c, g, or t
  misc_feature (871)..(871): n is a, c, g, or t
attttttaatttttatggtattctacttatcacagtaatgccaaaagtgtttgtattaagcctaaggtagaatgacgtatgtacttcagcaaaaaaatcatcggaacataagaaaaaaataggcctatctaaaatcactggaacatagtgaagtattgaacaaaaacaaagtaaatatagaagcaataatgaaatatttcaaaaaaggattttccagccgatgttttgcaaagtaacattgttattgtagttaatatgttgtgttccagaattgttcctaatgttgagctgaattgttaatgttaaaatagttaaaatagaagtggcattgcagtgaaagaagnnnnnnnnnnnnnnnnnnctannnnnnnnnnnnnnnnnngtagaataccacaaaaattagtttagttgaccaaaaatcaggcgaatttatccacatcgaaagataaattacaaacatacatatctaggtgtcatcttatctcatccttgaaggtgcctgtaaataaagaaggaacatatacatatctgtgtaaccagggcttttttacacatttttcttaaaacatagattattatatatggtgtacaagtatctaagtgttagaatttcttccaatgactttaataaataaagtcagtttacaggnnnnnnnnnnnnnnnnnnnnnnnnnnntttttactgggtttgattcaatttgattcgattaaatttaagtataacatatgtatgtatgtatatcaaaagtggctgcaaacaaataacccagatgatagacgaacataaatatgcaagataaaacagagaattaaaaaaatctagtaactacagcaaaaaatatttcctgggaaaagtatatngagaagagcntgaatgtatagggtcaataatattaag

SEQ ID NO: 7825 - DNA, 950 bp, Diabrotica virgifera
cataattttccttaaacaaaacaataattgcctatgtgctatccgtattatactacggaatggaagggtggacactgaaggaaattgacgtgaggagactggaggcattcgagatgtggatgtaccgaagagtgctgaagatctcatgggtaaatagaataaccaacgtagaggtcatgagacgtatgcagaagaaaaaagaagtacttctaactattaatcgcagagaaaactgagatatatgagacatgtgatgagaggagataaatatctaatactccaggtcactatgcaaggaaaaatctagtgaaaaagatccaaaagaaagatacgtcactcatggctcaagaaccttagggaattgtttggatgtaataacaacgatttgtttaacgaaggcggcacctaaagaagaagaataagtttcttgggtgaaacgaatattaatcctctttagtgatacgtcccaactaagcgtctcacccacgtcttcattggcctttctctgctactcctaccaagaactatcagatcagagattcttcatattggatgattagcgtctcgacgttgaacatgcccgaaccatcctgacctatgctcgttcattttgtcttcaattggtgtaaccacgagacttgtcctaatatactattattcttcattttcgcctttttttgtcactccactcacccatctaagcattcttatgtccatcatatccaccaccaataatattcattaatcttgtgaaggcatatgatacagattctaaaaagattctgtgatgggagttcaataatgttttacttaacatatacgctgcatatccagcagcgttgtaaacagtttttagcgaggttttatcaacttgttcttcatgttcttggcatttggatttttatatatttgtttaataatcatatttgtatatttgtggtctactttac

SEQ ID NO: 7826 - DNA, 967 bp, Diabrotica virgifera
  misc_feature (3)..(766): n is a, c, g, or t
  misc_feature (773)..(810): n is a, c, g, or t
  misc_feature (830)..(843): n is a, c, g, or t
  misc_feature (846)..(863): n is a, c, g, or t
  misc_feature (877)..(898): n is a, c, g, or t
  misc_feature (929)..(952): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnntagtctgttcgacnnnnnnnnnnnnnnnnnnnnnnagtttaacccggtgtgaagcagggtgggttnnnnnnnnnnnnnnnnnnnnnnnntttagacgaaaggac

SEQ ID NO: 7827 - DNA, 893 bp, Diabrotica virgifera
  misc_feature (66)..(878): n is a, c, g, or t
cattgctgtagtgcacacgtaatttaagtatttatttaagaattgtctgcaaataattaattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtaccctttcctc

SEQ ID NO: 7828 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7829 - DNA, 903 bp, Diabrotica virgifera
  misc_feature (69)..(94): n is a, c, g, or t
cataaattttaacaagtgacaaaagtgacaagtggtggtttagaatttttttggattaattcttataannnnnnnnnnnnnnnnnnnnnnnnnncagtttagggaattcggaaaggagatgattgactacgtcgccaactacctcgagaatatcagagaaaggcgtgtactacccacggttgaaccaggatatttaagaccacttataccagaaacagcaccagaaaaacccgacaaatgggaagacatcatgaaggatattgaaagagttattatgccaggagtaactcactggcattcacccagatttcacgcttattatccgacggccaattcttatcctgcaattgttgccgacatactcagcggtgcaatcgcctgcataggtttcacttggattgccagtccagcgtgcacggaacttgaagttgttacgttagattggcttggaaagatgttggggcttccagaagctttcctcgcttgttccggtggcaaaggaggaggcgttatccagggcaccgctagtgaagccactttagttgcgctacttggagctaaagcacgaacgattgacagagttaagaaagaacgtcctgaattatccgagacggaaatcgtcgggaaattagttggatacacgtcgagtcaaagccactcttctgtagaacgtgcaggtcttttaggaggagtgaaacttagatcagttcagccagatgaatcaaacagactgagtggggcattattagaaaaagctattcaagaagacatagaggctggactcataccgttttatgctgtagcaacacttgggacaacgtcttcatgcaccttttgatcgattggacgaaatggggcccagtttggcacaacaaataacgtttgggctttcacgtgacgcag

SEQ ID NO: 7830 - DNA, 514 bp, Diabrotica virgifera
aaagaaaaacaagcccaaacgcgacccagaaggcagaacaacccagggacgcggcctctgcagaggaaccacaaaacacagaagacgaagcgctccccaaagcaacccgcagaaacgacaaaaaacgggtatgccaaagcatctgaacaggaggacagacaagaatcctcctgagaatggaggtgaacagaccggagaaactggaacttcacaatctgaagaagaaccaggcgtacagaggaaatcagacaggggcggcagacgcgacagacccggcgaacccgtgagagcgacacgccagagaaaaatgcgaagctggatgaaatcggatctcaggagaagagatgcagatacagaagtagaagccgagggtgctctcgaagacatattctacgaacagaagtgtcatatgtctggaagtcgaggcggaacacaaagaaggagatatgcacgtgctaagctagggtgaatattgcgatctatccctaacatgcgacatatttcatacccgaac

SEQ ID NO: 7831 - DNA, 620 bp, Diabrotica virgifera
  misc_feature (109)..(129): n is a, c, g, or t
  misc_feature (208)..(227): n is a, c, g, or t
  misc_feature (292)..(340): n is a, c, g, or t
  misc_feature (480)..(500): n is a, c, g, or t
aaagcaactgtaattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttacattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 7832 - DNA, 894 bp, Diabrotica virgifera
  misc_feature (72)..(872): n is a, c, g, or t
aaactgccatcaacaacatcaattccataatcgcacctgaactgatcaaatcaggcctagaagttaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccatccaagcccacaatctg

SEQ ID NO: 7833 - DNA, 578 bp, Diabrotica virgifera
  misc_feature (20)..(38): n is a, c, g, or t
ccgaattcctttattaaacnnnnnnnnnnnnnnnnnnnatacaggtttaatatacgaataaaaacataattataaaatatacatatcaataatacaaatttatagcggagacgcattgaatcctgaaactcaagtaacagatgaatgataataggataaggaatcaatttaggccgtattgccagatagagacttatgcccacaggtatagaagcaaacgagaaagaatttttgcatcactaaattattaatgaaagaggaacattaagagtcctgcagattgcaccatattacaatatgaatgttcagaaatatccaacatagcttatggtctgataacacttgaaattgaaagagctgatacctcttatagatctacgtctactgtgcaatcatctttagcaaaggatgctatatattattatgtaattctatatgaacaacagcaatacctttcacaattggccaaagagaaatatattggctgatttggattatctgagccaaagtataggaagggatataggacaactgaagaatatagccatttaccactcatcttcaacaacctatatttt

SEQ ID NO: 7834 - DNA, 487 bp, Diabrotica virgifera
aaaaaaagagaaaaaatatgggttcaatggaacagaggggagcaccgaacaaaaagaaagtaaatataaaaaccataaagaaatattgcaaaaaaggagaaggccgagccgaagatgagcaaaggaacatgggtaatgcagagaatatggtgtggacctgaattgtgccgaatggggagcggagttggtaaggtgacagtaagaaaaatagaagtgcaagggacgtgaaaaacggacaaaagaatatcaagagaagattatatattttgtggaccacaacaccgaaaaaagtagcggagtagaccaaaaagcaggcgaatgtatgcacatcgagagataaataacaaagatacatatcaaggcgacagcacagctcatcctagaaagtggcagtgaatacagaaggaacatatacatagctgcggaaccagggcttttctacgcagtattcttaaaaaagagattattatatatggtggacgagtat

SEQ ID NO: 7835 - DNA, 401 bp, Diabrotica virgifera
  misc_feature (23)..(92): n is a, c, g, or t
  misc_feature (114)..(154): n is a, c, g, or t
  misc_feature (160)..(219): n is a, c, g, or t
  misc_feature (227)..(266): n is a, c, g, or t
  misc_feature (275)..(365): n is a, c, g, or t
  misc_feature (368)..(391): n is a, c, g, or t
ggttggtggtgggggggggtgtnnnnnnnnnnnnnnnnnnnnnnnnnnnnnnnnnnnnnnnnnnnnnnnnnnnnnnnnnnnnnnnnnnnnnnctcttttcttatataaagagannnnnnnnnnnnnnnnnnnnnnnnnnnnnnnnnnnnnnnnncttctnnnnnnnnnnnnnnnnnnnnnnnnnnnnnnnnnnnnnnnnnnnnnnnnnnnnnnnnnnnnggtgtgtnnnnnnnnnnnnnnnnnnnnnnnnnnnnnnnnnnnnnnnngggggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnatctctcttt

SEQ ID NO: 7836 - DNA, 68 bp, Diabrotica virgifera
  misc_feature (27)..(27): n is a, c, g, or t
  misc_feature (38)..(38): n is a, c, g, or t
ccccagacgcagacgtctgggtggtgngattttatatncagcccttaacaaatagctgctcttcaaag

SEQ ID NO: 7837 - DNA, 922 bp, Diabrotica virgifera
  misc_feature (584)..(584): n is a, c, g, or t
  misc_feature (826)..(826): n is a, c, g, or t
agaaattcttcaaaaaagtctacgatctcattctgccgtctttaaacaaaaccttacaaaagcctcaaaaggttggccagcacttccatgagcattaccagggcctggtcgctttgataaaagtagctatgcctgttgagaactgccaacagttgtgggaaaaagtccagaaatttgactctactgaaatattccacgtgcatctattggacgctatagtaacaaaagttttagaagactcggtggctgataagttagtaaataatatcatagtgacttttgtacacttacagatatatttgttcaagaaaaatgtcaagtctgaggtagaaattgataaagcagtagaggttacgaaagtttttgtacaggtactgaaaaaagttaaagaaaaatgtacagatgtcgattttaaaagcactgcaaacaacgaaacagttaaattatactttaagttttgtttaaaatatggtgtctccaaacagccggtatttttgcaagctctgcagcttttgatacagcttttaagtaaacatttggaagtggaggacggcaggcttatcttagacatgttaacgtcacanttcggagtttttggaaactgtgttaggagagtattgtgatactaaaacggaaatattgtctttatacttggaattgtgtaggaagtggccggaatttatggaaagacactatgtacctctcttgttggctagttatagaggtttagtcaataaatgtgacaggattgtgctcttgcttcttaagatgtacgcatcccagcccagaccagacccatttctacgacttcaaaccttttctctgngataaagctgcagccactcactattcagtcagacaacagattgaaaacgccctgtgggaggcaacccaaaaccagcgacgtcctcgatatcttaca

SEQ ID NO: 7838 - DNA, 639 bp, Diabrotica virgifera
ggtgcgcccgctgggggcggggccgggatttccgggggacccccccctcccccgaatgtattatatcgaatccgtcacctgatatacctcatcgagaaggctttactctgtaactggatctgatatgagagcaaattttatcatcctacattacataacttgaactctatagtaaccatcgaaatagctccctgatctggtcacatagtctccttgcctacacaagcacggcaagcaaaataagacacaagtaaagcttcagacttccaacagcccagccacgtatcttcacctccaggctgtcctctcgttgtatgcatctgcaagtacaactggtatggtgtatagaagctggtgatggcgtatccaagtctgtacctggccatgaaggtcatgctcttgatcttggaattgttgtatccgacgtacctagctgaagacttgagagattatctcgtgataattttgactgttccagcttcctcgtgtcctcaccaccgcagaatattgaaggtgttagatacatctgataatcactctgctatcacagttttggacttcgaccaacaacggtctaccgttgctagtacctggtcacttgaaaatagttatgtacttcgtgatgcacaagtactcacc

SEQ ID NO: 7839 - DNA, 736 bp, Diabrotica virgifera
  misc_feature (4)..(112): n is a, c, g, or t
  misc_feature (139)..(159): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaacgtttatttcatactttggcnnnnnnnnnnnnnnnnnnnnntttacttctgacccctctgggggggggatttactatcccgcatacggggagacctacccctcttcaacatctcacgacgagccttggattccttcttacgttgggccaaaagtttagcatatgcatcttcttgttctttacgtttaagggccctcttcttcttcaaagcaagacgaggacgttttctttgcaaaacaacggggggaataagacgttggattttgggggccttggttcttaacttcttaccttctttttgggccaaagggctctttactacatattgacgtacatcgtcttctttgctaaggttgaaaagcttacggattctggatgctctcttgggtcccaggggacggggggatggggggtgtcagtaagtccgggaatttcttgttctccttttcttacaatgactagggccaacacgctgaggttcccatcaacaatggacccacgaactgatttccttttacgttcaccggaacgtcggggtctggaacaggagggaccttttgaaagaaaaagtcttactctaccgtttgtaagaacgccttggttcatggggaatccttgt

SEQ ID NO: 7840 - DNA, 927 bp, Diabrotica virgifera
  misc_feature (21)..(41): n is a, c, g, or t
  misc_feature (331)..(347): n is a, c, g, or t
  misc_feature (350)..(362): n is a, c, g, or t
  misc_feature (393)..(405): n is a, c, g, or t
  misc_feature (408)..(437): n is a, c, g, or t
  misc_feature (506)..(523): n is a, c, g, or t
  misc_feature (607)..(627): n is a, c, g, or t
  misc_feature (661)..(678): n is a, c, g, or t
  misc_feature (737)..(737): n is a, c, g, or t
  misc_feature (832)..(832): n is a, c, g, or t
  misc_feature (894)..(894): n is a, c, g, or t
atttgttttaaacagtttagnnnnnnnnnnnnnnnnnnnnnacatttgagagtgcacattaggggaaaaaccttataagtgtgaaattggttctgcgcattttactacaagtaatttgaaaacacatttgagagtgcacacgactgaaaacctttagaagtgtgaaatatgttttaaagaattttactacaataagtgattcgaaaaaacatttgagagtgcacactggaggaaaacctcacaagtgtgaatttgttttaagcaatttagtcgagcaagtaatttgaaaacacatttgatgacacacactgggaaaaaacctcacaagtannnnnnnnnnnnnnnnntgnnnnnnnnnnnnngtcaattgaaaacacatttgatgatccacannnnnnnnnnnnntcnnnnnnnnnnnnnnnnnnnnnnnnnnnnnnctacaacaaaagttttgaaaatacatttgagagtgcacactggggaaaaaccttataagtgtgaaattnnnnnnnnnnnnnnnnnncataaaatttctttggatgcgcatatgagagttcacactggagaaacaccttacaagtgtagaatttgttttaaacagtttagnnnnnnnnnnnnnnnnnnnnnacatttgagagtgcacactggggaaaaccttatnnnnnnnnnnnnnnnnnngcgcattttactacaatttgaaagcacatttgagagtgcacacgagggaaaacccttanaagtgtgaaatatgtttcaaagaattttactacatttgtactgtacattttgatttgaaaaaacatttgatattgcacactggataaaatcttancagtgtgaaatttatttcaaagagtttagtcaagcaagtaatttgaaccacatttgagtacnagaaggattggacgaacgaatatagctcagctc

SEQ ID NO: 7841 - DNA, 865 bp, Diabrotica virgifera
  misc_feature (11)..(822): n is a, c, g, or t
actcgttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgggagagttcaaatcgataataaag

SEQ ID NO: 7842 - DNA, 699 bp, Diabrotica virgifera
  misc_feature (693)..(693): n is a, c, g, or t
atacatatcggataagaataaggtcttatatctgtacaaacatctagtttagtgaaatttctttttcaaactttaaaactccacgttattgcgatttgataattgcttaaataaatagccttaaggtttgcatgactagaagaaaatggagaccaaaataattcgctaaataaacatccgacttctagtagcgggataaaatatctacaccgataaaacagcaagctgttttagactttttacagttttagtagttaaggtccacaaaagtttataatgacagtagaatgtctctatttggacaaggattgtcacttattagagatgggaaatgcgataaccagcgaacctatcggaaggtcaatgacgcattttcgcgtcaagtttcactattttcgtcttctaaggcttctcaaatgcgcagcttattaaggtgtgtatatgcaaaggatatcggtgcggagaccaatcttcgacatgtacactttcgaacatcgacccctgtaaaataagggggtgagctacataatatgtacatacatacgaaatatgtacttacatacctacatattatgtacagtaggaaaaatgaaagaatagccatgcaggaacatataaaacagttttgcacgcctcatttggtgacgtgaccgaaaattcgcagatatgggaaaaatttgggtttgcacaagntggtac

SEQ ID NO: 7843 - DNA, 272 bp, Diabrotica virgifera
  misc_feature (9)..(41): n is a, c, g, or t
ttaatctgnnnnnnnnnnnnnnnnnnnnnnnnnnnnnnnnncccggggaaaatttcctaaaaaacttccatattggatcccttttttaaaaaattcccctgatttttttgggggttttggtcaatttggaataaaaaaatctacggggtaaaaaccaaaagggtccgaaaaaccactgaaacagtcaaaattatcaatcaaataaaagtggtgaaaaatgaatgtattagatattgtggataaatatacagggaggaggacataccaggaaa

SEQ ID NO: 7844 - DNA, 451 bp, Diabrotica virgifera
  misc_feature (298)..(313): n is a, c, g, or t
ggcctctatatcgaggggaactaataaagaaaacaaagaaacaataaaattataatctttagtaaattttacttacgttttcaagatcaaaaataatttttatgattgaaattttataacatgatgatctgcttaattgaaattactaatcatttaagcaaatagttaagatttttgacaatatggtttgaacatattcgattggcacaagcacacaataataaaaatcatatcatttagataaggataggtattatatacatcttcgcagcttttgcgagctttatttttgaaaacnnnnnnnnnnnnnnnnacgtttgattgacacgttttgcaataacttaggtactaattggtccagtgtaaaactcaccttgttatataactatgtatatgaactcttatttgtacaggtagtctaatttgtgtgttaaataaatgcttttgatct

SEQ ID NO: 7845 - DNA, 925 bp, Diabrotica virgifera
  misc_feature (211)..(228): n is a, c, g, or t
  misc_feature (744)..(761): n is a, c, g, or t
  misc_feature (791)..(791): n is a, c, g, or t
  misc_feature (793)..(793): n is a, c, g, or t
  misc_feature (900)..(900): n is a, c, g, or t
  misc_feature (904)..(904): n is a, c, g, or t
aggaaaagtaaaatccaatgttactagtggactatcagagttttaccttatatattataagaaatagaaagagattcccaatgaaaatttgagaaagatttttataaatcgtagtcatatagattataggtgtttcttacttcataaaaatggtgtttacagtattcttacagtagactagagtgtttcctaaattttttatattgtatgnnnnnnnnnnnnnnnnnntgaaaagctcaagctgtcatctagtcccatgttaaatgttttaataagtgtttggcatatcaagacggaacctaaaataccaaaaaatacctaatgttagtttgaaacccgtttacacaaagtggccagcctgcatgaggtagttcttccattattgcgcaataaaatgatctgtcttagaagtactgactttgtgatattccatattaatagtacattttttaaaatggatgtagtagatacaaaaaaacgattagacttgtagggtagtcggcaagacacactcactaaagccaaccataattttaccactcgcgaacatccatcttgaattttttaacgtattactagatggttctgcactagtcacaaacaatattaactataaacgtgtaaatacaatatgtatccgttatagccttatcaatttttcctatcttttccatattcctaatttccagctactccctctttaggtttacttcttgatcttttgccacattcatgggctcgctnnnnnnnnnnnnnnnnnncctttgttgctgtaagggtggttgcctatnanatgcatcttttgaggcttgtccattccatatacgccacaaaaataggattccatcctatttgtagcctatattattcattcatgtttactctttttcaccctattancagntactgatgtgatattgacctc

SEQ ID NO: 7846 - DNA, 926 bp, Diabrotica virgifera
  misc_feature (522)..(547): n is a, c, g, or t
  misc_feature (619)..(631): n is a, c, g, or t
  misc_feature (633)..(646): n is a, c, g, or t
  misc_feature (839)..(908): n is a, c, g, or t
ggaggttttccatgtttttaatattttttgggcaaattataaaattattgctaaggaaactatttttttaacaggattgtgttttctaaatttaatttgctatttcagtggccggttgtatgttaccgataagcccttgaaggaacgtcaatcttacatgtataccctcctgtaatttctatatgtacaccctccgtaacttgggaaccattcagtttggaaggattatgcatggcacctttttgtttcaaatttaatgtagaacatgtaactttttacgaacaatatgtggaccatatagaacagtttggtgttgaaggataactttcactttggatgtctgggtttgtgtctagttataccgtactaaaggcagatacacaatgaatacaaatacatacaaagaagtgtcgtcacagcactacagactgctcagtctatgtgaatacagtaaagcctcctttaaccgaaataatcacgaaataattggggggaggccatttcggataacaagaatttcannnnnnnnnnnnnnnnnnnnnnnnnntcttcttctattaaattatatagtattggagagatatagctgcaaaacatcgttgtcagaggaaaacacaannnnnnnnnnnnnannnnnnnnnnnnnncactctaaacattttcattttccttaattttattgttttttgtttaatttacttgttttggttaaaaaggtttcggttagcggaggttttactatatatacgtctatggtaccaccaccgtcgtcattaagagcatatttatttttgcaggagactttttttcccctgactattgaagtttttagcagttttnnnnnnnnnnnnnnnnnnnnnnnnnnnnnnnnnnnnnnnnnnnnnnnnnnnnnnnnnnnnnnnnnnnnnnatatttgtggctctgact

SEQ ID NO: 7847 - DNA, 53 bp, Diabrotica virgifera
gtggatgggacagtagttcgtagcccaattcgatcaatttgggcttggcgacg

SEQ ID NO: 7848 - DNA, 915 bp, Diabrotica virgifera
  misc_feature (9)..(28): n is a, c, g, or t
  misc_feature (875)..(875): n is a, c, g, or t
  misc_feature (887)..(888): n is a, c, g, or t
  misc_feature (908)..(908): n is a, c, g, or t
atcaaagtnnnnnnnnnnnnnnnnnnnntagattttgtatttctacactttcaaaaaggcacagtggcatcaaaagatattccacagtggttaaggctgcagcaccccaagcaaataggtcaaataaagacagtattcgcaaagaaattttagaatacaggcacatgtatccagaatttctaccagatcctaaaatcgagtttaggaatatgcttcgagaaaaactagaacgaaatgatatgctagccaggagaggtcatattaatatcccagagttttatgttggttcgatcttagcagtggaatcatcagatccccatgcgccaggaaaaccccacagatttgttggaatatgtattcaaaggacaggctgtggtcttcgtgctaaatttattttgaggaatatcatagatcatcagggaatagaaatctcatatgagatgtatgatccaacaatgctaaaagttgaagtactaaaattagaaaaacgcctagatgataagcttctttaccttagagacgcccttccagaatattgcactttcgatcccaacatggaacctgaaattttaccagaaggttctcaaattccagtaaacacaaccaaagtgaagttgaaaccaaaaccatggttagaaaggtgggaaaggcaaaatcttcaaggtgttcaagatttgggattacctgaaaagttctataagagagctgaagaactagccacaccatgggagaaatatgatttaatgaaggaatatatgcgtacaattcctgaagaagagcaactggaaatatttggtgaaattgataacaaactccagaaactccaagtacaaggaagaaaaatgaagaagagggtctttgtcaaacccacaaangtagcttaaggnntataaataatttttcataangaatttt

SEQ ID NO: 7849 - DNA, 390 bp, Diabrotica virgifera
ccttctccgccccgtcagatggttatatagtaatgggatgtgcacataattgcctcctatgctgttttagcaggtgctgaaattaatgaaataggacacacctacagcagggagctatgggacccactgagcagagatggaattataggcaacagccgagataacataccataaccatgacagaggctatcaactacacacgattcaacttcctctttaaaggtgccatcatacaggaaacttgggactcgagtctcccagtcaatccttgattgtgacagactgcacgtggattatctaagaactctagacagtcttatagttgtaattgtcgattacgtaggtttgctgcgtgcagagcaaagaaagagtattgttgattaccctgcc

SEQ ID NO: 7850 - DNA, 437 bp, Diabrotica virgifera
  misc_feature (5)..(89): n is a, c, g, or t
  misc_feature (93)..(117): n is a, c, g, or t
  misc_feature (120)..(138): n is a, c, g, or t
  misc_feature (141)..(157): n is a, c, g, or t
  misc_feature (174)..(267): n is a, c, g, or t
  misc_feature (284)..(342): n is a, c, g, or t
  misc_feature (356)..(386): n is a, c, g, or t
  misc_feature (399)..(435): n is a, c, g, or t
agacnnnnnnnnnnnnnnnnnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnnnncgnnnnnnnnnnnnnnnnnnnccnnnnnnnnnnnnnnnnncccgggggggttgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggagagaagggagnnnnnnnnnnnnnnnnnnnnnnnnnnnnnnnnnnnnnnnnnnnnnnnnnnnnnnnnnnnaccagtaaaaggannnnnnnnnnnnnnnnnnnnnnnnnnnnnnntgcctatatattnnnnnnnnnnnnnnnnnnnnnnnnnnnnnnnnnnnnncg

SEQ ID NO: 7851 - DNA, 881 bp, Diabrotica virgifera
  misc_feature (9)..(123): n is a, c, g, or t
  misc_feature (129)..(396): n is a, c, g, or t
  misc_feature (416)..(457): n is a, c, g, or t
  misc_feature (459)..(477): n is a, c, g, or t
  misc_feature (479)..(492): n is a, c, g, or t
  misc_feature (499)..(520): n is a, c, g, or t
  misc_feature (526)..(573): n is a, c, g, or t
  misc_feature (580)..(622): n is a, c, g, or t
  misc_feature (672)..(715): n is a, c, g, or t
  misc_feature (724)..(781): n is a, c, g, or t
  misc_feature (801)..(831): n is a, c, g, or t
  misc_feature (841)..(853): n is a, c, g, or t
  misc_feature (855)..(871): n is a, c, g, or t
tcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttctccctagaaagannnnnnnnnnnnnnnnnnnnnnnnnnnnnnnnnnnnnnnnnnannnnnnnnnnnnnnnnnnnannnnnnnnnnnnnnagggggnnnnnnnnnnnnnnnnnnnnnngagggnnnnnnnnnnnnnnnnnnnnnnnnnnnnnnnnnnnnnnnnnnnnnnnngtgggtnnnnnnnnnnnnnnnnnnnnnnnnnnnnnnnnnnnnnnnnnnntcaaatataaattgagtggggtggggtgtggggtgtggtggggggggcgnnnnnnnnnnnnnnnnnnnnnnnnnnnnnnnnnnnnnnnnnnnngcgcaaagnnnnnnnnnnnnnnnnnnnnnnnnnnnnnnnnnnnnnnnnnnnnnnnnnnnnnnnnnnaaaaaaaacaccaaaaaggnnnnnnnnnnnnnnnnnnnnnnnnnnnnnnntggcgccttnnnnnnnnnnnnntnnnnnnnnnnnnnnnnntctccctccc

SEQ ID NO: 7852 - DNA, 587 bp, Diabrotica virgifera
ctccgtctgcatcaagtgacattcccgctatattttcgagtctccaaggcacagacgaagactggcaatataagatggaaccatcagacacagcatgcttggggtttaaagacggaatttgtagatgtccaaggggaaaagatttgggtggtagcagtactattaacgctatgatgtacatcaagggcaactcaagagattacgatcaatgggctgaaatgggaaatactggttgggattgggccaacgtaaaataacagcttcaaaggttaacgaagagtatttcctaatgtaaaaacaagtataatacaagaaaaccattcatatatgctttaaatgaagcacatgaactattgggatataaatctcaagaacacatacaacccacaatatccaatcggagctgtaactgctaatgtgtgcatacataatgaacaaagacaataaacgcttaagtcttattgggatagtttcagatagacatgactatatatgtagcgacttactaatatgtggatatattgtagaagattcagtcacaagtcagcaagtggagacttaaaaaaaaactatgagaatcattaacg

SEQ ID NO: 7853 - DNA, 335 bp, Diabrotica virgifera
  misc_feature (15)..(34): n is a, c, g, or t
gaaagatggggggannnnnnnnnnnnnnnnnnnncagagaagtacactctagatggggaacgaaacggaagccaaccagtctggacaacaaatgctgatgacataacccaagaagaatatggtgaagttttacaaagcattgacgaatgattgggaagtaccatttagcaggaaaacagtttagtggtgaggatcaagtagagatcacagctatggagagtgttactcggcacggaccttttgatttgcttgtgaacaagaagaacgacaacaacatcgaatgtagatgtacgcagaggtgtcattatggaggactgtgcaacaccttgtcccac

SEQ ID NO: 7854 - DNA, 293 bp, Diabrotica virgifera
  misc_feature (28)..(45): n is a, c, g, or t
ctgcaaaacaaaaaatcctaattacctnnnnnnnnnnnnnnnnnnacttcttctttatagccttaccattaaacccttctacaggaacccccaataatgagcttccccgtttcttgattaattcccttgcaatcccctttacagtttgggggttgattggttcaggctttttaaattttttggggatacctttaaatgacttattcttctttttcaaacccttcttatctgaaggggaaggatcttcaaccattttacttttacagccttctcgtacttccctttaaacacaa

SEQ ID NO: 7855 - DNA, 506 bp, Diabrotica virgifera
aaagatgggacgcctggaagtacggggcgggaattcccgggccgccccccccgcccctctgcatgaagaaagtgggcgaagatgtgctactttaatatttgctggttcgtgtctccagttatgtaatataggaaacgtcaagttcctagttgtgtgtatgatatttgccatagtgtcaacacataccacgagaaagtatatcaaatggaagaaaaaagctctacatggtttacgattgtgccatatcgccacttaccgccgacgagtagcgctagaagacagagtaaggaagaacctgaatagcactcactttctgctatatgataagatgcagtttctgcatgtacctactatatgtaaacttggtatcggctcggaaacagccaagtcagctactaagaatgctcgcactgatatacgcagtcacctacagagagaccactctctctgcttgaatgtttggctccgatacttgacatctttgtagtcttgtgtatgaattcatc

SEQ ID NO: 7856 - DNA, 859 bp, Diabrotica virgifera
  misc_feature (18)..(49): n is a, c, g, or t
  misc_feature (54)..(71): n is a, c, g, or t
  misc_feature (285)..(305): n is a, c, g, or t
  misc_feature (608)..(627): n is a, c, g, or t
  misc_feature (850)..(850): n is a, c, g, or t
tgcattttatcttttacnnnnnnnnnnnnnnnnnnnnnnnnnnnnnnnntctgnnnnnnnnnnnnnnnnnnctgaaatcgaaaacatctaatgggaacaatcctatttcattcattctaattttcttatttacctacacacaatgtcttaagagtaaacttgttacttgtcattgctacaagtataagcaatcgaaaaatagctgaaaaacaaaacatttttgaaatattgttagattaccactacattgtttggcttgtttattacactggtatagttccgttnnnnnnnnnnnnnnnnnnnnnaacaaactacaacatttacgcgtttgaaagcatataagtaaaaactaagaaataaataatggacttttcttcatttgataaagaaaatttactcaagattcgaaaatattctgattttgagaatgatgtcggatatacagagtcgcccattctcgagaaaatgaatttgttccaactcaagcgagctcactgtataataaaagtaccaaacaggaatttttgactaggttagcacaggtgaatgtaaaacatacttttattgatgtaattacttaatatgattaagaaataatcaataggtcnnnnnnnnnnnnnnnnnnnncggaattgtccaaatacctttcttttttccttttacatttggcttctataacacttttctttttttcgttgcactagaaacttgttaaagatactcacaaaaacactccattcaaggttgacgaaaaaacacgagcggagatgtttaaattgcggcagacatggaatgaggtgtttccccaaatgaaactatacgccatagatgtgcagatcagtcttttggnatcagcatg

SEQ ID NO: 7857 - DNA, 942 bp, Diabrotica virgifera
  misc_feature (794)..(794): n is a, c, g, or t
  misc_feature (804)..(805): n is a, c, g, or t
atgatttttggactgagagcggatccaaggttgaggatggatagtggtacttcagtacttcagcagctgttggagatatctacgtatcagcctcgtttgcaccacacgtttgtttctggtgagctgatgtagaaatgatttaagagaaatttggcaggtttttctggaggaactttctaaatcttgtgtttttccttagacgccggaatatttttctgtcagatttcatgagtgtactatactaattaaataggcaaaacatttgcattcatttttttcttatgttctgcaaccttcattggtgattttttttctgaatttttcccctgattttctactctttcaattgtatttactactctcttctcaatggttctagtaagtcttctaacccagttagttttataacgttagaatcttctattgctttaagtttgaatgattctcttattgttttttgcgtcccaagagctgtattttcttttagccttagctcataaaatttggcatgctgttgcctgtttcaacatacaacaagtgttctatagccatgtaggtgtgttaaagatacccaattcttaagatggtcgttttatctgtggatccaaactttctcaggacctcgagttcgagaaaagaaacttagtttccattatatccaaatacctttacatagagtgaacacgtatagtatactgatagggacattgacattattacaatataacatagagttccatttaatttggagtaatttcaaatggtttttttatttcatgggtccaactttttanataatgattnnaaattaagataattctaaacaattggaatatgctctttctacactttagtgataggcctgttatactacattatcaaaatatgataacttcttcttatctaaaataaaatggtttcaaatgcatgtatacacaagca

SEQ ID NO: 7858 - DNA, 143 bp, Diabrotica virgifera
aaggaaagaacaaatggttcttcccttgcttatacctttcctcaaatttgacacgggtctggaatctagccttcttcctcttcatggcatctttgaggtccgtgtcaaatttgaggaaaggtataagcaaggaaagaacaaaa

SEQ ID NO: 7859 - DNA, 440 bp, Diabrotica virgifera
  misc_feature (2)..(166): n is a, c, g, or t
  misc_feature (230)..(243): n is a, c, g, or t
  misc_feature (246)..(268): n is a, c, g, or t
  misc_feature (337)..(360): n is a, c, g, or t
  misc_feature (367)..(426): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttcacatcgataataaagattgcgacctcgatgttggatnnnnnnnnnnnnnnggnnnnnnnnnnnnnnnnnnnnnnntgttcgactcttataattttacatgatctgagttttaaccggtgtgagccagggtgggtgtctatctcnnnnnnnnnnnnnnnnnnnnnnnngaaaggnnnnnnnnnnnnnnnnnnnnnnnnnnnnnnnnnnnnnnnnnnnnnnnnnnnnnnnnnnnncgggtctaaaggat

SEQ ID NO: 7860 - DNA, 581 bp, Diabrotica virgifera
cggcaattacgcgttgtttggaattttgtaagtttgtggttgaatttattgaaagttaagatggcggatggttacggtggaggcggcggtggatacggagattattctcaaccacccccaagcacctatccaggctatggcgcatctgctggaggctatcaagccgcggctcctgcctctggaggcggtggtggtggcggttcctggggccaaagtaggggaggccaaggaggcggttatggaggaggtcaaggtggtggaggtggctatggtggccaacaaggtggtggatatggcggctccagtggaggcggaggtggatatggtaacggtagcagttatggaggaggtggtggtggtggaggaggctatggaggcggaggtggaggatacggaggtggtggcagagatcaaagaggtggtggaagagatatagaaagacgagacagttatggataatttagtaattcaaatggatacagtcttcgtatctggaatgaacccagatttaactgatgatgattttgagcgacattgtggatctattgttattattaagttgcacaagaaaacccagaagc

SEQ ID NO: 7861 - DNA, 513 bp, Diabrotica virgifera
  misc_feature (8)..(46): n is a, c, g, or t
  misc_feature (290)..(324): n is a, c, g, or t
actagccnnnnnnnnnnnnnnnnnnnnnnnnnnnnnnnnnnnnnnnttatttcactgatctcctgaccgctaagtactatggacgcgagaaaagctatctgatagcagagaatggagcttgtgtgtgatggcccgtgtgcatcagggattcttagtggagagaccacaccagaccacactatccactgcgacgaaagccagcgagctcaaacccgtaacagtgaaactaccaagctggaaggcaggctgtcgcagggccaagagtgtagctacctgtatgaagatggaannnnnnnnnnnnnnnnnnnnnnnnnnnnnnnnnnntgagcgagaataactcatagtactagcagctgcctccggcacagatggatcacagtacagagatctgatacgaaatcgcgcgtcactactgctaaaatgttacaacaccacttatcgactctgcactctcatgcattaacataagcaaggagatcatcttataccattactactacgatttgttataca

SEQ ID NO: 7862 - DNA, 1029 bp, Diabrotica virgifera
tttgataattaccagaccgtactgtcataaaacgacgatgtcatacagtgagataggtacatcttttgttttaaaatcgatttacagattgggaatttaaataattgtaaattacgcgaagactgttagacctgggtgtgggacatccatataccattcgaaagaggtgactttgtttagtataattagtagttaatatacatggtgttctatttggaatgggcatcatatgacacattgaatggtccaataatgaaactgtaaatgttgaacgccctgtgaatgggtgtgtaatagtcaatcatggaatgcattcggccaatatccaactgtttggatgtggaagtgtttttttatggtttcttaaataacttgagagtgggccttcttttaaaactttacattttgagaggagtcgacataactcagagcactctgtacatgggtatagggagtccttatggggctgtaccttgttttttgcggacagttaaagggtgcaatggaatacagggtgttccataagagtgaatataacttttatgcgccgccatttattggggcacactgtatatttcaaagtgattttaaaatgtagattttatcaacttgcaggccactaattgaaaattttttcaagtcttttaccatttcgctgtggtcttccgtcgcgttggtggtgactcaccctgtataatataaacttaatataggaaacaaataagaaaaattaaaagtctcgaaaatgtagtagccagaggctcaaaaagttttcaccgagtgaagacatgtgaatgtaacttgaattgatttgtttccatttactttcactttccatctgttgaaccgtatttttttatttcttgttttattttgggtgaactgaaagcttttattggtcactagccatcactatccaggaaatctcttaaagtttggttagtattacctagttggaattttttttaattgtcagagaagtatcatcaatgctttttttgtgtttttcctattggtcccccctattgg

SEQ ID NO: 7863 - DNA, 453 bp, Diabrotica virgifera
attgtttcttatacgaataaatgtgtaaattcttctctgtggactgaaatcttgcgctgagatcatcaaagctaagctttattaacagcaagaaatctacgatagccagatgaacgaatagtgtacgatctcatcacagcaattgcatagttcatagagacgggtagctccgcgagacgatatctccctttgccgtcaaacgtctctggtacacaaggtagggagcatagagctctatagaaggtatgtattgatgtcctgagtgaattgatggagagcaatattaagtttgaagcgatcatgctgcagtactttatgtcaccattgacggactcatacttagattatgagcagagtaatgcaacttatgagatccactgcagtgtagcgttcgtaattgttcgttggagtcagaagctacgggtggtaccctcttgctcatttttcctaaac

SEQ ID NO: 7864 - DNA, 765 bp, Diabrotica virgifera
  misc_feature (667)..(685): n is a, c, g, or t
  misc_feature (688)..(702): n is a, c, g, or t
cccacgccaccggggtttttacatatattaaagacgagattaagaagaaaattatgtcctcgcttgctcagcgccctgcctcatgtcacgggggaaattacgtggaggtggacccctgttccttctttcggacttggacctgagacggccgagattcgggagactacccgaggaacactcatagcggactttcgcatgcggctagaaaggctgatagtagctcatagagagagaagatgcccgagagatcagcgagacgagtagaagcgcgcgacagaaagatacgtaatgatagccacttatgtgataggtatgactattacccgaacagcgccccctaatgagcgtatcaaacagactgaagcggaaccgatccacgggtggctgtgcttaggtaccctctatacgatgctggaagcctcagagagtcagggggctcatttttgaaaaggtttaagagaaatgacttgaacgaggcactaatcccgagtgcatgtaaataatcgaacagccatagcataaccggtttttgactaacaggataacaaaaagtccaaaatatacagaaaagcataacggacattgtattactgtttgagatggtcggaattaactaataatccttaatgatttcagaaaggagcattttttcgaaataaaaagttgnnnnnnnnnnnnnnnnnnnccnnnnnnnnnnnnnnngaataagaacgttgaatgcgtgaaactttgcagaccatatagacataacatagatcaaggaca

SEQ ID NO: 7865 - DNA, 105 bp, Diabrotica virgifera
  misc_feature (9)..(9): n is a, c, g, or t
  misc_feature (19)..(19): n is a, c, g, or t
  misc_feature (27)..(103): n is a, c, g, or t
aaagcttanatttttttanagacgagnnnnnnnnnnnnnnnnnnnnnnnnnnnnnnnnnnnnnnnnnnnnnnnnnnnnnnnnnnnnnnnnnnnnnnnnnnnnngg

SEQ ID NO: 7866 - DNA, 805 bp, Diabrotica virgifera
  misc_feature (731)..(731): n is a, c, g, or t
  misc_feature (741)..(742): n is a, c, g, or t
cgttgcattttttgtctagcggtctattctgctacgctccatttgattttggcaatttttgttgtgacatcctggacttttgtttttgatcttacccagtcgtttgtgtttttatctgatagtcgtatatctagcattgctcttttcattgccctttctgttgtggctagtttatttatattggccttggttagggtccatgtttgacataaatatatcatgatgggaagatggttgaacattctgcccctcaagtattgagatttttacggttcttaagtatccaactaagtttaccaacttttgcccataccagtcttgctctgatgatgatagtaatgttttagaggctataacttcgtttttcaataccatttataccagcggacaactaactacctaatggttggtctaattcactgtatatagctctacctaagaagcaaaacaaagctacctaatagcaaaaacctgtgctgattatagaattatcagtttgttaaaccatttattgaaaatttttcatggtcgtatctacaataaatgcgaggaataccttgatgacacacagtttggtttccgtaacggctttggaacgagagaggcactgtttggaatgaacgtacttgctcaaagatgtcgagatatatctgtagacatatactgctggtttattgactttataaaggcatttgatcgtgttaagcactctatattgatcgaagctctanaagacattgnncttgggacgcagagatattcgaataattgcaaattttttattggaatcaagcaacatcagttt

SEQ ID NO: 7867 - DNA, 965 bp, Diabrotica virgifera
  misc_feature (778)..(778): n is a, c, g, or t
cggagtccaattcagccaatttaaatttgtaatgagaagtcagtcttagggagtaaacaaacgaaataggatcgttctgaaagacaatatgagtacgaaagagattgtcttgccgcttgtgattgtgcaaatagttcttttgattttattttgtgtattcgggagatatgcaccaccaggaggggatgaaaaatatccattgagacgacggcattttggcaggcatacaagactaaaggaatatgtgcgataactatcgttgaatgtaaacacactatctactgggggcgtaattccaaaagtaaacagtaacaatcgagaagctaaaagcaaaatgcgctgctgtgtttcaggatgtccacgtcatgatattcatcggttttggttttttaatgacgtttctgaagcggtatgggtacagcagcgttggatttacattattattgggatctttcataattcagtgggctatactttgccagggattcttcgaactcaacgcagactataaaattgaaatagggatcgaaagtatttaccgagccgatatagctgcagcaagtgtactaatttcagtggggagttgtgcttggaagaaccaccgttcttcatttgctcattatgggtttgattgaaattgtagtattctcagccaactcatatcttggaacaaaggtcttgcaggtcgcagatgcaggtggttcgatattcgttcacgctttcggcgcttacttcggtctagccggttagttacgtgctgaacaggaaaaagaagaantaaggaaggaaactcggaaacagccgcttccttagcagaagctaactacacatcaggacttggttgccatgataaggtactgtgttccttatggatttattgggcaagctttaacgccatagaaattgaaagtagccaaaagagcactgccatcgtcaatacctaccttgcactagcctgcctgtac

SEQ ID NO: 7868 - DNA, 943 bp, Diabrotica virgifera
  misc_feature (630)..(652): n is a, c, g, or t
gctaaaggctgggcggccagtattctattcaacaaaaccgtccgagaacaattcgacaaattctttgccagaagagacacgttcagtttgggagtatgtaacggatgccaattgatggctcttatcggttgggttggaacacctgttaatgaaggtactaaaccagacataatgatggaacataatttgtctgagagattcgaatgccggtggagcactatcaagatagaaaaatcgaaagctataatgattaagggtatggaagggtcttcatttggtgtgtgggtcgctcatggagaaggtcgcttcacgttcaaatcagacaccatctacgaccaattgaaatccgaagaactcgtcgccttgcgttacgtagacgataacggaaaaccgactgaaatctatcccatgaatcccaatggaagtattgagggattggcgggagtgtgctccgaagacggaagacacttagcgatgatgccgcatcccgaaagatgcgttcaaccattccaatggccgtacatgccacaaagctgggtacactacaagaagagtccatgggagaagatgtttagaaacgcttatgaatggtgcagaagcaataaattccataatgtttattattaagtnnnnnnnnnnnnnnnnnnnnnnncaatgatctagctcaaattttataatgtttatacacattttgaagttattctattttagatatagcagtttcgaatgtagagttgagtccatggatatttacccgtgcgtcatcatttacagcatacgaaataagtcggaaatttacttaacgcaacagcaagtgacagaaagtggctactgctccgatgacggatattataaaatttgacattatcaaataaatagaatgtaaaaatggtagttttgctttaaatttttggtgcagaattacactaacatttgaagtagc

SEQ ID NO: 7869 - DNA, 745 bp, Diabrotica virgifera
  misc_feature (601)..(627): n is a, c, g, or t
  misc_feature (630)..(671): n is a, c, g, or t
  misc_feature (674)..(691): n is a, c, g, or t
aaaattcttaataaggatatagtttgtaaaaaaatcgaaaaatcggtgcatataccgagtccgtagacccagtacaagcgaagttgtagctaatgaaatcgtaggttcttattcgtcaaattccaaatcgaatatttcatcgagaaatcgccaagaaactcgaacacttctcggggaacactcatttcaacttttttaacgtgtttaaaaaaggtttatatttgtttttagaaaaagacctctagcgttaggagtgagtgagtcatcgctcaaaatattgtttttgccttttattttttggtaagaagaatcccgaaaagcaccccctaatttgcatatcaaatagaattagtcgtaaccgtttcacaggttgctttgcttatttattctttatacgatctgtaagtctcagcggttcagggtgcttatttttgaaaaggcttaagttaaatgacttgaacgagtcactaatcccgagtggatgcaaattatgaacagccatagcataaccgatttttgtctaacaggaaaacaaaaagtccaaaatattcagaaaagcaaaacgtacattttattactttttgagatttttggtattacnnnnnnnnnnnnnnnnnnnnnnnnnnngcnnnnnnnnnnnnnnnnnnnnnnnnnnnnnnnnnnnnnnnnnnccnnnnnnnnnnnnnnnnnngcacgttgaatcgatgaaacttgcagaccatatagacataacatagataaagca

SEQ ID NO: 7870 - DNA, 89 bp, Diabrotica virgifera
  misc_feature (14)..(79): n is a, c, g, or t
ttttacatcggaannnnnnnnnnnnnnnnnnnnnnnnnnnnnnnnnnnnnnnnnnnnnnnnnnnnnnnnnnnnnnnnnnaattcgtgca

SEQ ID NO: 7871 - DNA, 222 bp, Diabrotica virgifera
ccccctccgctacatcactagcgtgcgcactgttttcattttttgttacttgttttccgtgtatacattaatatcgcttgtacagttcccgaattactttagaacgtgactgataaaatctcgtgttgtcgtgtattactacgacacctctcttcctgatagctactttgatcatggacaactgatacaatgaatgactactgatatttgtgctggcacacc

SEQ ID NO: 7872 - DNA, 380 bp, Diabrotica virgifera
gcccccccccccgccaatccgattcctattgcggaacccggtcatagtaaccgacaaatagtcgtgacctcgcaacaaagttcgtcgtggaaacccatttagacctggagacatcgaacagatatgggaggaagagctttctcttctgtataaacgttcgagttccatggaatcctctaacaggaatatatggttggaagcacaaagagcaccgcagctagcaacggaggccggatcttctcctcgaaccttgaaaatccaggataggtgcacggaggaggatctcaccggttcgaatccgatatccgcagttagacttcatgtagaatagcctctagagcaatggaatattgtagatgagtcaagtatgcaaagaggat

SEQ ID NO: 7873 - DNA, 940 bp, Diabrotica virgifera
  misc_feature (643)..(665): n is a, c, g, or t
  misc_feature (831)..(877): n is a, c, g, or t
aacacaaatgttaaaagtttatcaatattgttaaaattctgctacggaaaagaatttgaaaatatggattttaatgatatttcgtcgcaagattatgtggatctgttacttagagagggtagaaaaataagatgtgataatactagtgaagcttttaaaacacaaacaacactaccttcttattacgacaaacgcttatttaaaaggggtcaaaaattcataaataagcatctatatgccatgggtctatctcagacatttggtctgatatctatttatgctatttcctccataataaatgttttacgaacaactaccaggaatagcactgctttagcaatgtacaagcggcaaattcccgctttctttatcatggatgttttatacacatctgattgtgagccaggatcaaaattttggaaagcaatatcgtttattaaacacatgcacaactcatccagtaaaggaagtatacgagcaaaatcgaatccaattaaccagaaggatatggttctgtctcagtttttgttcctgggatttcctctagtgaggggtgaaatgtgcggtttccacggaatcactaaagaagaacgagaaggctttatccatttttggagagtaattggatacttattaggaattnnnnnnnnnnnnnnnnnnnnnnncttcccaactcataaagtaatcgacatatgcgatcttctaatagatcaagcattcagaccagaaatagagaaaaaattaccattaatgctggaaacatcaaattatatatgtacagctgtttcaacagtcataccagaactgaccaccacatttgccctcaaccannnnnnnnnnnnnnnnnnnnnnnnnnnnnnnnnnnnnnnnnnnnnnnatcccatttatttggagacgattttattgtaggattctactataaatgtatggtttttatgat

SEQ ID NO: 7874 - DNA, 419 bp, Diabrotica virgifera
  misc_feature (28)..(46): n is a, c, g, or t
  misc_feature (355)..(374): n is a, c, g, or t
gaaaaatattgtttaattcacgacactnnnnnnnnnnnnnnnnnnngatacttaggtaatccgcatgaatttaacaatagatcgattgataggacgttgaccttaagaatttcttcgacccaagaatgtattttatacgtactactatttaaggtaatattcttatacatagatgtcaattacattaccatcatgtgaacaacggaaggattatactcactctagtgatgtcggataagccacacctgaggttatgattaaatattaattactatagaacctcgagtgcaaacagcttatttccattctggagtatgtcagaattctgataatcatgtgcgccgagttactaggnnnnnnnnnnnnnnnnnnnntatatctgcattaggagagtcgatggcgatgcctgtggcgagtac

SEQ ID NO: 7875 - DNA, 819 bp, Diabrotica virgifera
  misc_feature (10)..(37): n is a, c, g, or t
  misc_feature (211)..(236): n is a, c, g, or t
  misc_feature (803)..(803): n is a, c, g, or t
ctagatcgcnnnnnnnnnnnnnnnnnnnnnnnnnnnntgtaccattagcaattaagatcagaaatcctgaattgtttaagcaagaaataagaccacatttaaataacggtcttcatgggagtggtggttttgaaatggctcttcctataatcgaggcaatacttaatgagtctcaaaaatgtgcacctctagtaccaaagatccaaaaacnnnnnnnnnnnnnnnnnnnnnnnnnngaagacaacgaagcaaaggaaccattcgctacattcagtcatggtgatccttgggttaataatattatggtcaagtatgcaaacggtgtagcaactgaattaaaatttgtagatttccaggtatatgaatacgcctccccagtagcagattttctatatttcatgtttacgagcgttcaaaataacgtcctgaaagaaaatattgatgattttctaaaattctatcatagcagccttttacaaaatttaaaagagctgggatgcgatctggaaccatttggttatgatagatttttaaaagaatttgaagaacatacatacatatcgttgatttgggttctaacttttatcccttttgtggtttttggaaaaaaaggtgatgattctacagtacctagttttcaggatattaaatttagtgacagtttaagtgtagaggatgctagaaagagattgcctcaggtagtcaaagacaaaattcactttattgtcgaatattctgcaagaaataactggatttaaatagataaatcttataaaaagtagtattatactacattgtcttanatacagtatttattat

SEQ ID NO: 7876 - DNA, 880 bp, Diabrotica virgifera
  misc_feature (42)..(79): n is a, c, g, or t
ataacaacaaactttattaaaactttacgataatacacagcnnnnnnnnnnnnnnnnnnnnnnnnnnnnnnnnnnnnnncatattaatatctaattaaaagtggtaatacacttaaagttaattcagttttcagtcttcaaaacggcttcgctcctccaatcggttctcatatatcgccttttaatcttaaattctttgggtcaaatggacttctcaaatatagtgaagcgggatactttttattgcggacttcgatgtggtaggtgccgttcttaaggaattcattgtcaattacttttcccttcggatgttcaacataccctgtaccaatcgtgctgtcgaggctgaatccataatctcctcttcttaaaattcctacgataacatcatccctccaaatagtttcattgccataaatagctactggttcttgtaatgtgaagaatactcttcgctttgtaacaccttgtttgaatttttctaccgcctgctttcccaagtattgtccatcttttctgcaaaaagctcccaaaccagcttctattggattatcgtctaatcttagatcgtggttaagcagatggtagcctttttctaaacttaacgattctagggctttaaatccggcatgcttcaaatcaaatcctcttcccgcttccataattttattatatacagggatgcaagaagcaagtggaatggggatttcgtaacccaattctccaatataacttatccttagtactctgcaagtgtgtccgttgatttttagaattttagacattccatatggaagctgctcgttagttatagggaattcagttatcgattgaagtattcgccactttttggtcttgtatagagagaattctatcctgt

SEQ ID NO: 7877 - DNA, 92 bp, Diabrotica virgifera
  misc_feature (26)..(26): n is a, c, g, or t
  misc_feature (42)..(42): n is a, c, g, or t
gtactctaccatattcttttgagaanagttttaccagaatanaacaaaatgtctctcgctgatcccgttgcctttatgaaggatttcctcgc

SEQ ID NO: 7878 - DNA, 479 bp, Diabrotica virgifera
  misc_feature (293)..(311): n is a, c, g, or t
agttttaagagtctgcgctctggagaaagatcttgcgttatttcctcacgcagacagaaccctagtaggggaaagaggagttatgttgagtggaggacaaagagcaaggattaacttagcacgtgctatctataaagaatctgacatttatttgctagacgatcccctttctgctgtagatactcacgtaggcaaacaattatacaccaattgcataactggctatttgaaacataaatgtgtaattctagtgacgcatcagctgcagtaccttcgtactgctaactgcatcnnnnnnnnnnnnnnnnnnnaaatcagagcctcaggaacataccaggctttaaagaattcagacagtgcctttactaaacttctagcttcttcaaaagatgaagagaaaaaagatggcgcacgtagaatttctaaggcggagtcggtagagtccgaagctagtgaagccgaacatgaagctatagagc

SEQ ID NO: 7879 - DNA, 362 bp, Diabrotica virgifera
ctttgtccggagaaaggcgatcctttatctgggaatctcttcaacttgagggatgataaatggagaaatatgagggctaaacttacaccaacatttacaacaggtaaactaaaaatgatgttccaaactatgatggatgcttcatctggtctggagaagatattagaaaataaccgcacatctaaagaaccgatcgacattaaagactcgcttgatgcgcttcactcgtagacataatcacttctgtagcatttggaatagaatctaaaagcatggacaatccagattcagaattcaaagctatcgctaataaattattaggtcctccaccacgcgcattacaaaagcgtactatatttacg

SEQ ID NO: 7880 - DNA, 926 bp, Diabrotica virgifera
  misc_feature (635)..(664): n is a, c, g, or t
  misc_feature (755)..(755): n is a, c, g, or t
  misc_feature (785)..(785): n is a, c, g, or t
  misc_feature (795)..(795): n is a, c, g, or t
  misc_feature (805)..(805): n is a, c, g, or t
  misc_feature (814)..(814): n is a, c, g, or t
  misc_feature (826)..(826): n is a, c, g, or t
ctttaacatctccataactacatatttcgattcccagatattggaatttcgagacttgttcaattagttcgttgttaattactaatttgcatcttatgggttcccttgacactaccagggattttgtgttggctgttgatattttcatgttgtagttcttcgccactgtattgaaagtttgtgccattcgctgtaggttatcctcgttatcggagattaagattgcgtcgtcagcataacagaggatttttatttgtttttccgccatcttatatccatttccagtacctttaatgttttctatgattttgtccaagactaaattaaaaagcaatgggctcaagctatccccttgtctgattcccgcgttgatttctacttccgatgcacaaagttggttacagtttttagtacctagtagatttttatggtttgattttaaaaatgaaagttattaatttgacagttttaaattgcattgggtttttaattaattattgacaaaataatctgcacttttgtaacttttcagtgtgtaatactataaaacagataaaaaagaatgtgtgtgtactttgtacgcacgtaagaagttatacttctactacatattatatgatttttaagacaatacnnnnnnnnnnnnnnnnnnnnnnnnnnnnnngcacacaaacacattgaaaaatgccacaaagaaaaaatgatttctgaacgataataagcacactatctgaggactttgcatacctataatnattaatatataggatctttatattcgattnccagcataangatgctggtnaataacttnttccaaaatggnctattctccgataatcagcccagacttagtatagaagccatcaagggtagaaatttcagaagactcgttacagagaaatgatgaaaactacttagtatac

SEQ ID NO: 7881 - DNA, 464 bp, Diabrotica virgifera
catatataattaaaccagccagcacacaataaatatacaaatttaaaatagaaacatcttcaaaatgatacaaattaaaaaagaaccacttgctacattatttaacttagttatctcagtacgtctacaagtcttgtacagtaaaacttcctctttggaagaaaaagatcacactttttttaatttgctaaaaggaataatttattctaccttcttcttgggatcgacattccagtagaacaataattggactactagaacagcattagataaactactagctatacagactggcttaattggatacttggtattatattatcaaggaggtataaccaaagcaatcgcggatctcttagtatatgtaaccgcatgctatgttatgatgctcggaatgacaccgctggaattcttgggggctcgtcacaccctcaccatatttgtagggggggggggggagcgcg

SEQ ID NO: 7882 - DNA, 886 bp, Diabrotica virgifera
  misc_feature (802)..(802): n is a, c, g, or t
  misc_feature (857)..(857): n is a, c, g, or t
  misc_feature (861)..(861): n is a, c, g, or t
  misc_feature (871)..(872): n is a, c, g, or t
aattgaggtaaatgatgaagactaccaactaaccattaaagaaacctctcaaaaaggtttcattttagaagcaggagaaaacttggacttcttagatgcagaatttagtaacagtatacaaaccaccgctacagacatagtgatggtattagacatcgcttagaagccacatttccttgaaaattccaacagataaagttaccaatcacagtgatacttatagacaggttttatgtgaatatttagaattcactaagttctacttaaacttaaaatcaagttatttagcctttgatttgagtaaaattagtataacaatgtttgatgaatcaaatagggaacatagtgtagtaataagagtgaattacaatgacaggaacatttttgagatagtagactgtgatttgccttgtgaaatggaaaatttccaaaaatcttccaacttaaaagcagtgtataaccagtttgtcgaggatgttgaaaggctgcagctcttttttaatttaatggaagattttgataaaaattgcaatattttggatcctgtaccaccaaagaagagatacaactttagaagaatttggctaggcgaaactctttcagttataataacagttgatccattcagcttaggtcggatgcctacaataattttccttggaccagagaggatggtggagacttatcgcatgacgatgaataataatctggaaaattgggatacgaacaattgtattttttcagaaatactcaaattaataggtttagacaaatttccaacgaaaccaatcaacgaaggtanacaagacgatcttttattagaagccggagattgcagcatctgtttctcttatagnatanacgacaattnngcccgaaatcgtct

SEQ ID NO: 7883 - DNA, 960 bp, Diabrotica virgifera
  misc_feature (797)..(797): n is a, c, g, or t
  misc_feature (910)..(935): n is a, c, g, or t
aaataatttaacaaacttgtcaaacttgatcaaataatgtatgaacaattaaattgtttataacaattttttgaccactcggatcgaaatatcgaaatccccctcgaaattcgtaatcagcagcccaagatccatgggaggccgttgagtttgtccatcagaattgagaatgacacggtgacctctatttggcgcctagaatatatgtggggtagtttattcgggtcactcacgtcgtacaaatcatcttgtatagacgaatctaggtggatcatcatctagttaaaatcgaaactattttttgtagcttgtatgggatttatttaaggatggattataggattaataaattgttctattgatgtatgcgagcaatttgtgtacctaaatattgtatttgtatcccacgttttacttttattattattttactgttttattgctctgtttacatgactaaactcggttacagacattggggtgacatttattcgagattttaaaaagatattcatgtttcccatgactagacagataaagctaaatactaaatattttatttgtgctatttttagtatacgaaactttaacgacataatatttaaatagtttaaaataattacgctcgcactcgtatttaggataaacatgtaagatataaattaaacataattcgaaatttttaactcgatataaaattagaaaacttccatattgataacaagtaaaatcgaagttacaaagaagtggctgaagggaatattacagataataatttgaacagaaattaacactancatagttgatttcttgactacaggtgcaaatacgaatatgatgtacctctagtactctcatttatcgacatatcatacttgtcatacactaggattcgtttaatatttcttcnnnnnnnnnnnnnnnnnnnnnnnnnnttatggtaagtataatatagaaaaa

SEQ ID NO: 7884 - DNA, 246 bp, Diabrotica virgifera
  misc_feature (146)..(146): n is a, c, g, or t
  misc_feature (171)..(171): n is a, c, g, or t
  misc_feature (204)..(204): n is a, c, g, or t
taatccgccactttcttattgaacccaccagcagcggagttcgactaaagggatgtcagaacgagccagtgttcagctctttgtccgcattgatataccaacattcgattacccagatggcgcttccttgcagacttattcttccnaatgaggacttgaggtattcggaancaaatggcgtccagcaacaatcactctatacgncaggagcagcctgtaacgttctgtacctctccaccatcgaca

SEQ ID NO: 7885 - DNA, 721 bp, Diabrotica virgifera
  misc_feature (3)..(84): n is a, c, g, or t
  misc_feature (92)..(211): n is a, c, g, or t
  misc_feature (215)..(575): n is a, c, g, or t
  misc_feature (577)..(590): n is a, c, g, or t
  misc_feature (592)..(621): n is a, c, g, or t
  misc_feature (630)..(707): n is a, c, g, or t
  misc_feature (713)..(714): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnngnnnnnnnnnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnngaaggnngtggatg

SEQ ID NO: 7886 - DNA, 701 bp, Diabrotica virgifera
caagatcaacctttcaagaatctcgcatttgatctaggaatttacgtacaaaaactaacattaaataaaagatgtattaattctgacctatcacaatgacttctgcacgatgaaagatactgttctctcccactgacaaagcaatggaaattatgacacccattacctgagccttcatgcatgaaagaacacctcttaaaccaaccttcctggacataaccctttctgaaattctatctgttctaacagatttttcttactgaaatgaatcatctcacaatgcaaaagatctgaccagataaggacttataccacgagaaatacgatgagatgaattttctctaaagaaatcgacttgctctgcgtcacgtactagtgggaaatttcgttatatacatttttctactacaagaactttctacatacatttaagactgcgcactggggaacacacttacaatagagatacttgttttagatagtttcctcataaacgtcatttgcacacacgtttgagagtgcatactgccagatacaccttacaatagtgaaattatgtttatgcacagatcgatcgatatatatctttgtgtacacatacgaaagttcacactggacaagcgccttactactaccgcagaatatgctttacacagtgcagatataatatatctttgattgcgcatactaaagttcacact

SEQ ID NO: 7887 - DNA, 444 bp, Diabrotica virgifera
  misc_feature (329)..(344): n is a, c, g, or t
cactcgccgcccctgccctgattgatatgaaggacaatggtctttttgagtacaatgttatttctagttctcatctacgctgtacatttcgatttaatttgtagcgatgatactccgtctgtttgagtacgaaagcccccccttcataatgctgcttgaacagccagactgataggtaaatgagtattgatgtttggaagaagagcacaacgagacgctataaaacggatgctctctatattggggcaactagtgtatatagcgtgtttgcagttaaaggagattcatgggtcagattagcatctgttgttcgaattcatgcagagtcnnnnnnnnnnnnnnnntctttaataacgcctccactatgctatagacgatgaacatacctactgtttcccttacttgccttggtggtgagatgggacaagatgctttattgtgatt

SEQ ID NO: 7888 - DNA, 1100 bp, Diabrotica virgifera
  misc_feature (8)..(120): n is a, c, g, or t
  misc_feature (130)..(146): n is a, c, g, or t
  misc_feature (148)..(192): n is a, c, g, or t
  misc_feature (201)..(245): n is a, c, g, or t
  misc_feature (247)..(312): n is a, c, g, or t
  misc_feature (326)..(344): n is a, c, g, or t
  misc_feature (370)..(415): n is a, c, g, or t
  misc_feature (420)..(442): n is a, c, g, or t
  misc_feature (449)..(495): n is a, c, g, or t
  misc_feature (528)..(549): n is a, c, g, or t
  misc_feature (571)..(764): n is a, c, g, or t
  misc_feature (774)..(810): n is a, c, g, or t
  misc_feature (812)..(812): n is a, c, g, or t
  misc_feature (818)..(835): n is a, c, g, or t
  misc_feature (837)..(857): n is a, c, g, or t
  misc_feature (893)..(893): n is a, c, g, or t
  misc_feature (934)..(934): n is a, c, g, or t
  misc_feature (1005)..(1022): n is a, c, g, or t
  misc_feature (1033)..(1090): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnncnnnnnnnnnnnnnnnnnnnnnnnnnnnnnnnnnnnnnnnnnnnnncatttatcnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncattttaaaatacnnnnnnnnnnnnnnnnnnnatcattattatttttactttttatcnnnnnnnnnnnnnnnnnnnnnnnnnnnnnnnnnnnnnnnnnnnnnncgacnnnnnnnnnnnnnnnnnnnnnnncgtatcnnnnnnnnnnnnnnnnnnnnnnnnnnnnnnnnnnnnnnnnnnnnnnncttcacccggttattaaaaacacgtctttttcnnnnnnnnnnnnnnnnnnnnnncgcccaccgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtattannnnnnnnnnnnnnnnnnnnnnnnnnnnnnnnnnnnnanaaaatnnnnnnnnnnnnnnnnnncnnnnnnnnnnnnnnnnnnnnngatcccatttttttgatataagaataattaccttangatacagcgtatttttttttggaagagtcaatcgataaaangatggggccccccagggggggattaaggtttttaattgggggacagatattttttttaaaattggttcgcnnnnnnnnnnnnnnnnnnttgggtttaannnnnnnnnnnnnnnnnnnnnnnnnnnnnnnnnnnnnnnnnnnnnnnnnnnnnnnnnnaggggccccc

SEQ ID NO: 7889 - DNA, 660 bp, Diabrotica virgifera
  misc_feature (28)..(60): n is a, c, g, or t
  misc_feature (63)..(161): n is a, c, g, or t
  misc_feature (163)..(205): n is a, c, g, or t
  misc_feature (213)..(235): n is a, c, g, or t
  misc_feature (292)..(345): n is a, c, g, or t
  misc_feature (359)..(385): n is a, c, g, or t
  misc_feature (416)..(496): n is a, c, g, or t
  misc_feature (513)..(638): n is a, c, g, or t
  misc_feature (646)..(646): n is a, c, g, or t
aaaaaaaaaaaacccggggaggaggcgnnnnnnnnnnnnnnnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngaaattannnnnnnnnnnnnnnnnnnnnnnaacccaccaccccccttttgtttttaagaaagaagccgccccacccccgcccaaccnnnnnnnnnnnnnnnnnnnnnnnnnnnnnnnnnnnnnnnnnnnnnnnnnnnnnngggtgggccgcccnnnnnnnnnnnnnnnnnnnnnnnnnnntaggccacaaacacaaaccccaccggctggnnnnnnnnnnnnnnnnnnnnnnnnnnnnnnnnnnnnnnnnnnnnnnnnnnnnnnnnnnnnnnnnnnnnnnnnnnnnnnnnncccttcccccctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattcntcgtccttccctct

SEQ ID NO: 7890 - DNA, 968 bp, Diabrotica virgifera
  misc_feature (384)..(410): n is a, c, g, or t
  misc_feature (705)..(727): n is a, c, g, or t
  misc_feature (809)..(809): n is a, c, g, or t
  misc_feature (878)..(878): n is a, c, g, or t
  misc_feature (883)..(883): n is a, c, g, or t
ttttgtaatgaatgtttgtgggccgatgtaacaatatggatttatccaaaggatgacttcaaatggaagacagtagataacaataccactctgtcaaatgagaagtttgcttatgaattctgcatttctctttccgatgctacgatgaggtctaattagaccgaaacgtgttacattgtgaacgaagacagacttttaaacggaattaatgtctattgcggtcttggtctactttttgtatcatcttctgtggtggtaacagactttaccaccacagaatagtatcctagggacttgctttcttttgctcttgttttttacgtaactcctctgaactatccacctcttccagtaaactttactacaaatttagaaacataatgnnnnnnnnnnnnnnnnnnnnnnnnnnncaccatcctcacaaagtcttgtcattttgtgttccaacatgttttttttggaatcctctattactctctccaggaaatatacgctgcgcaagtatttttattggattatgggtgattttgaggttaaagatattccaatgatctttgtcagacctttttgcgtgcaatgttttatttatcatgtacaaaaagcaaatagtctggcaaaagggggtgacaaccttccatagaggtgtaaattcgctaatgaacaagcaaaattgcttataaagggaagcagggggaagaagattcnnnnnnnnnnnnnnnnnnnnnnncatgttttcttgactttgtttgaccatttccaggtgttttatattcaaatcattttcctgcaaattaatcctgaatcctganagtcacattacttctgactttctaattaattcttacttctaatcaattatctctgtcattttaacctanatggnagtttttctgtttcattatttagcgtatattaaaacgttgttctcgtctccgatattttgtttcttttttcatcttatttttata

SEQ ID NO: 7891 - DNA, 863 bp, Diabrotica virgifera
  misc_feature (255)..(268): n is a, c, g, or t
  misc_feature (270)..(298): n is a, c, g, or t
  misc_feature (371)..(403): n is a, c, g, or t
  misc_feature (706)..(706): n is a, c, g, or t
  misc_feature (717)..(717): n is a, c, g, or t
  misc_feature (740)..(740): n is a, c, g, or t
  misc_feature (797)..(798): n is a, c, g, or t
atcattatatagagcgtatggagcagtttcttctggactaatttaggttaaagtatgagtatatctaaatttttgaagcgaagcgaattttatgctgaaaacgttatattaatttttttctctatagtaaaatgttaaggcgagcgtcattgaagtagcgccacgaaatagcgatttgtggtccgcagttacagtaaacagtaaagagtcaatttacgcgatgaggggagtcccttatacatgtaaacttattcnnnnnnnnnnnnnncnnnnnnnnnnnnnnnnnnnnnnnnnnnnntactttattcaattttaaaaatacagacaaaatagtatgaagcttcgcgctaatctacactgccgcctaccgnnnnnnnnnnnnnnnnnnnnnnnnnnnnnnnnnttcatccattcattttctatctttatttaaataaacttatatgtatcttgaataaaataggtattgttttaaggatacacaagatacagtccaactatcgataaatagtttggttcgttcaaataaaatgggtagtaccgtgtattagtaccagtgatacaaacgaaatacgaaacatttgtggttttttgaaacctagagtcagtaaaacgaaactaacttgattttacaggtacagtttgtcaaacctaggaaaaactttgaaaatcttacattaaaataacgccacatggcgattttaangattttttttncaacttattcttagatttggtanactgtaaacttgatacttagacttttagacgtcaggtgctattctccattttctttnntcataaaccgcaactttttccctattcttatttataattaagactatagatcattaaatatttta

SEQ ID NO: 7892 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7893 - DNA, 919 bp, Diabrotica virgifera
  misc_feature (248)..(267): n is a, c, g, or t
  misc_feature (663)..(663): n is a, c, g, or t
  misc_feature (819)..(820): n is a, c, g, or t
  misc_feature (874)..(874): n is a, c, g, or t
cacaaaatttatcgttttattaaattttgtcatacaatggaagtacacaacgcctcctttcactcatacaagttatacatataaacttaaaaactacgtttacatcatactagagttaaataaagaaaaacataatacaaaaaagagaaaatatctttgactaactcaaaactcaatgtatcatttatatataaattcataatttgaagaccatcaatttgttttaacatttcctaaccgatttatcnnnnnnnnnnnnnnnnnnnnctcgactggatagttgacttttatgttggacttgtaacataaaaattttgtacgttgtcgggtatattttccaagcgccgcgatgaaatggaatgattggaaaattcagttgaggatgagatgacttattacggaaaatgtttgaatcacgaactattctcttatgatattaaccagcctcacttctgatagggttggaacctttggttgcgttgaccagctcctctttgtttggggcctccgccagcaccaccagattggtatccgccggctccaccgtagttaccgccgccatagtttgagtaatcataacctccataacccccatagccactgccgtagtagtcataaccttggctgtagccatcatagccgtatccttggccataaccatangccggacgcgtgggcaagctccgtccgctgaacttgttgagccagaatatttgtcgaggtatttgccaagttgatgaagcagtttttttcatattctgaaaaggagctaactaaaattaacaccttttattccgaaagctcgccgagctactagannaatatgcagtttaaaagtggaatttgagtgaaactcagatggccagttcgaaanaagaactccggtagaaaaaaaatgctcaggaaaaaaaatgtacag

SEQ ID NO: 7894 - DNA, 761 bp, Diabrotica virgifera
  misc_feature (643)..(760): n is a, c, g, or t
aaacttgacaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaactgtattgctacaaggcagacgtaatgcccgtgaagctgtgaaacactttggtcctgctcctggtgtaccacacagtcatgctaagccattggtacattccaagggacgcaaatttgagagagcacgaggtcgtaggcgctcatgtggttacaagaaatagacttaagttaatcattttgtttctgctgtattcatatttgttgttcaataaataggaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 7895 - DNA, 890 bp, Diabrotica virgifera
  misc_feature (809)..(809): n is a, c, g, or t
  misc_feature (868)..(868): n is a, c, g, or t
ggtttcttcatcttgcacagacactctgcaagttctcgtgcgaaaagccgcttgtgttaaaagctttgcctacgggttcttagcaaccgtcgctcttttatagagtatccaggaattggcaaccgttaaatcaagtaagtgataaaatagccggaggtaccatttcctactttttatagaaattttttatcttccaatatgactttccacgagatcaacccctcccatatggcggttatattctttaattacaaagggacagtctacttcggtagatttttcgcagtcttatcaaagcgttatattttgtatataggagatatacctgcaaaagtggaaagcaagacaactttttattatctttccatattgtagatgagatatctacgccgtcatccgtagcagtatattcatgactatcaccacgaggaaattcttcatatccgtatgtgttggtaatttgcaatacggtatccgttgcctttgaactgttcccaatgataatattccccttttggctttatgtacaagcagctgtacacctgttacctgtataataattatcatgataaagacggaaattttttatgctatggaataatgcgagccaaacgaacaactacattactggatgctccaagatcggtagatagcaagctttcattcctcgtggatgatttgctcactttctagcatttccatatttttctggtgtgtctatctcctctgccatatctttagccccattgcacgtttcttcatcagattcgtccccatagttaggttcaaattcagggtctgcatactantctgtgtaggagaaatcactttcatcttcactactcaggccagtgaaatttgcccatantttctgtagatccttttccgac

SEQ ID NO: 7896 - DNA, 911 bp, Diabrotica virgifera
  misc_feature (13)..(13): n is a, c, g, or t
tgtcgtccgaaanatatttgatcaacacaaatattgaagtgtacataaatagcgtacataaatattgaagtacatcgagataaactatatgtcttgtttgagctaactgaagattggataaatgattaagtaacaagatattgtatggtaatatagcacctgtattctttgttgatttgttaaaatcaaagataatgtatttgaatccatgatatatactcatacccgtgcaaatgttggagggattcaaaaaagtgacaggcataatattcaaacgacgtggttgtcggtttgaaatgtaaatattcaacttaacgaaaataacaatactgtatgtatattcaaggttgattgcaataatcatattctgtttagttaagagtcgatgttttatgttttactctaaccatttgtagataagacacccattcacattattaaagctttttaccctctaagagaaaatatgaccacagtattctatgtgttttgatgacaacatttgaaagatgcacataattatgtactgtatatttgtaagttttaaaaagcgtgttttaagtctaagcactgtgttgtgtcactcggaactagtgcttaaaacataaaggaaattacttggaatgtctgaaggtataagcactaaatctgctacgattccaaaacagtataaatactaatttgaaatcagagaagacatacaaaagttgccaagcgtaaactaaacattaattactaaacaacaataactttatttactacataattttttacattacttatatctaaatggccatcctttgcgaatgataagttacatataaatgctgaccactaatcaccccaggtaattcaaattagcacaaaattttattgattcctattagagataaaaattgatgcgggtcggt

SEQ ID NO: 7897 - DNA, 791 bp, Diabrotica virgifera
  misc_feature (135)..(149): n is a, c, g, or t
  misc_feature (710)..(710): n is a, c, g, or t
  misc_feature (733)..(733): n is a, c, g, or t
acgacagtgtgttgtcacgagggtctcatcaaggatgctgacgaggcaagagtgtcggcggtagtactgcgtcaaattcgaacttaatgtaattacaattttgcaatagggctttccatcgattgtcatttagtnnnnnnnnnnnnnnngtgtcacataatattaatgtatctacttcatacgtctttggtttgtatcattggtatatacctataacgtatgacgtggatatattaatattatgtgataatatgacaggggctcgaaacaaatgactgtgaatgaaaagccctattgccgttcagttaacaatgacaaattattgatatgtggtcgttaaggaagttatgtctgtttttatacggtagactctctataacgaacacggatattacgaggtttcgcttataacgaggtacactagatgtcccgtgaaattcctattgaactataacacctctataacgatgcgtatttggttataacgaggaaaaatgaaatcgaaggttaagtttctttacctgtttttggcgtggtgatggccatatataaataccataactgcctgtatacaggaatgcccaacatctgtgtgcttattgagactagtgctgtaataaattccatcgccggtaataaacttcttccttcttgtttatctgtctaccgacattgaatcgtaggaaatttacaatttacgatagccaaancttcattgttgagatcgaccatncacacctaataaactacgtaagaggcatcgaaacattttcagtggtggtggcatgcac

SEQ ID NO: 7898 - DNA, 764 bp, Diabrotica virgifera
  misc_feature (25)..(48): n is a, c, g, or t
  misc_feature (61)..(78): n is a, c, g, or t
  misc_feature (112)..(134): n is a, c, g, or t
  misc_feature (360)..(380): n is a, c, g, or t
  misc_feature (459)..(478): n is a, c, g, or t
  misc_feature (543)..(591): n is a, c, g, or t
  misc_feature (729)..(751): n is a, c, g, or t
ctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtannnnnnnnnnnnnnnnnnnnnnnagaagctttttct

SEQ ID NO: 7899 - DNA, 411 bp, Diabrotica virgifera
cgggccacccccccgcgcccccgcgcgtccgtggatgtctcgccgaaagttctagtgtgcaacgtcctgggttcatgatattcaacccatattgaagatcccatagacctattggtcagctatatgataccccagacgatgatcccctctaatcgagtggagttagcgtctcttcgtacggatgccaatggtaggcatagttccctcgtgaggaatacttggcatggacacctgagtctatgatggactagagagagattggtgaagaggcgataactattatcgaattctccacaccgtggttacttagttggagattgtcagattacaatactaaactgccagatgtgctttgtactgtagccgcagtatcatctgatgttctcgctgtagattgcggattgagactct

SEQ ID NO: 7900 - DNA, 125 bp, Diabrotica virgifera
  misc_feature (2)..(93): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggaataaacaagcggaatttttttt

SEQ ID NO: 7901 - DNA, 712 bp, Diabrotica virgifera
ttgctgctctcgcacacgcgggcgaccttgtcgtcaccggcatactggaacgaatccttgagcatcttggcgatttcgccgtcggtcaggccgtaggacggcttgacctggatgctggcttcaacgccggaggccagttcgcgagcggcaacgctgagcaagccgtcggcgtcaacctggaaggtcacgcgaatcttcgccgcaccggccaccatcgccggaattccgcgcaattcgaagcgcgccagggaacggcagtcgctgatcagttcacgctcaccttgcagcacatgaatcatcatggccgtctggccatctttgtacgtcgtgaagtcctgggcgcgggcaacggggatggtggtgttgcgtggaatcaccttctccatcaggccgcccatggtttccagccccagggacaacggaatcacgtcgagcagaagcagttcgccaccatcgcgcttgttaccggcgagggtgtcggcctggatcgcggcaccaatggccaccacttgatccgggtcgatttcagtcagcggctggcgaccgaaggcttcagctaccgcctcacgaacacgtggcacgcgggtcgaaccgcccaccatgaccacggcagccacgtcttccaactcgacaccggagtcacgtacggagcggcggcagtgctgttcgggctgcgagcgaccatcgactccatccaggaatcgaacgcttc

SEQ ID NO: 7902 - DNA, 867 bp, Diabrotica virgifera
  misc_feature (828)..(828): n is a, c, g, or t
caaggatccaagtgtcatgaaaataaacgaaaattaaataatttgatttttgttgatctcaaacaaaaatggatagactggaaattaacaaaaagaaattctgtcgcctgtgtttatcggaaactgttatatcgcattcattactcaatgacgataatgcagtatttttagaagctctgacagcaataaagatcgacgaagacgagccattcccaacaattgcatgtgtcaaatgctgctgcaatctaaaatttgctttccaaatccagcaaaacattctagaagctgacagaaagttgcatatgttagaggaaattaatatagatgaactggacataaaaaatagattagttgataatgtagtcgaagtagaagaaaaagttcagtcagtgggggaatgtatcgtggaccatgattatggactctctagtactgacccatccacacctttgagcagaaattctccaaaatcaactctatctgaacttgaaacagaagaactgaaaattggtgtccagtgtgaagcagtaaaaagtgaactcaaatctgacgaagataattcagtagataatttatttgtaacagagactgaaaccgaagaaccagttctttttgctaattttttgtcagcagaagctaatactgatgactgtgaaaaagttccttgcaagatctgtggtcaagagtttctagataaggatatgctagaccatgtgcaattccattatttttctactattaagtgtgatgaatgtaacatgaattgtgccaatatacatacatatagggagcatttagcagatgcacataaagatatcctgctagtangaaggtggacgtgcaaatttgcaatggatccttctttat

SEQ ID NO: 7903 - DNA, 945 bp, Diabrotica virgifera
  misc_feature (3)..(15): n is a, c, g, or t
  misc_feature (124)..(145): n is a, c, g, or t
  misc_feature (285)..(333): n is a, c, g, or t
  misc_feature (496)..(514): n is a, c, g, or t
  misc_feature (731)..(731): n is a, c, g, or t
  misc_feature (826)..(844): n is a, c, g, or t
ttnnnnnnnnnnnnnggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctanagtaccaaaagcttctttttttcttctctcttgcctaacaatatgagaaattaatccaaatcctggtaaaattaaaatatatacttcaggatgannnnnnnnnnnnnnnnnnngttgatagagaattggatccccctcaccagctggatcaaaaatgatgtatttaaatttcgggacagatcagacctctatagggaacgcgaagaaaggaatc

SEQ ID NO: 7904 - DNA, 572 bp, Diabrotica virgifera
cgcggccccttcagcggcccctcacgaggagagttggactacggtgcacccttgttaggaagcacccaacggcggccttatactcgtattacaataaaaggatctatttatggactacgtatacagcatactagagagtaagtcaggaagccctaaaagtagcgtgagagattctctttgactatctcgtaactggcagtgtcatttatatagaagttgacaataggaatactttcagcttgagtataacaatagccgaactgatcgtatctaagagtcagtgaagcaagtatcgactgtattactgcctttcatgctggcactggtaacatactctttttctaccttgtcgggtatattttctaagcgccgcgatgagatgctatgattggaaaatgcacttgcagcagacatgacgcatgacgcaaaatgattgcatcaagagatattctcttatgatattatacagcctcacttctgataggctagaaacctttcgcgtgagtcgagcacgctcctctttgtgtagcgcctccggcaagacctccaaagttgtgatacgtcgggtccag

SEQ ID NO: 7905 - DNA, 895 bp, Diabrotica virgifera
  misc_feature (35)..(47): n is a, c, g, or t
  misc_feature (49)..(73): n is a, c, g, or t
  misc_feature (92)..(123): n is a, c, g, or t
  misc_feature (525)..(557): n is a, c, g, or t
  misc_feature (699)..(700): n is a, c, g, or t
  misc_feature (793)..(793): n is a, c, g, or t
  misc_feature (831)..(831): n is a, c, g, or t
ttttatctaattttaatgtatacacaattttaagnnnnnnnnnnnnngnnnnnnnnnnnnnnnnnnnnnnnnncaatttatctcaattactnnnnnnnnnnnnnnnnnnnnnnnnnnnnnnnngttgagattgaagataattaaaaggagcaaataatgttaaaaagagcatagcagcctttaacacgttaactgctacatgaaatttgtaagaatcaaaataagaaacaagtggtaaatgcgttaatggttgttgtaagtagaaacatattcttaggattgtaattgtttacgaaaataaaaattgtacgagaatttataatctttaaaaactgtttcagttttagcagattagtagcaagtataaatgtatattgattgttcttctatggttcttaatgctttttgatgtaagaatgtacatatttctccatttgggattgctcatattacttatgcggaatttataattgttttttcattatctcgatacatctgattggtggttgggttcgatttctcttnnnnnnnnnnnnnnnnnnnnnnnnnnnnnnnnngtaatcagaaggtcaacattcttgtaaattcgatgttaaataggcaacatgtttcaaatgtgtccattattcccttatctactattcttaatatttttgttgtacttcttgttcttctttgtctcgtagcactacaacccgnngatggggtgttgactgactgcacaattcgcttccatctcgaacggtcgtcgatgatggttgaattaagtagtgattagctccattgctcttanaggcgaccataatatgttatcttcctaatggtcttctntggctgtcggggattcctcccagattaactgggtaatgcagttggtaagggagtctatggacat

SEQ ID NO: 7906 - DNA, 694 bp, Diabrotica virgifera
  misc_feature (2)..(27): n is a, c, g, or t
  misc_feature (33)..(78): n is a, c, g, or t
  misc_feature (147)..(176): n is a, c, g, or t
  misc_feature (188)..(216): n is a, c, g, or t
  misc_feature (218)..(270): n is a, c, g, or t
  misc_feature (273)..(406): n is a, c, g, or t
  misc_feature (409)..(430): n is a, c, g, or t
  misc_feature (435)..(463): n is a, c, g, or t
  misc_feature (470)..(565): n is a, c, g, or t
  misc_feature (602)..(693): n is a, c, g, or t
annnnnnnnnnnnnnnnnnnnnnnnnnatatannnnnnnnnnnnnnnnnnnnnnnnnnnnnnnnnnnnnnnnnnnnnnaaaataatacgcggttttttttttttcccgcggggatgtttgccgcgcgaaaaaaaaacacccccccannnnnnnnnnnnnnnnnnnnnnnnnnnnnnggggtgggttgnnnnnnnnnnnnnnnnnnnnnnnnnnnnngnnnnnnnnnnnnnnnnnnnnnnnnnnnnnnnnnnnnnnnnnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnacacnnnnnnnnnnnnnnnnnnnnnnnnnnnnnggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccccctctccttctttttcttcccccgccaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 7907 - DNA, 938 bp, Diabrotica virgifera
  misc_feature (175)..(208): n is a, c, g, or t
  misc_feature (818)..(818): n is a, c, g, or t
  misc_feature (892)..(892): n is a, c, g, or t
  misc_feature (917)..(935): n is a, c, g, or t
gctgaattaaaaactgaattttatttgtacactgctacaatatgatataaccttacgacatgatgattatgattgacattgtcatgcgcgctgtcaccagctgacatggaacgagcaattatttgccatacacttgtgtattctgcaacataccgccagccttgaaataccctgnnnnnnnnnnnnnnnnnnnnnnnnnnnnnnnnnnctacattacaataaagggtcataattgcccagtatacatcaaaacatagaaatgaacttaaatgtctgttggtaatatgcacacgcgtgagagagctcttgtcacttcaccattgtttgtttttattgtcacaacacgtattctattgtctctgcctcgatgtaccattgaaatacgtcctaacctccactgtagaggtggtaagttgtcttctctaagacacactagctggtctatcttcacttcttggttgctaacagtcctccatttggatcttgactgaagttgagttaaatattctgttgaccatcttgcccaaaaatgttggagcacttgagtcatatgttgaaacgtgttgagatttgaaattcttcgtatgtctggctcaggaaaggttgttaatggtgaaaagattaaaaaatgacctggggtcaaaggttgaaaatctgatgggttagaggataaaggagttaaaggtctggaattaagacatgcttcaatttgtgttgtcaaagttccaaaattatctactgagaatatatgatttcccacaattcttttaagatgaaatttaaatgatttgactgctgcctcccaaattcccccatanatgtggtgatctagcaggaatgaactgccactttattgattctactgtcaaaaaactgttaatttctggtctgnaattctgtactaaatcgtacattgnnnnnnnnnnnnnnnnnnnccc

SEQ ID NO: 7908 - DNA, 474 bp, Diabrotica virgifera
ttcgtccgctaaaatcattaagaaaatgctggcattttcatttcccttgtagatgtcgacaaaagggaacataacagtcgttcaaaggtcttcgaaaaattcatatctctttggaaacattcacttttaaacaagcgatgaaaaagattcatttaattgcttaaatcattgaacaactttaaaaaaatgattaaaaggccaaaaaactagttttgagaccgtttgatcagatcaattaaatgtcttagtgaccccactgacctatctggtgttttatattacagcctggaaacatattcactgtgtgatgtcgagagaaaacctcaaataacgcctggacataaaaaactagggtgtcatcaaatgtcgttcttaaggtgagcgtgtacgtcatcatgtttacagagatcctaatacctttcactatgctgctgctgcgcgaaatatttcttctatggtggaaggacgaccatt

SEQ ID NO: 7909 - DNA, 73 bp, Diabrotica virgifera
  misc_feature (2)..(68): n is a, c, g, or t
gnnnnnnnnnnnnnnnnnnnnnnnnnnnnnnnnnnnnnnnnnnnnnnnnnnnnnnnnnnnnnnnnnnnttttt

SEQ ID NO: 7910 - DNA, 470 bp, Diabrotica virgifera
ccctccacctttgcagacgtcctaagaccaccaggacctccacctatgacacatcctagagcgccaggtcctccacctggcacacgtcctggaccaccgtgggcctccaccaatatgacgtcctacacccctggacctccacgaagtaaacgccctagaccgccaggacctccaccatgcttaccccctaatgcaccaagtcctccaccttttagaaggcctttatcactatggcctccaccaagcttactgctatccaccaccagagccctcctccacttgtacgtcccaaaccaccgggatcgctcccgatcagacgtgctatgccaccagtgcctcctctctccatatctatttaattataccgagaagcctacttcgtaggaccgacattctcttatatagatacttaatttacatttgactaaacagatacaaaaagggaggacggtctataaggatatctgctg

SEQ ID NO: 7911 - DNA, 903 bp, Diabrotica virgifera
  misc_feature (104)..(126): n is a, c, g, or t
  misc_feature (348)..(367): n is a, c, g, or t
  misc_feature (741)..(741): n is a, c, g, or t
  misc_feature (784)..(801): n is a, c, g, or t
  misc_feature (820)..(842): n is a, c, g, or t
cgttctaaagtcttattattattcattgtcaattattaatacgcatacttactattaagacctgattattttaataactattttaaaaagtaatgaatcctaannnnnnnnnnnnnnnnnnnnnnntgtatcgtgttttagatgaagatgtgtttgaaaaatgtgaaattggtaaatttggcaacatcgctcgggaagatctttctgtgtttcgcgtcgatctcacatattgcgtattaagacgcgttatataggtagtgaatcactagcaaaagatacactcatagtgacaccaattttaataacttcacgtcatgcctcgtttgtgagaggagtttacacggcaannnnnnnnnnnnnnnnnnnntatgcagacgttggtggcagaagcatgtcaagttatgtgtggagtgatagcagacaggattttacaaaatttggcaagaaaagagtggagtggattcaacaaaagacatctctaagtttcctgaagattttaaaaattggctaagatgtcggaacaacattttcaatattatatggaacttgttagccccaaaaataaaaaactagtaatatcagagaagctctatcggccaaactgaaattgcaaataacacttcgacatttggcaagtggagactctttaaaagtttagaatatttgaatccattattgtttaaagggggtaagcgccattttctacttttcaagatcttttcaaaaagcaaaggtctgtanaggagtaagtggtcgtgaataaatgaaggagtgtatgtgttcnnnnnnnnnnnnnnnnnnaatatcaaataaagggaannnnnnnnnnnnnnnnnnnnnnntccgtggtaggagattgcacttttgcacgatctcagtagagccacttgatatcttgatttc

SEQ ID NO: 7912 - DNA, 198 bp, Diabrotica virgifera
  misc_feature (159)..(186): n is a, c, g, or t
gcatctttaaaaaaataaaccctcgactaaaaggttctcataatatttgaaaaaatggatatgatggaaatttcaaccttttccccgggttccctcttattccctcttttttgcgcgttttttgtcttccggtttttggtccccccaaaaaactggggnnnnnnnnnnnnnnnnnnnnnnnnnnnngggtggccccca

SEQ ID NO: 7913 - DNA, 744 bp, Diabrotica virgifera
  misc_feature (414)..(432): n is a, c, g, or t
gccagttacatgtgcacactaacgagaagtttttcccgtatttaatgtaatttgccaaaaatatagtgtgtaatagatcttttcgagtgctaaataagacaatatgaagttgaacgaatcgtacccgcgcacgggttgccttgaacttttcgaagttgttgacgtaaacaaaatcgcgtatcttttacgataaacgcatgggtctagaagttgaggctgatgctcttggtgacgaatggaaagtctacttcttgaaaatatctgaaggtaacgtatccgctagatattccacttgatacttggagttcttacaatcggtagagtaacacttttactttcaataggtcactcctgctacagacccagacgtaccagggaatgcaaaaagaaatcagtgaatgagagtcttgaagnnnnnnnnnnnnnnnnnnnggacctagactttgtaggaaaaggtctataaaaaattcccggacttactgactattccatcccaccgcacatgggacacaagagagcgtcactagtccgtttgttcttctaccctaacctctaagacgatgtacaacaatatgtagcatagagagctttggtcctaaaagaaggtagaaagacaagaaccaagtgtcccatattccagcgtattattacaccacgcagttttgcaaataaaacctctatcgacatgctgagaagaacaagaggtgccttaaacgtaaagaacaataggatgcatatgctaaa

SEQ ID NO: 7914 - DNA, 871 bp, Diabrotica virgifera
  misc_feature (308)..(325): n is a, c, g, or t
  misc_feature (345)..(364): n is a, c, g, or t
  misc_feature (386)..(405): n is a, c, g, or t
  misc_feature (763)..(763): n is a, c, g, or t
  misc_feature (791)..(791): n is a, c, g, or t
aatcatttatatgtgaaatcatgtataatataatctgtaacgccaaaacttaaactaagaacaacatattttaaatacaacattgttttggttcagcaaaacaatccacattcaattcattgttctaaataatgtccaaaatgtaaaaagaaagtaggtaagctacagaaataaagggcgtatataatattaatataatgtttttaccagtcacacaagaaaaacagcaaaaaaatcagcattcctcttccaagttaactcttttaacgtaggcaatattaatgtggctcatccggaagaaaagagtnnnnnnnnnnnnnnnnnnccaggaaagacaaaaatggnnnnnnnnnnnnnnnnnnnnctgtaagttgtaaacaactgcnnnnnnnnnnnnnnnnnnnncgaagaatgtggataagtgaatgtttctaattgtgtaagaagcaaaaccaaatgaataatgacactatcgccatcttacgaagttggaagtaaacatatatgtgacacttctcctggtaaaaacataggatttttgagtcaatttaataagataactggaatttgcatttttttagttgtgtcacttttcttctggacgagcgatatggtttccatagaactaataaaactgtttttatgcttctcttgaaagaggaatgagttcatccttttttacaatacatttcgaaaatcaaagttcaaagccatttagctctttgacattaatagtaaataggactgtagaatacatattaanatattttttttattttgactattctctngttaatgttaatgacgaaatagcaacaaaatacgaaagagttacgttagaaaaaagttttatgaagtaaaagtagttttt

SEQ ID NO: 7915 - DNA, 343 bp, Diabrotica virgifera
caaaattgtgactagaagacttaaagaggttggtctgaatccaaaacggcctgccagagttccacttcttctaccacggcataaaactcacaggttgcactttgcaagagcccccgttaactggaacgaacatcaatggggaagaggtcttttcacatatgaaacgaggatacaattatggaagccagatggacgtgatcgagtatacagagggtctggggaacgtttcgtagaatggaatcttgtataaaatgtagctttggtggggggtccacattttattaaatatgctatgggatggcattagttgggagagtcgtatggagcttattgagggggatat

SEQ ID NO: 7916 - DNA, 722 bp, Diabrotica virgifera
cacacgtcgcacctcgctagttaaaccctccatgaatactcccaagatcatctcctctcgaatctcagttcgcgtactcggcttttcctcttctttctcatattcttttacaacatagcgcgccgccgttctacacctatcagcgaatctccgataattttccccctccttccggcggatgttcattagtttcgccatttcgttcactctgtctttcttcattccaaactgctgcaatagcagcccttttatctccttccatgtccatccctctttcttctgactcgtcgcatttcccaaaaattctgccgcctttccaatcatccttcgtctcaccaaatcagctgtgttctgctcagtccacccattaatttgctgcaacatctctactgtctcaagaaactcctctacactcatctctccttcgctaccacaccattctttcacctctctggcacctatcatttccaccctcctactttcggccattctcagttcttccatctccttcctcagatagttcagttcgttttgtgcgaccctctgtctcgcaccttgcaacttgcatacttcctctgtggccttttctaactcttgtttcaatctatctacctcgtcaccatgttccggcatggataattaagaggcaaaacaagaccagagtcttacgaccgtcggtaccgtgccattcgcttggttctcttgacacttacaccccgagt

SEQ ID NO: 7917 - DNA, 929 bp, Diabrotica virgifera
  misc_feature (830)..(830): n is a, c, g, or t
ccttgtggatgggaccgggtggatggataaacggttgcaggttttgcaaggaaattggttacgagtgctcgcggtagtttcggaacataaagtttgaaccgcagcgttttagaagtaggggcggagcagatcgtggcaggggaggttgatcgggagctttccgtcgtattcgcactaagggcgctcggcacggggcgaacagaacagggtcttttcgtggcttggatgcaggtggcttctcaggatggcatcggagcggtgctttcccaagtgcaagagggcgacgagtggcgtcatcggggatgcttctgcagaactctgggaaaagcggagggaagctcggctcgtgtcgccgaaaggggagttattggcagtcgtcggagcagtggaacactaccattcgttcctctatcggcagaggattcttggagggaactcgaccattcggccttgcagtggcttctcaatttcgggacgcctgggggccggataggtcggtggctggagaggctgcagacctgtgattttgaaattcgtcacggagcgggaagaagtcgtgggaatgatttatttaaattgttaaattgttaaatttatattaagatccattactggtctgacttgctaacttacttacacctatgctaaggtgattcgtaacaccaatacagtgttttattcgtattgagtactattcagttcatgtatctgtcatttttggtcttgaaatattgaatgatctcttttgtcgattgtccgctatagtattgttgttgattgatatatttcggcaagtgatgaagagcgatttgcatcattaactggaatanagaattatagatattatttgtacagtaaacacgaacaaatagaaatatctttgacaagtagtgatgtataacttctcgctgtacaagaacgtatccatg

SEQ ID NO: 7918 - DNA, 977 bp, Diabrotica virgifera
  misc_feature (730)..(730): n is a, c, g, or t
  misc_feature (829)..(829): n is a, c, g, or t
  misc_feature (938)..(938): n is a, c, g, or t
tatgaataaaaatagcatttttatatacaataacctggagacgggtcacaggcttcatgtgcaacacttaacaccttcagctccaggccaatatctgatatttgccacatgtgtcacttttatacagtcattggaaaattgttgaattgtaaacacggtagccgtgtccgtgtcggtggcacctgattgataagaggatgaacacgggagccgtgtcggcagacttaaagtgttttgagaaaaagtttgttttaataattaatatttcgtcctattagaggtaaaactcactaactacacttttcagaaagtggagaaaaatcgatttaaaggtacaaattgttttttgaattcacctgacttgaatattggaattttttaaatgcaactttaaagaataaataaaaacagatattttgtgccatatttcgtcacaggaactatgatacaatcaatattagatcaatttttgtacttaatgagtttttccatgaacaaaattattggatattgatatcctatcagaggtaaaactcactaactacactttgtacttgatgagtttttccttgaacacaattattggatattgatatcctatcagaggtaaaactctttaactacactttgtacttgatgagtttttccttgaacaccattattggatattgagaacttaatgaatttgtctccataaaatttcgctgacttacaacaaacgaactatcanaattaacaggcaattatgtcacaggaactatgatataatcatgatacaatcaatgttagatcaatttttgtacttaatgagtttttccatgaacacaantattggatattgatatcctatcagaggtaaaactcgctaactacactttgtattttgatgagtttttccttgaaacacattattgaatattgatatccctatcagaggntaaaactcactaactacactttgtactttgatgagtttt

SEQ ID NO: 7919 - DNA, 889 bp, Diabrotica virgifera
  misc_feature (428)..(448): n is a, c, g, or t
  misc_feature (609)..(609): n is a, c, g, or t
  misc_feature (618)..(618): n is a, c, g, or t
  misc_feature (837)..(855): n is a, c, g, or t
gtgaacagatctgacagttttcgtgcttgctcgtcttcctcgacttctaagtacatgatttcgttccagttttggtggtgaagacaccaatttagccgatcagtcttgtgctgcctggataactcgagaacccataactgtctcctgctgtatacttcttgacacgaactcttcttcttatcgtttcaactgaaacagttacatctgtagcttccaaaagctgcctttggagctgtaggtgagaaatggttgggtgtcttccagctgattggacaattaaaggactttcccttgctttatttttgagctttcctagttcctgttacctagcataggttttggacagaacgccctgtattacgtttagtatttgtttattttcaataaaaacctttattcttcgcaacaataacaagttttttcaaagnnnnnnnnnnnnnnnnnnnnncatggtgattccatgtaagtttaggtatgtgtagactccatcttctttctttcttgtatttctgtgttgggcaatatattatattatctacttctctcatcttttgctaagtgatatgacctgtaaattttcattttagttttactacttctcttcatttntttttttcnggtcttttgttccgacatcatcgaagaactgatttgaagatctgtttccatgtctgaatttatttcattctagtcattcatatatttttattctattatttctatatccaacaatatttattctttgtgagacgcattgtatacaacgcgccaaaaagtggcgcatgaattcagttcttcgtgaaccgacgacttttgaggaagatcccgaacagggcnnnnnnnnnnnnnnnnnnncgattttttgggcgttatatcaggctagtgacgt

SEQ ID NO: 7920 - DNA, 682 bp, Diabrotica virgifera
  misc_feature (20)..(87): n is a, c, g, or t
  misc_feature (89)..(104): n is a, c, g, or t
  misc_feature (129)..(203): n is a, c, g, or t
  misc_feature (213)..(233): n is a, c, g, or t
  misc_feature (238)..(238): n is a, c, g, or t
  misc_feature (248)..(268): n is a, c, g, or t
  misc_feature (291)..(323): n is a, c, g, or t
  misc_feature (326)..(372): n is a, c, g, or t
  misc_feature (399)..(417): n is a, c, g, or t
  misc_feature (438)..(463): n is a, c, g, or t
  misc_feature (476)..(508): n is a, c, g, or t
  misc_feature (512)..(556): n is a, c, g, or t
  misc_feature (561)..(599): n is a, c, g, or t
cgcgccccccgcccctgggnnnnnnnnnnnnnnnnnnnnnnnnnnnnnnnnnnnnnnnnnnnnnnnnnnnnnnnnnnnnnnnnnnnngnnnnnnnnnnnnnnnnttcttttttgggtgtgttgttgttnnnnnnnnnnnnnnnnnnnnnnnnnnnnnnnnnnnnnnnnnnnnnnnnnnnnnnnnnnnnnnnnnnnnnnnnnnngttttggttnnnnnnnnnnnnnnnnnnnnnacaantagtttatcnnnnnnnnnnnnnnnnnnnnncgcatttggcccacccccccacnnnnnnnnnnnnnnnnnnnnnnnnnnnnnnnnnagnnnnnnnnnnnnnnnnnnnnnnnnnnnnnnnnnnnnnnnnnnnnnnngggggaggagagaggggggaggcgcgnnnnnnnnnnnnnnnnnnntttctcaatatataagaagannnnnnnnnnnnnnnnnnnnnnnnnnaatatgtggaatnnnnnnnnnnnnnnnnnnnnnnnnnnnnnnnnntacnnnnnnnnnnnnnnnnnnnnnnnnnnnnnnnnnnnnnnnnnnnnnacacnnnnnnnnnnnnnnnnnnnnnnnnnnnnnnnnnnnnnnngtggcggaaggagtggttggggaaaaataaataaaaaggagggagggagggttttagtgggggagaggggggggggagactac

SEQ ID NO: 7921 - DNA, 398 bp, Diabrotica virgifera
  misc_feature (11)..(47): n is a, c, g, or t
  misc_feature (61)..(168): n is a, c, g, or t
  misc_feature (180)..(260): n is a, c, g, or t
  misc_feature (271)..(362): n is a, c, g, or t
  misc_feature (373)..(390): n is a, c, g, or t
tttttggaatnnnnnnnnnnnnnnnnnnnnnnnnnnnnnnnnnnnnntcccctcccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgggggtnnnnnnnnnnnnnnnnnnnnnnnnnnnnnnnnnnnnnnnnnnnnnnnnnnnnnnnnnnnnnnnnnnnnnnnnnnnnnnnnngggagtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatcggagnnnnnnnnnnnnnnnnnngaagagac

SEQ ID NO: 7922 - DNA, 810 bp, Diabrotica virgifera
  misc_feature (2)..(119): n is a, c, g, or t
  misc_feature (123)..(144): n is a, c, g, or t
  misc_feature (277)..(311): n is a, c, g, or t
  misc_feature (314)..(326): n is a, c, g, or t
  misc_feature (330)..(345): n is a, c, g, or t
  misc_feature (347)..(421): n is a, c, g, or t
  misc_feature (435)..(593): n is a, c, g, or t
  misc_feature (629)..(656): n is a, c, g, or t
  misc_feature (687)..(707): n is a, c, g, or t
  misc_feature (712)..(745): n is a, c, g, or t
  misc_feature (747)..(802): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaannnnnnnnnnnnnnnnnnnnnntttaataaaagaaatccggaacaatttttttcccccgtttatttaaaaacatgttcttttgatttaaaatataaattccgccctgccccctgataaaatttaaagggcccggggatatatacccgggtttaannnnnnnnnnnnnnnnnnnnnnnnnnnnnnnnnnnctnnnnnnnnnnnnnggtnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnncccaaaaagcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaacacccacacttttttttttagtttgtaannnnnnnnnnnnnnnnnnnnnnnnnnnnggggtttgagtttttaattttgtttgggggnnnnnnnnnnnnnnnnnnnnnccccnnnnnnnnnnnnnnnnnnnnnnnnnnnnnnnnnngnnnnnnnnnnnnnnnnnnnnnnnnnnnnnnnnnnnnnnnnnnnnnnnnnnnnnnnngccgcccc

SEQ ID NO: 7923 - DNA, 803 bp, Diabrotica virgifera
  misc_feature (15)..(89): n is a, c, g, or t
  misc_feature (108)..(135): n is a, c, g, or t
  misc_feature (143)..(190): n is a, c, g, or t
  misc_feature (203)..(418): n is a, c, g, or t
  misc_feature (440)..(498): n is a, c, g, or t
  misc_feature (509)..(570): n is a, c, g, or t
  misc_feature (575)..(732): n is a, c, g, or t
  misc_feature (746)..(780): n is a, c, g, or t
aaaaaactttctccnnnnnnnnnnnnnnnnnnnnnnnnnnnnnnnnnnnnnnnnnnnnnnnnnnnnnnnnnnnnnnnnnnnnnnnnnnngggggtggtggccgccccnnnnnnnnnnnnnnnnnnnnnnnnnnnnctcctccnnnnnnnnnnnnnnnnnnnnnnnnnnnnnnnnnnnnnnnnnnnnnnnngttgggtcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccctcttttcttttgtnnnnnnnnnnnnnnnnnnnnnnnnnnnnnnnnnnnnnnnnnnnnnnnnnnnnnnnnnnnttccccccccnnnnnnnnnnnnnnnnnnnnnnnnnnnnnnnnnnnnnnnnnnnnnnnnnnnnnnnnnnnnnntgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatggctgcctnnnnnnnnnnnnnnnnnnnnnnnnnnnnnnnnnnntttcgggggggggcccggggggg

SEQ ID NO: 7924 - DNA, 901 bp, Diabrotica virgifera
gttaggttaatacaaaatatgtgttgatgttatagagttgtatattaaataatttcataataatataacatggcaatatcaagtagtataaaaaagaaaagagtatctaagaaactaaagagttcatggagaaaacatgtaaatataaatgaagtagaagaatttctggaagagcaaagattagaagaaagattagggccttctttggagttggttcctgatagtgaactatttaaagttgattccaagccttcaacagaattattatcatctagggaaagaagaaaattaaaagccgctaagcctttaaaatgtttttctgcattacagcctcacacaaatgttccagatcccatatccagaagaaatcgtgtgagaactaaagaagaaagaaagagtaggctggtaacattaaaagaacaacgaaatgaagctaaaggaattgtaaaacgtaaatcacttcaagctgctgaaaataggaagttagacgacttgaagagaaaaagtaaaccgaaacgtggagatgtttcctctgatttgtggcaagatagtgataaacaggcaattattgaagagtgggtcgataaaaacgctaaaaagcataacttgagaggtgtaggtgtagctgtaaaaaagacgaggtctagtaaattggctacgaatattccagcaattgagcccccacatcctggtatgtcatacaatcctagctatgctgatcaccaagatttattacaaaaggtagcagaaaaagaacaaaaacttatcaaggaagagaaccatttacgcagagttaccagtggaatgttcagcaaagtaacagagtctaaacgtgatgaagattggttaatatccatgtcagaaggtctaccaagtaagagtaacattgtatctgataatg

SEQ ID NO: 7925 - DNA, 671 bp, Diabrotica virgifera
  misc_feature (194)..(215): n is a, c, g, or t
atttcatatagattaattttttgttgaccataaagaaagtatgtaggtacagctcccggaacgaaccatggtcgatgacaaacgctgtagtcggtcgtacactcacctaaactttacgcagacataatttctctcaccggccatagttcggtccgggagctagtaaggataaaaaattgtctttagtttaggtnnnnnnnnnnnnnnnnnnnnnntggtattaacacaaagtgtaaataatgcattttatatacgaagttaaaaaaagtacttgaagtgttaaaagaagtttagttttttcaagttggtatatacagggtgtttcattgatagttgtccatattgtggctggaggggccttggcataaaatgcgaagatttaacctggaacacttagatgaaatgtggttccttattgagttgcagggtgttttatctgaaagtttaaagactgtttttgctcagagttttcaaactgttcgacgtgtcctttttatacttggcaggaagtgtaggtgctgtacagactactaaattgtgttcaacaaacgtttctggctgttaaccagaggcgtacgacgtgggagggtgaatgattgaccctttctagattctgcgccactggcgaaattgctgtattagattagtttttggactctccaatgctttct

SEQ ID NO: 7926 - DNA, 218 bp, Diabrotica virgifera
  misc_feature (25)..(65): n is a, c, g, or t
aaccccttttttaagggggcatggnnnnnnnnnnnnnnnnnnnnnnnnnnnnnnnnnnnnnnnnntgggggttgttttgagaaggaaacaaatacggaccgggggaaaataaggtgagcgttatggtgaggatagatgagggggtaaaggcgatccaggtagattaaattctcgaccagaagagaaggacggaaagaggctgttagaaaagagggggg

SEQ ID NO: 7927 - DNA, 852 bp, Diabrotica virgifera
  misc_feature (376)..(393): n is a, c, g, or t
ttaaattagtcacctttaaatatcagatctgtactgtaatgagcatgagtatttttgagcttgattcgagatacctacaatcactatttacaactcctcctttggattgttcatatatttcaacaagaaagtttttatatcatcagcagtccttttcccgttataatcagcaacaaattttccgtttttaaacaattttaacgtcgggaacccggatatgtggtattcttcggcgattgatggattttcggcacaatcgatcatcgcaaggcaagacttatgtccttcgtcgctaagttgatgggctgctacgctatactccggtttcatcttcttgcagtatccacaccagggagcgtagaacatcactagaacnnnnnnnnnnnnnnnnnnattctggaatgttttgtctgttaatttcactacggcaggatccattatccattcggcaggttcagcaggaggaggagcaggaacatttactactttgtcgggttctctcatgaagtctataaaatctggagccgttcttccacctttatagtctttcatctccttcttgtagtaactgaagtatttaaacgtgggataacctgtcacgtcgtttgcactacagactgatgggtatacagtacaatcaacagcagtaaattcgactctgggatcatccttgaactctgtagcggcttgagtatatttccggtttggcttttttacaatgtccacaccagggagcataaaacatgaccaaggaatgtttcttcttttttaggaatggtttaaatgtctcttcggtcaatgaactacctcactttcttatcagcccacgtttttctggaggggggggggggg

SEQ ID NO: 7928 - DNA, 1003 bp, Diabrotica virgifera
  misc_feature (174)..(189): n is a, c, g, or t
  misc_feature (934)..(958): n is a, c, g, or t
tggcataaaagttgagccagtgtcacggtaaatataactaaattaaaatggccaaagggaaaggaaaaaagggcaaaaaagctaagaaaccagtggagattgatccgaatgctttaacagaagtcgacaaaacattttacgaactaactattactgatttaaatcgaaaattgnnnnnnnnnnnnnnnnaaaaccaagaactagaacagaaaaatgaagaactggtacaagaaaaagaaaaactggacgaagataggaacgatatcatcatgtatcttaaaagaactctgcaagaaaaaacaagtgaaatagctgaattggaggaacgaataactgccatgaaacaggagcaagaagatacaacccaaatgtacgaggaaaaaattgtcgaaatgacgaatgaatataacacaatgcatgatcagttaacttctgaaaataaactgttagaaggaaaattaaattcactggaggaattccgatctcaacgcgacgaactgatgaaaaaattcgaaacccaagaaaacgacatggaagcgcaagagaaacgtcacaagagggaaatgtacgaaatagaaagaaaattcataattgccaaagatcgcttgaagaaagatatggaagccaaactccgtcagctctccacagaattccacgatgctacagagctaagaatagctgctacaacacaccgagtaattcgagagaatattgctgtgaataatgaactggatgtcctcttgaacaaccagcagaaactgtttaatgaaaacgggaagctcaaagataaagattccaatttgcatcggaaagttgagctgcttgaggcagaaaagacaaaagctttggctaaagtgagagtacaggaaaattgaataaaaagatatcagatgaacatgaggtttttaataagccaccggaaccactacaaggnnnnnnnnnnnnnnnnnnnnnnnnngttgtaggaaacctaagaattcccagaaaaattaacaatgtttcc

SEQ ID NO: 7929 - DNA, 947 bp, Diabrotica virgifera
  misc_feature (877)..(877): n is a, c, g, or t
agaacacgcagatcaacattctttgatcgacattcctaatggcttcataatcccaggaggacggtttaaagaaatctattattgggatagttactggatagtagaaggattactagtcagtgaaatgactgaaacagttagaggagttttagagaatttcttatcaattgtggagagatttggctttattccaaatggagctagagtatactatctaaatagatcacaaccaccattactagccatgatgatgggaaagtatatagatcaaacaggaaacaaaacatggttggaaaaacacgtagatactctcgagaaagaaatgaattggtggtggagtgaacgaaaagtaacagtaaagaaagatggagcgaactatgatatgttcatgtatgctgtcaaaagcgacacacccagaccggaatcctactatgaagatattattacgtgccaaaattttacagaatcggaacagaaagcctgttacagaaacttaaaaagcggtgcagaaagtggttgggacttctcttctcgttggttatacaatgacgacagaaaccccagtacaaacctctctcaaatagacatcattgatgtcataccagtagatctaaacgctatcctctgcagagcctttgaagaactctctaggttttatcaacttgtaggtaataacgaaaaggcagaagcatggtcccataagcacttaaatttaagatcagcaattcaagcagtcaattacaatgatgaggacggtatttggtatgactttgatgtgaagcattccagtcatagaaaaggagttttatcccagcaactttgctcctctttgggctgatgcttacgatactaccaagaaggaaacattcggcattanggctgctactccctataaaaaagatgaaagtaatacttacgctggtgggataccgtcatctttactccaa

SEQ ID NO: 7930 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggttnnnnnnnnnnnnnnnnnnnnnnnnnnnnnnnngaaagga

SEQ ID NO: 7931 - DNA, 943 bp, Diabrotica virgifera
  misc_feature (834)..(834): n is a, c, g, or t
  misc_feature (847)..(847): n is a, c, g, or t
atattcttggccaatgcacaagcttagaatcgaaagtgttctaaaccaatatgctaaaaagtgagatttccagtgtatgtttacgtgatgtgatattttagagaatccagtgagtctctaatattagaaggtgtctaaattggaggtgagaataacacgcatattattaacgagctctacaagtcaaccggtaccaaatggtgtgaactgtatggataatgtgcatctgtttgtacaaacataaatctgccatgtgattctgtgttgtgtaaattatgtggaactttattagtgcccttggatcatgtctgcaccttggccagttaaagaaggagcgctgaagaataaaattatggatagtgatcaggaaaaacaggttaaaactcggatgcatttgccgtcaaaattgaacctgcagttgatcgatgatgaagctagatctctcaaagctggagatctcagccaacaggagtccaaaaacctggctcaaacgaatatgaaagttacaacagacaagttcagtagtgaaagaacagccatggaatcccagcaacaaagacagactgttacagctagcggcttttacaatcaagaaaaacacagttctagcacaagtcacatatacacctcttcttcttcaaaaggtcttagcacatcggcaaagatcaatgcaacaagacagtttcacttattaaatggcacacccgaagaagcaatattaaacacgtcattagaagatctcgacagtctctcagccacttccgatgtccacgatatcgaaagagcaaaacacaaatattctacatatttagacgaatccattagatgccttcnaaaactagaccanaacaaagatgcacccctagtgttagataaaatcaatgacgtcatgcgtaaagcatgggcagtaccgacctatggtcacgaacttggctatgctcta

SEQ ID NO: 7932 - DNA, 107 bp, Diabrotica virgifera
  misc_feature (57)..(57): n is a, c, g, or t
atgatgatgaaattgaaaatattattttattgcagtcgaaatacgatttttatatantcacgaagtatatttttataagtacccaaatatgaaatataggatatatt

SEQ ID NO: 7933 - DNA, 476 bp, Diabrotica virgifera
  misc_feature (430)..(447): n is a, c, g, or t
  misc_feature (463)..(463): n is a, c, g, or t
catgtggttctcagtagtgttggtaattgttgttatagctttttatctgttttcattgactataaaaccaaaaaattatcctcctggtcctagttggtatcctattgtaggaactgtgctagaagtaaaaaacctgtcaaaaaaatttaaagggcaacatctagcccagcaatatctgtccagaaaatataaatctgacgtcattggtcttcgaaacggcaaggaaaatgtcgttgtggtattcaatcaagctgctgttaaagctatatttaagagagaagaatttctagctcgaccccagaacttctttttatatttacgaaatatggggttaataagaggaataacgattgtaagtggcagactttggcaaatacagagaagatttgtagtatctcatcttaaatatttaggtttgggtaaaagatcnnnnnnnnnnnnnnnnnnagacgaaagtaccganattttaaacttat

SEQ ID NO: 7934 - DNA, 951 bp, Diabrotica virgifera
  misc_feature (803)..(803): n is a, c, g, or t
  misc_feature (817)..(817): n is a, c, g, or t
  misc_feature (847)..(847): n is a, c, g, or t
  misc_feature (929)..(948): n is a, c, g, or t
ctttgtaaaagtgaacaaaacattgttttataatgtgtttaagttaattagttatcatatgattaaaataaagtgattttatattattgccgtatcttgtggatattttaaactactatgtcgtcatcatctaaatctgaaaacgacccagatgaaagttatacacgcccaagaagggctaaaactaaaatgaaatgcgttgtagaagactgccctacgataggatgtccaccaaatagtactcattgtttgacaagagaacgttacattccttggatgaaagcaataaaacaatcaccagaaaatgttaaaacaccaaattatgacagctatatttgccagaaacattttgctctttctcaacgtgttggacccaatttgaaaccaaatgcaattcctacattaaatttacccacttccagcaattccaaagtgtgcaccaaagaagaaatagagcaagaattttttcttgtaaaagctataatcaccgttgaaaagaatgtgcctgccgatgaagtaccatttatgaatcattattattccaagttaatactattcaatgacttaatacctacgaaaaaagaacttgcctggaggctaaatcttctcggggtcaaatacaaggaagatgaagaagttgaggttaaagactcggtggtggatgttttctcaaaacaatcagaaccggtctttattcaaacgcccacttaccttgagacaacattgatcgaagaagtggatgatgaatttgttgaagacgtaccatcatttatatcaccaagtaatcttttagaacttatganagaagaagaagtanaacccagtcctaatgaaaacagaatggaanattatgacgataatcctgatgattcccggatgagggtgagaattgaatagagatccctgactatgaatgtagttaacgaccnnnnnnnnnnnnnnnnnnnnatc

SEQ ID NO: 7935 - DNA, 579 bp, Diabrotica virgifera
  misc_feature (357)..(378): n is a, c, g, or t
  misc_feature (438)..(457): n is a, c, g, or t
cgtcatctttttagatgttttgtcgtttgtgtcaaatgtatacattgacaaatttttcaacaatacggtggagctctgattagctctatttggtatatcgccagtttaaatgaagtgtctctaaattacatttaagtacagagggatttgtgttctgtttgattaatacggtaaacaaacatttgccttcataacgtagaacgtaacttcatagtatttataactccatactacctctgttttttcgtctcgagaacgatagatctgaatttagatggggattgcattataattctagaattctatttttaataaaacagtttttggtgcaaacctagtattttgaaaattgttgcnnnnnnnnnnnnnnnnnnnnnngacggtctgtttcctgtatttaaccctgcaacgtgcaatgtttgtagtgtgaggcacttnnnnnnnnnnnnnnnnnnnngatgatattgaaagagatattggagttgggaatacataaaaacataaatacctctattttttgtatccttaatatatttctctaatatgtacattattttaataaatgtggttatccaagcc

SEQ ID NO: 7936 - DNA, 51 bp, Diabrotica virgifera
tgagaggaacgagaagagaagggttttttggcaaagttttgatgagtgagg

SEQ ID NO: 7937 - DNA, 666 bp, Diabrotica virgifera
  misc_feature (5)..(69): n is a, c, g, or t
  misc_feature (73)..(140): n is a, c, g, or t
  misc_feature (144)..(180): n is a, c, g, or t
  misc_feature (249)..(278): n is a, c, g, or t
  misc_feature (283)..(305): n is a, c, g, or t
  misc_feature (324)..(346): n is a, c, g, or t
  misc_feature (349)..(361): n is a, c, g, or t
  misc_feature (379)..(432): n is a, c, g, or t
  misc_feature (437)..(454): n is a, c, g, or t
  misc_feature (546)..(565): n is a, c, g, or t
ggggnnnnnnnnnnnnnnnnnnnnnnnnnnnnnnnnnnnnnnnnnnnnnnnnnnnnnnnnnnnnnnnnncctnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnngggggaccccaaaaagggaacattggggaattggtacctttaaaaaacctttttagggttatttggttnnnnnnnnnnnnnnnnnnnnnnnnnnnnnnggggnnnnnnnnnnnnnnnnnnnnnnnggaaacaaaaattccattnnnnnnnnnnnnnnnnnnnnnnnggnnnnnnnnnnnnngtttggaaaccaaccccnnnnnnnnnnnnnnnnnnnnnnnnnnnnnnnnnnnnnnnnnnnnnnnnnnnnnnggggnnnnnnnnnnnnnnnnnnggttaaaaagggtaaaaaaaaaaccggtggggattaaggggtcccctaaaaagggtttgaaacccgggaaacagggaaaaaatttttcaatnnnnnnnnnnnnnnnnnnnncccctttggggggaaaatctggatccaaaaataaaggcttgggatggacattggaaaaatttttcattctaccccatggcctaaaaattaggggagccccc

SEQ ID NO: 7938 - DNA, 91 bp, Diabrotica virgifera
actcctatagggagaggtgggcgccgcggggtgcggcgggcgggtacccggggggcccccttcggcggccgggaccagccgagcgggacca

SEQ ID NO: 7939 - DNA, 900 bp, Diabrotica virgifera
  misc_feature (6)..(6): n is a, c, g, or t
  misc_feature (385)..(403): n is a, c, g, or t
ccgctncacctggtcgacaaataactgttataagtgtcgagcagaactatttgttatgtgtctttctgtttttaaagttttgttgactgttatttttattgctaatttagtattgtttcagttgaagtatgtgttaaagagtgaaaccatatattttctttgtttttaaagacattagggaaattcaaaaaacaaaatgttttcacaagacataaaacttacaacagaattttgatgtatatttacccttgtgccttgtctctcatacagggtgtctcaaatttaacataaggaaaacatgtcttttcttccatctttttcataagcccaaaaaaaagtttgagataacatttgcccaacggtgtagataccaaagagaaatccnnnnnnnnnnnnnnnnnnngcggaatccgttagtcgattcatgaaaaaatcaatgaaaatgagcataattcttggtaggtcaaaacgtctgcggttaagtttattatcgtcttgtgtatttaaagtacaatgttaaaattacgtaccaaagactagaataagaagacccatttgaagtatatattttgccaaaatctatcaaagctttcggttcgtatgataaattttagatagcttgccttcagccttcttcatcttcaacaaaattttgtttaatgagttctggacatcacctaaaagtagattcctttagaaaaataatatgtaaacacaatatctgtaaagaaatccaaaaccattctaagaaaattgctgaggccaatcaaaaacagtattgggctaagaacggtatgcagtaaggggacctaagaaatgaatgtcgcttatcctataaccactcacttttatgtttgggttaaaatgttacttttaaagacggaaaatcctgatgataaa

SEQ ID NO: 7940 - DNA, 561 bp, Diabrotica virgifera
  misc_feature (4)..(173): n is a, c, g, or t
  misc_feature (177)..(192): n is a, c, g, or t
  misc_feature (194)..(288): n is a, c, g, or t
  misc_feature (292)..(337): n is a, c, g, or t
  misc_feature (350)..(435): n is a, c, g, or t
  misc_feature (448)..(540): n is a, c, g, or t
ggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccannnnnnnnnnnnnnnnnnnnnnnnnnnnnnnnnnnnnnnnnnnnnnttcctcccccccnnnnnnnnnnnnnnnnnnnnnnnnnnnnnnnnnnnnnnnnnnnnnnnnnnnnnnnnnnnnnnnnnnnnnnnnnnnnnnnnnnnnnnacgagtcccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaacgacaacacgcccca

SEQ ID NO: 7941 - DNA, 98 bp, Diabrotica virgifera
  misc_feature (44)..(69): n is a, c, g, or t
  misc_feature (71)..(97): n is a, c, g, or t
gtattgctaagttttatgcactttgactgtggtaatcccagttnnnnnnnnnnnnnnnnnnnnnnnnnngnnnnnnnnnnnnnnnnnnnnnnnnnnna

SEQ ID NO: 7942 - DNA, 495 bp, Diabrotica virgifera
  misc_feature (12)..(35): n is a, c, g, or t
  misc_feature (69)..(127): n is a, c, g, or t
  misc_feature (135)..(302): n is a, c, g, or t
  misc_feature (323)..(406): n is a, c, g, or t
  misc_feature (414)..(487): n is a, c, g, or t
aagataaaaaannnnnnnnnnnnnnnnnnnnnnnntcctcctttttgtggggggcaggggggggtgttnnnnnnnnnnnnnnnnnnnnnnnnnnnnnnnnnnnnnnnnnnnnnnnnnnnnnnnnnnnttggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggggagaagggaaaggannnnnnnnnnnnnnnnnnnnnnnnnnnnnnnnnnnnnnnnnnnnnnnnnnnnnnnnnnnnnnnnnnnnnnnnnnnnnnnnnnnnaatacgannnnnnnnnnnnnnnnnnnnnnnnnnnnnnnnnnnnnnnnnnnnnnnnnnnnnnnnnnnnnnnnnnnnnnnnnntttttttt

SEQ ID NO: 7943 - DNA, 617 bp, Diabrotica virgifera
  misc_feature (4)..(33): n is a, c, g, or t
  misc_feature (54)..(145): n is a, c, g, or t
  misc_feature (151)..(179): n is a, c, g, or t
  misc_feature (182)..(222): n is a, c, g, or t
  misc_feature (225)..(238): n is a, c, g, or t
  misc_feature (249)..(426): n is a, c, g, or t
  misc_feature (443)..(462): n is a, c, g, or t
  misc_feature (465)..(496): n is a, c, g, or t
  misc_feature (522)..(612): n is a, c, g, or t
cccnnnnnnnnnnnnnnnnnnnnnnnnnnnnnncttcacaaaaagaaaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtnnnnnnnnnnnnnnnnnnnnnnnnnnnnnggnnnnnnnnnnnnnnnnnnnnnnnnnnnnnnnnnnnnnnnnngcnnnnnnnnnnnnnntgtgtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaccaaccacaannnnnnnnnnnnnnnnnnnnaannnnnnnnnnnnnnnnnnnnnnnnnnnnnnnnggaaaaaaacaaaccccgcccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggt

SEQ ID NO: 7944 - DNA, 59 bp, Diabrotica virgifera
aggatgttggtcgggtccttcagggtgatcaggttgtgcttggccagcagcaacagcgc

SEQ ID NO: 7945 - DNA, 214 bp, Diabrotica virgifera
  misc_feature (168)..(202): n is a, c, g, or t
taacagcgtaattttaattgaagagttcaaatcgataataaagattgcgaacctcgatgtttgaataaaaagtttattaattggtgtagcagctttattatttaagtctggtccacttttaaaattttaaatgatccgaagtttaaccggggtgagcccagggtgggnnnnnnnnnnnnnnnnnnnnnnnnnnnnnnnnnnnccaaagggaccc

SEQ ID NO: 7946 - DNA, 1012 bp, Diabrotica virgifera
  misc_feature (731)..(731): n is a, c, g, or t
  misc_feature (787)..(787): n is a, c, g, or t
  misc_feature (819)..(819): n is a, c, g, or t
  misc_feature (887)..(887): n is a, c, g, or t
  misc_feature (913)..(913): n is a, c, g, or t
  misc_feature (921)..(921): n is a, c, g, or t
  misc_feature (923)..(924): n is a, c, g, or t
cttagatgaatgtaatcacatcttttcaaaaatctcacgacatatttagtgcgagatgtttgaaaagatgtgattgatctgttcattacttagatgaatgtaatcacgaatttcgaggactcagaaagaatgaaaaatcaaaatttaagactaaaataaaaagaaaactgcatctcattaccataatctccaatgattttgacaatcatttaattatttcttcgtctgtcagtttcgcactttatgtaaatcatgactttattgtcatcacaaccaaaatgactatttataggacattaattagacctgtagtaacctatggcacagacaaactccaagaacagccaagaaaactctttcaaaactgcttaaatggtgccgaatttccaaaagaatggaaattatctatcatgtcaaccatccacaaaaagggcagcaaggatcaatgtgaaaattacagaggaattgcggtaaacagcacaataagtagaatgtatgggacacttattaagaacaaaatagaaaatgactagagattacgaagcagaggagcaagctggctttagagctgggcggtccacagtcgaccacctgtactctattacgtatgtgattgagaaaaaaacagccgtcaataaagaagttcacctggtatacgtagacttacaaaaagcatatgacagtgtgcccctcagcaaactatggtcaatcctacatcaaaccaacattanacatggtctggtcaaagcagtccaaagtctgtataatggaacgactgcaaaaatanaactggatgtcctggggggattttagatcacngaaggatgaatctcaaagtttgttgtatttcgcctaccctttttaaaatttatctggaaacagcactncatctgtgaaaaagaaaatgtaaggncatggaantnncctctcatgacgacacacactttacactatatggttcgctgatgaccaaatctgattgctcaggatctgaacgacttgagttacatga

SEQ ID NO: 7947 - DNA, 404 bp, Diabrotica virgifera
  misc_feature (274)..(349): n is a, c, g, or t
agtgttattttaattaattcgtggattttactacacaatattaactttaagaacattttaacattcttgatcttggaggttggtcaagtaggacttctttttctgggcaacacggaccttgcgtccatcccaatgcaagcttcctacggttccatctatttgtatgtgatgtttactcccctgaattgcccaaatatggaatcaaccctggtcttaccaactatgctgctgcctatgtcactggattacttttggccagagtcatcctcaaaannnnnnnnnnnnnnnnnnnnnnnnnnnnnnnnnnnnnnnnnnnnnnnnnnnnnnnnnnnnnnnnnnnnnnnnnnnntttgcccaagagctttctcgcgatacttggaccccatgggtattcaacacttgag

SEQ ID NO: 7948 - DNA, 456 bp, Diabrotica virgifera
cgggccgggattccccgggggacccaccgcgccggctagcccagcgatgatgttctaatgggcagactctgctcatgttttcgctgcaccgggagaataatatagacatatttagtagagggctatgccgggtacgagagcagttagcgtgtagttcattcatgtgcgtcttgctggcccgaggagaactaaagagtatctgaataatcgtggatcgatttgccttcatggattgtggtcctgaaccagaatatcgagtcagatcccggcggcatttatgatctcacgatgatccttcccgacgttaatggtgacaagaatcaatgagcgtctggccagaaagccccaattaggtacagacacaagggaatagggaggagggtgtgccaatcgttacgggaatttacgatgtacccaactatgatgctcccgaataggctgtaaatcgagatctac

SEQ ID NO: 7949 - DNA, 892 bp, Diabrotica virgifera
  misc_feature (401)..(422): n is a, c, g, or t
acctgatgatcctggcctcgtttttatcgtcttagattgccccaccgtagactatttagattcgttagaaaacagtcaaattatcacaaatcatcaaaaatacaacaaagacgagactcaaatcgctagtttaattgtacactttacaccgaaggatgtagttgagaatcccaggtataaagcttggatggagcattttcctgccagtaccacacacttaatgttgaacgaatataatacatgtatgggaagcgaggccgttcataggattcagtacaagctgaatttgttatcgaatgatattttcccgttgttgggagaaaaggggactttgctaccaaaaggagaagtcgagggcgaaagtgaccggaaaaaacaaaaaatggaagatctcgtcgagnnnnnnnnnnnnnnnnnnnnnncggccaaattgtcagagagtccttctttgtacatcactccagatacgttttgtgcctatcatttgagacccaaaagaggtttggacaggagtttggaactacgactcaaccctacagaatatttagaagaaacttacaatgttgccgattttaaaaccgttttagaaaccctcaaatccaatttgaattccaaaacggtgtctagagatgaatttccgaagattatatttttgggaaccggctcttgtataccgaacaaaacgagaaacactagtggtatattactagcccttaatgagaaccagaacattataatggactgcggtgaaggaacctatggccaactaatccgtttcttcggaccagaactatcttcgcaagtcctagccaatatcgatgccatttacgtttcacatttgcacgccgatcatcacataggacttataggattgctacaagggcgaaaaaga

SEQ ID NO: 7950 - DNA, 942 bp, Diabrotica virgifera
cgttcaataaaataccttttagtagtattttagaatttggttgcttctttagtttattaaataattcattatcgggtagaagtaaaaatggcttcagtgaaagaaattggaggctacaaattaggtaacctaatcatcgaaggaaaaacaaaacaggttttcgatgtaccctctgtgcctggacattgtattttgttaagcaaagacaggatcactgctggagatggtgtgaaggctcatgatttggctggaaaatctgttatctcaaataaaaccaatggaaaagttttcgaaatcttgaggaaagttggtatgaaaactgcctatgtaaaatcagtatctgacaatgccttcctttccaaaaaatgtgaaatgattcccatcgaatgggttactagacgtctggctacaggatcattcttacgcagacatccaggtgttaaggaaggattccgctttactccagtcaaacatgaaactttcttcaaggatgatgctaaccacgacccccaatggtctgaagaacaaatcatatctgctgagttcaaggtcaatggtgttgtgattggaaaacacgaagtagacttaatgactaagacatcaatcatagtattcgagattcttgaaaaagtgtgggcaacaagaaattgtgcacttatagacatgaagatcgaatttggagtcgatgatcaaggaaacttactagtagctgacgttatagactctgattcctggcgtctttggccttctggagacaaacgtcttatggtagacaaacaggtctacagaaacctaacaacagtaacagacaaggatctcgacacagtaaaaaggaacttcgaatggatcgctgatcagttggaccatctaatccctcccataaccatcttgtggtcatatcatgggcagcctgcagataagatattgcacaaaatcagcaca

SEQ ID NO: 7951 - DNA, 1074 bp, Diabrotica virgifera
  misc_feature (1037)..(1056): n is a, c, g, or t
acataatatcacttggcaagtttacatgaagtgtgtaggtgtgtgattacgtttaattcatttaacaagactactgttggatatactggaagtgtagataatatttagcttatacatttcaatgcttaaaatatggtacctcaaagatacctcgtatcaatactcgccttttttggttttatgaatatctatgccttacgttcaaacttgagtattgctatagttgatatgacacaactgaagaatgtttctttgaaaaacgggactaatgtattcgaacgagaatttgagtggaattcgacattgcaaggttacgttcttagttcatttttttatggatacatctttacacaaatcgctggaggatttttggccgcgaaacttggaggcgctagaatttttggactgggaattgtctctacttccttattaaccttggttactccgtggattgcaaaaaccagtgtttactttctaattgcaatcaggattttagaaggggctcttgagggtgtcacatatcctgctatgcaggaattatggtcgcattgggcccctccgtcggaaaaaagtcgtttagttagcattgcgggatcaggcagctattttggagctgtagtggcaatgcctatttgctcactcttagcgacgtctttcggttgggagagtattttctacacatttggtgtaattggattcatttggtacgcgatatggctactagtagtcgcagatactccatcaagcgacagatacataaaagaaaaagaagtaaagtacataaacgacgccgtcagttccatcaagagcgatgaaaaaatcacccccccttggtgtactatttttaaatcacgtgcagtattggcaagtaccgtttgtttaagtgggaaacctgggaatttatacgctactaacatttttgcctcaaatgatgaaatcccttttaggatttgatctaaacccagttgggttccttctcacaattgccttatttatccatgcctattatggtaaaaagtgggggggtttctttaccnnnnnnnnnnnnnnnnnnnnataccttaactaccaact

SEQ ID NO: 7952 - DNA, 457 bp, Diabrotica virgifera
  misc_feature (102)..(121): n is a, c, g, or t
gaaagacgccagaccgagcaggaaaagaacgaagaactccccgccaggagagcaccaaagagaaagcagaaaacagaacaagaaaaaaaacgaggagaaagnnnnnnnnnnnnnnnnnnnnggacgcacaagaggaaccaaggaaacggacgagagaaagagacagaagacgcccccaacgacgacccaacagacaaggcacagaggcgcagagccgcacgggaaagacagggaaaacccggagggggcccaaagaaggcgacaagaagaacatccgccgagcgccaacaggggacagagcgaagaggcccgcgcagagcgccccgcccgacagaggggcagccagaaagaggaaggggaggcgcccagcagcggcacaacaagcgcggggagcgggagggcgacgcgaagagagaccgcaacaccggccaacgcccaaggggccgcgcgggacgcg

SEQ ID NO: 7953 - DNA, 602 bp, Diabrotica virgifera
atcgatgagattttatattagttattgcattgttgacatcggttggaaaacatcaccacgatacagaagacagcaggatatgtatttgcctaaaacagtaaattcggttagaaaagttgtttaagcagttatacacaaaacgatttaggttcaggttagggatggcggtttttgacaaaacaccgattttcggttataccggttttttttttgcttacggtttaacctggcggttataacccgccaaaaaaaacaggtttttggaaaaaccggttttcgatttttgaagttatacttctttacgcgcgatatgagggtgaatttttatatgttaaaacctacgatcccggcgcatgcgcattataactttgttctgattggatgttcaaatgacatgtcaaaaattatccaatatggcagctgtagcgctgctgtggattggacggctgacaggttggttgtgtatgagtgtggcatagttattcccgtgagatgtgatatgacaggcagcccttcgttattgtgaagcctctattatcattagtatttgctatacacgtcgtagtgttacaggactcgcatgattgatccctgcgttattg

SEQ ID NO: 7954 - DNA, 339 bp, Diabrotica virgifera
  misc_feature (80)..(95): n is a, c, g, or t
gggtgtaagaaaaaatgaaataatttggaaagttcccaagaataagaaaaagagggacctttcgggaaaaatgcaaaaannnnnnnnnnnnnnnntgtattcccccctttggggcacaaaaaattgctaccgcccccccaaaaaacctctgggtgttgttttagtatttaggggggctttccaaatatctagcacatatgtcggggtaggagaaacattcactggaaataatttacagccattacaaatgtcttttgtccctgagtcggttgaacagaaccgcacggcgtcgttttttactaaaaaaatgaatgaacaccggataggataaatattttt

SEQ ID NO: 7955 - DNA, 829 bp, Diabrotica virgifera
  misc_feature (21)..(50): n is a, c, g, or t
tgacaatattacagtacaacnnnnnnnnnnnnnnnnnnnnnnnnnnnnnngaaatttgttggaacaaaaataaaacaaattacaaattctattgatgataattggtataacttgtttttatttcttattgagaatctgatgttacatttcattcagtatataacagatcttatacatttcttggcatttattcttcttcctcttcctcatcatcttcctcttcttcgtcaacctctacttcctcctcttcctcttcctcttctggttcgggttcgatcactggttctttaagatcttcatcatcatcagcagcttgtttaccttcttcctcaccttctggagtttctgggtcaccagatttcttgcctggtctttcaccgaaccattttggaagtcttgttttttgcctggagtcgaattgtccaaatttctctttccaagatttttcgttgagatctttaacgatattttcaaatcctccttcaaagagatgtttcttatcactgtacgacctagtgtctacacgacgttcatatttggaggctacttggatttttggagggtatttgcctgtgagggcttcagggtctagaccctttttcaaggctttgtgtctcaactgctgcttttgtctttctttcaattctttaagatcgtagtcttgacgtttttgcctttcttccaagtcatacttttcagtttccaatttgacgatgcaatcccagagttctgtggctctttcgcggagtttatctacgctaaggccatcaaggaccaagggtttgatacggatggaaagggagaattttctttttcttcttccatttgt

SEQ ID NO: 7956 - DNA, 699 bp, Diabrotica virgifera
  misc_feature (15)..(87): n is a, c, g, or t
  misc_feature (140)..(166): n is a, c, g, or t
  misc_feature (174)..(191): n is a, c, g, or t
  misc_feature (195)..(247): n is a, c, g, or t
  misc_feature (257)..(308): n is a, c, g, or t
  misc_feature (342)..(471): n is a, c, g, or t
  misc_feature (541)..(584): n is a, c, g, or t
  misc_feature (601)..(654): n is a, c, g, or t
  misc_feature (657)..(691): n is a, c, g, or t
ctctctccctggggnnnnnnnnnnnnnnnnnnnnnnnnnnnnnnnnnnnnnnnnnnnnnnnnnnnnnnnnnnnnnnnnnnnnnnnnntcccaaaaaaacctcccccccccctttgtgtgttttttatttttgtttccccnnnnnnnnnnnnnnnnnnnnnnnnnnncccccccnnnnnnnnnnnnnnnnnnttcnnnnnnnnnnnnnnnnnnnnnnnnnnnnnnnnnnnnnnnnnnnnnnnnnnnnntgggggatgnnnnnnnnnnnnnnnnnnnnnnnnnnnnnnnnnnnnnnnnnnnnnnnnnnnncacccacccccccctccctccccctccccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttttttttaaaagcaaccacaacaaaaaagaagggggaggggtgggagagtggtttttgggcgggnnnnnnnnnnnnnnnnnnnnnnnnnnnnnnnnnnnnnnnnnnnngcgggggcgggcccgcnnnnnnnnnnnnnnnnnnnnnnnnnnnnnnnnnnnnnnnnnnnnnnnnnnnnnnggnnnnnnnnnnnnnnnnnnnnnnnnnnnnnnnnnnncccccccc

SEQ ID NO: 7957 - DNA, 824 bp, Diabrotica virgifera
  misc_feature (13)..(30): n is a, c, g, or t
  misc_feature (64)..(86): n is a, c, g, or t
  misc_feature (312)..(332): n is a, c, g, or t
  misc_feature (411)..(430): n is a, c, g, or t
  misc_feature (495)..(543): n is a, c, g, or t
  misc_feature (683)..(703): n is a, c, g, or t
gtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagataattctgaaattgccatattatcatc

SEQ ID NO: 7958 - DNA, 212 bp, Diabrotica virgifera
  misc_feature (4)..(22): n is a, c, g, or t
ctannnnnnnnnnnnnnnnnnncttattagtatcaaatttagatgatataaaagaatgattattatgggcgtgatttaaagataataattttcattcattttaaataccctaatctaagttgaagattatctctccccgggtttatcttgattgtccaaaagtacatactgatcctaattgaacacattttgtttattcctgcgagagttgc

SEQ ID NO: 7959 - DNA, 934 bp, Diabrotica virgifera
  misc_feature (570)..(596): n is a, c, g, or t
gcaaatttagcatacgttgctcccctaccataaataaagttttattagaatgttctaaaaaatataaaaagaataattcttactggtatcttaaaataaaatttgattagacgatttcaaaattgtattttgtgaatttcgaaaaaaaaaacagtaagagcgtctacgataggcactacttgttattttgttaccttcttgcgctcactcgcacgttcaataataatattatgcttgtatcgcagcatgtgtctcaatacagatcataaatcttttcaactattctaaaaaatcttttaaatttacgcacttgccttaagttgcgttttcttaataaaatcagttatgctgcaggttaaagtctctgctctataagtttgtacagacaaaacacattggttataaccctttcgcttgagacacatcgaaattcaacctttgagaataatatggcttagtttgtcaaatgctgcccatgtcaggcctattcgcctctgtatttcatgtgtttgattgtctctgcttattttgatctcgtggcctagatatttgtaggtgtcagtttgttgnnnnnnnnnnnnnnnnnnnnnnnnnnnctattctactttgtaaataggctcaatgcttgttttactttggtttttagcctcaaaatgccatacgataaataaatgctattttctgtcagtctttttatgttgattccattctatttttcttcttttggtgcacatgtttatttcttctataccacatctcgctcgtatttcctcacttcttactctgtcttttaagagtttggttttgttatttttcgtaagactttcatttctcctgtttccagtaggtctttgtgttttcgccgtatctgctcttggtttccgctgtgtacgtcattatccgtcgtaatattgtttatatatcctggttttcg

SEQ ID NO: 7960 - DNA, 736 bp, Diabrotica virgifera
  misc_feature (2)..(44): n is a, c, g, or t
  misc_feature (52)..(632): n is a, c, g, or t
  misc_feature (638)..(666): n is a, c, g, or t
  misc_feature (674)..(674): n is a, c, g, or t
  misc_feature (682)..(716): n is a, c, g, or t
  misc_feature (718)..(719): n is a, c, g, or t
  misc_feature (727)..(727): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcnnnnnnnnnnnnnnnnnnnnnnnnnnnnngaaggggntggatgannnnnnnnnnnnnnnnnnnnnnnnnnnnnnnnnnntnnattttaangtaaaaagc

SEQ ID NO: 7961 - DNA, 637 bp, Diabrotica virgifera
  misc_feature (485)..(502): n is a, c, g, or t
attaaagtgacattaaaaaattagcaaaatgagtggggacgatgaccaaaagatggagatcatcaaaaaagccttcaccatgttcgacacgggcaaaacaggcttcatcgagaccattaaaatcgccaccattttgaacaccattggtcaattattcgatgaagtcgccctaaatgatctgattaccaaaaatgaccctgacaggactggacaagtgaacttcgatggcttctatgaaatcatctatcctttcctagaagaggatcttgatgaggctgaaacacagaacgaacttaaggaagctttcaggttatacgatagggaaggtaacggatatatcacaacaggttccctaaaagaaattttggctgctctggacgacaaccttaccagcagggacttggacggaattattgcagaaattgatactgatggatctggtaccgtagatttcgatgaattcatggagatgatgactggagacnnnnnnnnnnnnnnnnnngaattatggacagggtcactatttggactaattttagggaaattatagtattgaaaaaaattccaatctagggttactcaagaagacaaataatgtgtattcattacttataaataaaacatgttgaaattgttg

SEQ ID NO: 7962 - DNA, 745 bp, Diabrotica virgifera
  misc_feature (353)..(384): n is a, c, g, or t
aataaattaaaataggacactttacttcctactcgatggtttattgtctggaagctcattctaagtagattccgttttattaaagaactgttgaagggagcaagtgactctacaattacggaattgaaaaacactaggagtaaactcaagaggacaagaaaggactgatttatcttctcaaaatgaatattcgatgtgcaaaaccagaagatcttatgaacatgcagcactgcaatctgttatgtctaccagaaaactatcagatgaaatattacttttatcatggccttagttggccccaactaagttatgtagctgaagacgaaaaaggtaacatagttggttatgtcctnnnnnnnnnnnnnnnnnnnnnnnnnnnnnnnnagcatggtcacataacctccctggcagtgaagcggtcccacaggcgattagggctagcccagaaactgatggatcaagcttccgaagccatggtcgaatgttttgacgcaaaatatgtttcgctgcatgttcgtaaaagcaatcgcgccgctttaaatctatacaaaaactctttgaaatttgaaactgtcgaaattgagccaaaatattatgcagatggtgaagatgcatattccatgagacgagacttatctgaattcgctaagaaagttaaacctaagtctgagactaaaaacgaagaatagtgtaattatttgtaatttttgtatttatagcaaatataatatacatatttaatatt

SEQ ID NO: 7963 - DNA, 803 bp, Diabrotica virgifera
  misc_feature (399)..(416): n is a, c, g, or t
cgaacagaagaagatgatactgatgcgttcttagataaaatattaccaacctaaaattacaatgaaatgtgcaaccatgactatactgacttccagaatattttccaacattatttcctacaaaacttcaagattatccacgactagaaatacgaaacaatcgacatgcctgatttcaaacatgctcttatcgatcgtttcatccacgattttactaccaacactactgacatcttccacataactggacataaatgcttcgacatgtcattgaaccaagacaatgttctaccaccctacacgatgtttgatttgattccccatatgcgctaaggtcattatacagaatataccgatcttgctacaaaaaatatgaaagctatcatcccaccccttacnnnnnnnnnnnnnnnnnntggatatattgcaagagaatgcgatgcattgactatttatacatcacaaaaatacagacgaaggagttgtaaagaagactgcctcttctcactatcaccaatacggccagctcgctgtaccgagatgcacccatagagaaactatctacccgtctgacgagaactgctacaacgagagttagaataaactataacacggctaaccatcgaatctctgtatctgtatcataaatattcctttgtatactgatgtgagtcacttgaatttctcttgatcttctcatatcatattgtgttaatactgtagatgctacttaacacgatgtgagacgcttccattatgaacatacactatatggaccagaatctattgacctgactttattg

SEQ ID NO: 7964 - DNA, 852 bp, Diabrotica virgifera
  misc_feature (615)..(640): n is a, c, g, or t
gcattatctttaaattttgcaaaaaaaatagttataatacgctggtctaatgagtaaagtacaaagaaagtttatttaccagcaattttattgctggaatcgaatattatgatcctatatattaataatatgggtatgcaaagtccgcagatagtgtgctacttttttattaacaaaatggttcctccaaatcgtgttttttcaattattggtctataactccgaagattttaactttacaccaaaaatactcaaataaaaatttaccccaatttaattatacatagagacatgtttttcccgattcggtccgacgaaaattttcctcggaaaatgtgggttttcccaacaaaatctcaaattttcaaataaattttttcggcaagtaattatctatcaattattggataacttggtgaaataaaagcttttttggtatagattataactgcagaagctggtgaaaattaaacaaatattttagcaacaattcaattgttaattaacaatttgcaatcgcaataaccaggtcagtcttaaaaccaggtcatttcgaaatcgttgttatttcattgttttttctctatttcggaaaatgcgtgaattatttaccgnnnnnnnnnnnnnnnnnnnnnnnnnnggaacggatcctttcggggccctccgggaaccgggcccctaggcccccgctataagcgccctgtgaataaaccggcactgtctagatccctaccattcctgttcctcccaatcacataatatacctccgtttttcgatgtgctattcttactttctccctcttcaatagcatagccccttttcgacccctataatttcgtccaaacattttt

SEQ ID NO: 7965 - DNA, 752 bp, Diabrotica virgifera
  misc_feature (2)..(750): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 7966 - DNA, 510 bp, Diabrotica virgifera
  misc_feature (4)..(23): n is a, c, g, or t
aagnnnnnnnnnnnnnnnnnnnnaacgtccgcgataatgttgtttcagtagtggagtaaagtttaatactcgtagaccgaaatgcgtgagtgtgatctcaggccatgttggacaaaccggcgaggactacggcgaggcctgatgacagtagcactacctgatagcatgagcaagacacacagacatgatattgagatcatgaaagactgtgtcgacaatgtggtatcggttgcgtctcgtttctttggaataaaaggagaggacaaaagtcttacttacagaagatggagatgttgagaacgatgcgtaacatgtacctgatctgcagacgcagacttactataggccacttcttgactgcaactatcataccgccaatgaacctgtgatatgtcaccttgaatatggtatgtgatggaggaagaaatcaactacttaggacagagttgctatcttaatgggatggtgtttagtactggaattccacaaaagatagagaggaagcgaagt

SEQ ID NO: 7967 - DNA, 881 bp, Diabrotica virgifera
ggcacatggaaaacgcacgtgtaaatgagagcatatactattgaagaagataacttaatccttaattggattatcagggtaaagggatattaccatttgcgaggttcagcactctggaaagatatggaagcgggaaaaatattcttagaggacaggacgtggcagagccttaaaagcaggttcattaaaacaatacagccgaacatatataatgcgaagtattctctaacaaccgaagagaagcatagaataatgcagggttggacccaaacagcaaaaagttgagatacagccgaacatatataatgcgaagtattctctaacaaccgaagagaagcatagaataatgcagggtttgacccaaacagcaaaaagttcgaggcaagttctgactctaggtcagacagttcagatagtgaatgatccagccgaatactgaagaaaaacataaaatcatgcagggttggatgatgcagactgccaaaacgttcgaggcaagttctgactctagatcagacagtgaatggtaattggtattacagtaatggtatacagtaatgatccagccgaatactgaagaaaaacataaaatcatgcagggttggatgatgcagactgccaaaacgttcgaggcaagttctgactctagatcagacagtgaatggtaattggtattacagtaatggtatacagtaatgatacagcccaatatctatgtaagtaggtattcggttacaaccgaagaaaaacacaggataatgcatgggttggaggcagactgccaagaccttcgaggcaagttctgacagttcagacagaaataaagaacaatttcagttggattagtttttagttaaaaatatataataaggtgcatctat

SEQ ID NO: 7968 - DNA, 132 bp, Diabrotica virgifera
  misc_feature (40)..(57): n is a, c, g, or t
aataacataacctcaatcaaatttgcattattattattcnnnnnnnnnnnnnnnnnngaccttttagactattgataatgtaaagagtattattgttgactggtggggtcagaacagtctcatttttattgt

SEQ ID NO: 7969 - DNA, 927 bp, Diabrotica virgifera
  misc_feature (749)..(749): n is a, c, g, or t
  misc_feature (756)..(756): n is a, c, g, or t
  misc_feature (811)..(811): n is a, c, g, or t
ggaactattagagacgatgttgccggctcactagacttacagcgtgaggaacgaagattaggagagacatggaaattgatttatacataatagatacaattgaagccaaaagactaaactggtatggatacctgcagagaaagtctgaatacatggccaaaaaagatagaaaaatggacttcacccaaaagaagaaaacaatgtagatcacgacggtcctggagagaagatgtcgaagatgcaatgactgccagggatttaaaaactgaaaattgcttcgacagaatacgttgctaattaggatgcgagaaacggtgccagctgtagaagatatacatcaattatagtacttgtggggtgcttcctcacgattaagaagctctaaattttccaccatctttacttcttcgtcttagtcttctatcgtcgacgtcatctcatctgtttcttccttactcctgtcgtttactttcgtaaggtctctaacgttgtattgttgcattccaacgttggtctttttgtctagcagtgtgtcctgcgaagctccatttaagtttggtaacttttggttgttatgtcctcgacttttgcttttgatcttacccagtcgttcctatttttatctgatagtcgtgtacctaacattgctttttctattattattcatatttgccttagttagggtccaggtttgacatccatatgttatgatgatagggaggatgcactggaacactttgctcctcagncttgggnggtattttgcggccccatgttttccaaatcatgtccatgctagtcttgctctccnagtcatttccgcactgtgggtctcattgtcaagtttttgggatttggcctaggtagatatattcctggactttttctatctcactgccatttatagttagttataggtcgggagct

SEQ ID NO: 7970 - DNA, 635 bp, Diabrotica virgifera
attgttatatacttccttgtgtctacatttttctgtttatttgtaccgattattcttcaattattataactgattgaccaactcccctgacatccaattgctagaattcaaagaaccatttctcactattacaagaaacatgaaggctgacacgattacaaactaaaaagttaagaacagaaatgagcatctcgacgatcttatcccacataggctgaattacgggatatgatctgtgtcgaatatgtcaatggctacggaacgctcatgttcccaaaatttttatcaaggacggtacaaagcataagatatagcgagagccaggaatatattcgtgaatccttcctgagagatctacgaagacagatacgttttcctctacatttccatgattgcgccacgtcatgacacgcttgattgaaattttgctggactaaaaaatatatgattcgattcttaagtgcaatagcaatgtcgatgatcttgtcagttattgatagctcataaccgtgctttcttcatcgtgtagatattttacctttatttaggcttatgctctgcttctgacaaatcatttcttgcatgtgtcatgaacgcaaattattagctatgagggctggaccactagagagaat

SEQ ID NO: 7971 - DNA, 824 bp, Diabrotica virgifera
  misc_feature (155)..(182): n is a, c, g, or t
caaaagtacagaccaaacacagcacttaacccttctttgtcttagttctaaactgagatgattaatacaaaaaattggtcattgctattctgttttatttctatatctggatctagttgatccgttatcccccatatagccgcattgtattctcnnnnnnnnnnnnnnnnnnnnnnnnnnnnatcacgtaaggcaacactgttgatctgttttgtatacaacaatgtctttatctcaggtaggcctaatgacctctctgttaagtttttgaacgaagatttcatgaatataggtgagtcactgtttttaccgtagacatggcacattcaacacctgacaagcactcaccatacctatattgaacactatacaaaagcctaccgcgcgttaaccgcttgtcatgtgaatctcctcttattcattggccggagagagagaatagggggagagtcgtagctcgaaatatgtttgagcgctttttcttcgctgtgaatcaaaataatatagacgtatatatttgctttttaaagcaattgttactgaatcgattttttactaaaaccccgcactgtgtgtctacatttttgatgacgttgataccctatatccatagaattagagctgaagataatatttttatctatgtattattaacaggtaaatcaaaatattggaaagtatgtgattgttgatgtgaaaacaggattagaaaaagttacttgttatttgttagtactgtcaagagcttgcataaactctgaaagctccaacatttggtgtccttttaggggggccgtccataagttcacgcttgtttcccgagt

SEQ ID NO: 7972 - DNA, 583 bp, Diabrotica virgifera
  misc_feature (14)..(34): n is a, c, g, or t
  misc_feature (38)..(68): n is a, c, g, or t
  misc_feature (74)..(234): n is a, c, g, or t
  misc_feature (242)..(293): n is a, c, g, or t
  misc_feature (311)..(328): n is a, c, g, or t
  misc_feature (332)..(418): n is a, c, g, or t
  misc_feature (420)..(455): n is a, c, g, or t
  misc_feature (462)..(582): n is a, c, g, or t
acaaaaaagggggnnnnnnnnnnnnnnnnnnnnngttnnnnnnnnnnnnnnnnnnnnnnnnnnnnnnnaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccctnnnnnnnnnnnnnnnnnnnnnnnnnnnnnnnnnnnnnnnnnnnnnnnnnnnncccaccgccacctgggtnnnnnnnnnnnnnnnnnncaannnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 7973 - DNA, 1174 bp, Diabrotica virgifera
  misc_feature (11)..(40): n is a, c, g, or t
  misc_feature (140)..(160): n is a, c, g, or t
  misc_feature (231)..(248): n is a, c, g, or t
  misc_feature (423)..(444): n is a, c, g, or t
  misc_feature (727)..(727): n is a, c, g, or t
  misc_feature (807)..(807): n is a, c, g, or t
  misc_feature (816)..(816): n is a, c, g, or t
  misc_feature (895)..(912): n is a, c, g, or t
  misc_feature (971)..(994): n is a, c, g, or t
  misc_feature (1035)..(1057): n is a, c, g, or t
  misc_feature (1063)..(1114): n is a, c, g, or t
  misc_feature (1121)..(1166): n is a, c, g, or t
agttctagtcnnnnnnnnnnnnnnnnnnnnnnnnnnnnnnttttcttttaaacgattcaaataaaatatccataacaaaattcttttgggaactactgacttctggacagatttcaaatccatgcacaagttacgaaatnnnnnnnnnnnnnnnnnnnnntaaggttgtctatttaattctctaaatcacttggcacatgaattttccatcgttcatcacattcagacagnnnnnnnnnnnnnnnnnngctatttggtttcataattagcactttccacatacatggtggattgtcagtaagttggtactttagaagtgacgtattttgtcgcattttgagttcatagtaaaaggcaactacgcaaataacatttgttcaaaaatctaaaccattcaaactaaactgtcacacacagatacgnnnnnnnnnnnnnnnnnnnnnntttgattaacaatttctaggaactaattaaaagaaaacttaacattgtcaattgaatgtgaatcaagatcaaaatagctgttaatttgtgaattttttggaatctacgcattctgtgtgttttaaggaacaaatgaactattcttcctttagatttttgttaccaaaccctgttttcaacttcttttccatcgtctggagaaaagcccagattcaggtattaaggcaccaagtcacacagttcctttggaactataaatactgtttttcttactgtgttcacnttgtttagtgttcaaaccttctactgaaatataaagatacatttaaaacaaagaatactaccgaatcatcactatacctngtcacaaangtgtagaactaaacagttcctgtcattttataaatgtcaaaaggtcaatgtttaaatatcaatgtcaaatgtcaatgtnnnnnnnnnnnnnnnnnncactgggtgttgaaactataccagtttgtccttaatggaagaaactaaagtaacacacnnnnnnnnnnnnnnnnnnnnnnnntgaaatggggggggaattctttttaaaactggtaaaaaccnnnnnnnnnnnnnnnnnnnnnnncggttnnnnnnnnnnnnnnnnnnnnnnnnnnnnnnnnnnnnnnnnnnnnnnnnnnnntttttcnnnnnnnnnnnnnnnnnnnnnnnnnnnnnnnnnnnnnnnnnnnnnnaaacctcc

SEQ ID NO: 7974 - DNA, 856 bp, Diabrotica virgifera
  misc_feature (835)..(836): n is a, c, g, or t
  misc_feature (839)..(839): n is a, c, g, or t
ctctaatgacaaccatccattctgtgacgaacagccaagtccttatcgacggagctagaccacacaaatggagatttggcagaggtggcatccagaacatcataccggctactacaggcgcagcaaaagctattggaaaaattatacctgacttgaacggaaaaataactggactggcattcagagtaccaacacccatagtatctgtgataaatgtattaaagaaacctatcttcattctattggaccaggaccatgtggaagacgacttgtgagtgttaggagtgcgaaattggaaaaccaagacgaaggataggaaggaatggaagctgattctggaacaggccaagactcaccatgagttgtagagccaatgatgatgatattcattctattaactattagatgtttctttccgaaatacctcccaaagctattgggaaaattatacctgacttgaatggcattcttgaaaaatagtgaactggaatttagagtaccaacacccatcttatctgtgataaatatattgaagaaccagctttcttaaaattcttgtttttccgacattgctagcttttggtccttatgattactataaacttttaatgtgagttataaatgtaatattcatgtctacaataaaattaataagtgttaaatgtattttcttattgttgagtactgtaagagcaacatgaaaacactgaattgaatcgaattttgtccatgagatttagaaagtcatccttcctatatacaccatttacattatatatgacaatagtatttttattatctttttggatttatataaacctagtggacttgttgnntcnagtagtagtacaataat

SEQ ID NO: 7975 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7976 - DNA, 943 bp, Diabrotica virgifera
  misc_feature (457)..(475): n is a, c, g, or t
  misc_feature (698)..(718): n is a, c, g, or t
  misc_feature (892)..(892): n is a, c, g, or t
  misc_feature (920)..(920): n is a, c, g, or t
gactgagactaaagtaactttatataatacaataatacagccacactttgattactgtgcatcgattgtatatttattcagtcttaataaaattagtcagctgcaaaaacttcaaaatagagggatgcgcatcatattaagaactagtagaataacgccaatattgattatgttaaaatctcttgaatggttgtcagttcgtcaacgtttgcattacctaaccatggtttttgtgtataaaatattgaactcgttggctccatcttactttcaaaaatatgtttcttttcagagagatgtacatgattataatacaaggggtacaaataatctacatattgttgagtttaaaaatagctttatgatgaattctttaatttgcaaagggtttaaagaatataatgaactacctctcgttttaggaacttgtagaaacattaatacattcaagtacagnnnnnnnnnnnnnnnnnnngagaataatgtgttgaatgtatttgtgttgccttgtacttattgtgcttacgttgatcgcattggtattttattcaagtgtttgtggctttcgatattgacattttaattagtttgagttttttactttttaaattaagtaatggactatatcaatacttgtattgttttgactatatgtactttagcatgtttatattaggttatcctatttcaaataaagnnnnnnnnnnnnnnnnnnnnnaacattgaatataataagtgttaccaaattagttcaatttcaaatttttttcctatgcaggaacaatgttgtaaatgccaaatcagattttgtctacaacttttgaaaacatgcaagtagtaatgatttgaaaaagcaactttatgaggatacatgatagatttaggatgcatncagtaaagtcttaatattcccaatgctncgcagtacattatttgcacatat

SEQ ID NO: 7977 - DNA, 1235 bp, Diabrotica virgifera
  misc_feature (4)..(82): n is a, c, g, or t
  misc_feature (92)..(160): n is a, c, g, or t
  misc_feature (314)..(333): n is a, c, g, or t
  misc_feature (338)..(360): n is a, c, g, or t
  misc_feature (362)..(390): n is a, c, g, or t
  misc_feature (392)..(410): n is a, c, g, or t
  misc_feature (454)..(532): n is a, c, g, or t
  misc_feature (548)..(705): n is a, c, g, or t
  misc_feature (716)..(754): n is a, c, g, or t
  misc_feature (759)..(784): n is a, c, g, or t
  misc_feature (793)..(867): n is a, c, g, or t
  misc_feature (882)..(932): n is a, c, g, or t
  misc_feature (978)..(1048): n is a, c, g, or t
  misc_feature (1082)..(1124): n is a, c, g, or t
  misc_feature (1141)..(1174): n is a, c, g, or t
  misc_feature (1176)..(1211): n is a, c, g, or t
cacnnnnnnnnnnnnnnnnnnnnnnnnnnnnnnnnnnnnnnnnnnnnnnnnnnnnnnnnnnnnnnnnnnnnnnnnnnnnnnncccggggaannnnnnnnnnnnnnnnnnnnnnnnnnnnnnnnnnnnnnnnnnnnnnnnnnnnnnnnnnnnnnnnnnnnnctagtgggcggggtgtaaaaaatattacccccacaaaaaatagaggggggcgccctcataaatactaaacgaggggcgaaaaaacaatcatttgtgggggttattcccccaaaaagggggcggtttcccctcccaaaaaaatatttgtgccccnnnnnnnnnnnnnnnnnnnnaaagnnnnnnnnnnnnnnnnnnnnnnngnnnnnnnnnnnnnnnnnnnnnnnnnnnnntnnnnnnnnnnnnnnnnnnntcctctctcctccctcctcccacaaaaaaagaaaaaacccggcnnnnnnnnnnnnnnnnnnnnnnnnnnnnnnnnnnnnnnnnnnnnnnnnnnnnnnnnnnnnnnnnnnnnnnnnnnnnnnnattacaaaaagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggttccannnnnnnnnnnnnnnnnnnnnnnnnnnnnnnnnnnnnnngaatnnnnnnnnnnnnnnnnnnnnnnnnnnacaacccannnnnnnnnnnnnnnnnnnnnnnnnnnnnnnnnnnnnnnnnnnnnnnnnnnnnnnnnnnnnnnnnnnnnnnnnnnaatatattaaacacnnnnnnnnnnnnnnnnnnnnnnnnnnnnnnnnnnnnnnnnnnnnnnnnnnnataaaatagtatgtgggggaggaaaaacaccaccccgccgcccgcnnnnnnnnnnnnnnnnnnnnnnnnnnnnnnnnnnnnnnnnnnnnnnnnnnnnnnnnnnnnnnnnnnnnnnnaccttccattttttggtgtatgtgtggggcggcnnnnnnnnnnnnnnnnnnnnnnnnnnnnnnnnnnnnnnnnnnncgcgccccccccgccgnnnnnnnnnnnnnnnnnnnnnnnnnnnnnnnnnngnnnnnnnnnnnnnnnnnnnnnnnnnnnnnnnnnnnncatttctcccccccctcccccccc

SEQ ID NO: 7978 - DNA, 825 bp, Diabrotica virgifera
  misc_feature (231)..(249): n is a, c, g, or t
  misc_feature (273)..(291): n is a, c, g, or t
cgatatttatttcttgttcgtaaattaaatcactgattaatttgttggacaaaccgtaacataatctaatgaaccttttttgtcctttattaagtgtaaaagtattaaaaacatgtctctaaaatggtctgaacttcctttgttctacattctatatgatttctctctcgtggttttggatgatacccgagtttgcaaaggttattcagccaccacatttgccagcgccgnnnnnnnnnnnnnnnnnnnacctcaaccatgaattacctctcnnnnnnnnnnnnnnnnnnnactcccactttcacttgctcaccctattttcactctgcttgcacctgagcacccaatttggtcgcctttttttagctttattgtttctctgtcgtcttctttacatatttatgagatattttccgtctgtccgctgatgatgtcatctcctctaccattcccgtggttgactgtgttctgccatccaggtttcttccaatccgatcaccaatttattatataccatagcaagatgtgagataccaagcgccagagaagtcgcatgagcaattgccattatatgcccttctgaagctgtaaaggtatgcactagagtcactagaaagtaagtttgaggcagaaactaatctacatcctacctttctacgttagtatttcagacgcagatttgtaggctcatgacaccctcagcaggttcttcctcactgctaggatcagttactttctgtacgaccacataggatcgcgaaacttcaaataaatttcacaacacaatgaaagagattggggcaccaccgctagatatgttcctac

SEQ ID NO: 7979 - DNA, 814 bp, Diabrotica virgifera
  misc_feature (50)..(68): n is a, c, g, or t
caagaagttaattttaattatgaaaataattttagtagttttggtgattnnnnnnnnnnnnnnnnnnnctacggacgaagaaaaatggagacaatttaagattacccacaacagagtatataacaatattgaagagcataaacatcgatttgaaatctttaagaaaaatctgattcgtattaaagagcaaaacgaaaaatacgaaaaaggggaatcaacttttaacttcggaatcactcaatttgcagaccttaccgaagaagagttccttagtcgttttaaactcgctggtagttctaagttaagcaaaattaatagcaatgtctcttcttctaaaagtagaagtaaaacctccggtggatcagatgatttgccagaacaatatgactgggtccgcactggtgcagtaacatctgtaagagatgttgcagattgtggtgattgcacagctgaaagcgtggtagccgcagtagaaggcgctgagtttataaaaactggaaatctaatacagcgaagtcccaagcagctagaagactgcattccttttaacccagatgaatgttggatatgttatgagaaggtccttaattacaccagagattttggtattatgaccgagaaggattatccttggaaatttgaaagtgaggattgtcaaatagatagcattaccaccaccgatccgctgatacagataattgactggatatatgttagcgagggggatgaggtggaattacaacgtacactttatcttgaaggaccttgtagtggtttccatagatgcaaccattaattatcagctatatgcaga

SEQ ID NO: 7980 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 7981 - DNA, 427 bp, Diabrotica virgifera
gttgtttggccagatgaaaaaaattacgtgaacagctacctccactggggacatattaaaaccagaagtgccaacatgaaccggggccccctttgccggggtagaccaacccaccgggggggaaacctgccttgtctggttaccggcccgggcagatccgcgcaacatacgatcacaccaatgtcccggggggctcctgagatgccccaacatccaacgagagttgtggcggagggccccccaccgtgaccgccccagccagccgtacaggaacaggcagctagctagcacaacccgcccaagaggggcggtgaagtcacccctgtttgaagtggaagtgccaggtggcagttccgcgagcagcaccgaccggctactgcactccgggggtgctgacaagaaattcgcctaggcacgcccatgttgc

SEQ ID NO: 7982 - DNA, 501 bp, Diabrotica virgifera
  misc_feature (59)..(79): n is a, c, g, or t
tttttgtccggcacaaagaccgtttaaaattataaagatagacttttttcgatgattgnnnnnnnnnnnnnnnnnnnnnaccagtttacttgtatttttatcaatcaacgcttaaagaaaagataataattatagaaaatacgtcatttttgggaaaaattgtttatcaggtattttagctggaatctatacttaaattgtatattattagtaatattttacatcatacatcttatcttgatttatcagttgattttcttttctataacgattttaattaattttgattcaaaaccatttatgatcttttgaggtttttgagtagaatatttacactaatattttgctgcttactttgcacaacttctctcttctgtaatgtgaaagctgtattttatgtgtagctgaaggtagagtgatagttcagataaattgtagatattggttcacagtggtattgcaaacttagaacctgatactaacaggactcggaactttctt

SEQ ID NO: 7983 - DNA, 845 bp, Diabrotica virgifera
  misc_feature (79)..(98): n is a, c, g, or t
  misc_feature (809)..(809): n is a, c, g, or t
gaacggcacaataaaccagaagtagaggttacaacttccaaagaattactactcaacccggtcgtgatatctagaaacnnnnnnnnnnnnnnnnnnnnagaagcgtcagtaaattcaattagaattagtatagcagtgaaacaagcagatgagattgaaaaaattctctgtaagaaatttatgcgatttatgatgatgagagccgaaaacttcattgtacttcgaagaaaaccaattgaaggatacgatataagcttcctcattaccaattttcacacagaacagatgtacaaacataagttagtcgattttgtcatacattttatggaggaaattgataaagaaatatctgaaatgaagttagctgtcaatgctagggctagaattgtttctgaagaatttttaaaacgtttttaaaaagtaatgtatgcagtgctaatataggtgctaggaacattgatactatatcaagacaatgacatttgagtaacgagtatgaagaagtactgataaaataattgtaaaagatgtaaaacggttagttaaatcttttggtatcttaaggcaaagtcttaagactacaattgaatcgtttattgttgaaaggaggtaagtaccattttttactttttgagttttgttaaaaaatccctcctctctttctatatccacctcgaagcaaacacaggcattgtatggatatcgtttatacactgtgaaactacatttaacaccaggagatgcggatatagacagaaaaggtttttttactacagtcgaactagcttattggaatagccttcgtgccnagcaaaagtattcctataaccgagatattctaatac

SEQ ID NO: 7984 - DNA, 840 bp, Diabrotica virgifera
  misc_feature (793)..(793): n is a, c, g, or t
gaatgacagatgggcgatggacaaaaaggttattggaatggaaatggagatcaagagaagacaaaataaacgtcgctcaaccgcctacaagatgggacgtattaaaaaaggataaataacaactggatgagatcggcgcaggatagacagggttggaaacaaggggagtaagcctatgttcagcagtggaattttaacgctatatgatgaacataattttttattttgataacgatttccgaagtggaaataaattttggaaacaaaaggcctccgacatggatgttgtctatctcccacgctctttaaaatataccttgaccaattgaccaatccttacagaggtggacaaaagcagtaaaaccgatgggactgaaagtgggagacgactccctatttacattatactttgcggacgaccaagttgctatagcccaagatcaagatgacttaagctatatgatacggaagctaaatgaacattaccaatagacaggattagtaataaatatggacaagtcagaatacttcatagtgggaaacgaagacattgaaaacctaccatcggaacaaggatatattggttggtgtgaaacaatgcaaatatttgggagctatatttaacaaacgaagaaatagtgaagatgaaatacaacataggatcaataaaggtagaagcatcactagatccctcaattcaattttatgggacaaaggtatcaggaaggaaacaaagagaagaatatatgaaagtataatgaagagcgctgcaatctacggtgcagaaagttgngacataagtgcaagaaataaaaagaagctacttagttccgaattgga

SEQ ID NO: 7985 - DNA, 264 bp, Diabrotica virgifera
  misc_feature (7)..(100): n is a, c, g, or t
  misc_feature (146)..(164): n is a, c, g, or t
  misc_feature (219)..(236): n is a, c, g, or t
ggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatagggaataccggggcaatttttattgggaaaagttccaaannnnnnnnnnnnnnnnnnncggaccccccaaggggggaattaaaaggttttttaatttgggcgggaaacacggnnnnnnnnnnnnnnnnnngcgcggggtgccgaactttttttaaaaa

SEQ ID NO: 7986 - DNA, 620 bp, Diabrotica virgifera
  misc_feature (454)..(470): n is a, c, g, or t
gcagagcccatgattcgcttctatatgtaacagttgagcgaataattgacatacagtcttaatttaccattgttctttttaccagcttaaatcttagtaatgatgacagggagtgttatgacttttccacgcagctattcttgctgatacctctttttaaaattgtttgacatctgtgattatcgcccctatatatttaaactattttactacctctaagctgtggtcattattatgtatgttctgcctaattctgggtcttgacatgtttgattattaatttatttctgcttttcttcatttattccccggcccaaacaacccactagaactgattgttcctcgattcattattatataggtatcgttctgctacactcttgctcttggatttttgtctactaaggtatttcgccttttcttcatttattcgacggtccatactacctgcttnnnnnnnnnnnnnnnnnatcctctttcacgcctcttgtatagtgagcgactgcacctacatcatcggcaaatgccaacaatacttctgatcctcgattctcaaatcaccttatcatctcatataacgagtctccttgtctaggtcatgatcttacagtgttttatat

SEQ ID NO: 7987 - DNA, 1205 bp, Diabrotica virgifera
  misc_feature (641)..(665): n is a, c, g, or t
  misc_feature (897)..(927): n is a, c, g, or t
  misc_feature (982)..(1009): n is a, c, g, or t
  misc_feature (1121)..(1146): n is a, c, g, or t
  misc_feature (1176)..(1202): n is a, c, g, or t
gaggaaatctcgctcagctcgccagcggacagacatgtaggaaaatacgatcaccgctcgtataaagataggtaaaaggaaaaccgttggattcgttcagcacaccaaaacgacggcggaaaatggttgggataatatacctcgttgttgtttattattcttcgatcaacgctccaagaataataatcaactaggcttttcgttccgacttttatatcgtacgagacggtacaaaaacacgttttacttaattcattggcgtactctatatatagaattatattatcgtcacaagggcactatgtccatttttgtcaatattgggattatactgcagttataatgaacttttaattctccacacagaggtataaagcactatgtcctactttataaaataacaaagataagcactttataaaaagtatcatgtcacattttgtttagaagcagaaacatgaaacgctatacctctgtgtaagtgtattttgtaaagcaatgtgcacggaggtatagggtttcatgttcacatggttgaaggaagttacaaaataaatccagtattaaacaagcagggtaaagtattacactttaccctgtaatgtttgtcatgaaggagaaactatctccactacattgtnnnnnnnnnnnnnnnnnnnnnnnnnatcaattttagtatcacaatatgtgttataaacaatacaattttgaaagctaataatctgaagaataaattagacaagggattgtgacataatgtgtattaacatacatcctgtgaataaggatacacaaaaataaacttaaaacgcttctcctgtaaaattacgaatttgtgacatagtccccttttacctccgccatgcagaattattcttgagtaatgagcattttagnnnnnnnnnnnnnnnnnnnnnnnnnnnnnnnataaaattgcattgctacactttttaaacggtatctgaagggacttttttacccnnnnnnnnnnnnnnnnnnnnnnnnnnnnaagctaaaggtttcaatttttgggggcggatttactttttttcccattagaaaaaaaaagggtagggggtaaagggggaaaaaaagagctagagattccaaaaaaggggacnnnnnnnnnnnnnnnnnnnnnnnnnntatagggtccccgaaaattaatattggggnnnnnnnnnnnnnnnnnnnnnnnnnnnttt

SEQ ID NO: 7988 - DNA, 395 bp, Diabrotica virgifera
gcttcaaggcgttagcggccatcaaatatttgattttaacaaatcagagctagaaagggtctgcggaaaagacgaaggaaagcggttaacatcacaactgaatatccagaaagctacaagtgggtaccaaactgtaaggagtacagaactaagaaaaattctggcaaaagtacgacaaaaaatgggagatatgtaacagcgtttctaggtaaaagtgtcatgaaaaaattttgtatagttgttaaaatattaatcgttaccaaaagtgttatatagtgtacgtcatttcattttgtctagtccatatcactttatactcgttattgcaatagtaagacttggagagggctgtatttattcattatgtttactgttgttgaatataactatgattt

SEQ ID NO: 7989 - DNA, 892 bp, Diabrotica virgifera
cgatccttcttgttgtgaacgtaatttgtgaagacttttcaccatttactttaatcttcctttttgttaaccaagtttgaagtgaatttaaatagttttgtaatttgttagaagctctatctgggttttcgtctgatgtaaggattcctgtatcgtcggcaaatgtggtcatagtaatgtcatcatcagcaggtatgtcagcagtgtaaaggagataaaggaatggaccgaggacacgaccttgaggtactccggattgtataggatgatatttggaaagtgaggtatttactttgatttcgaaaaatcgctcgctcagatatgattttaatatcaggtttatttcattaggcatattacttttcactttatacaacaggcctttatgaccttatcaagtgccttttccacatcaaggaatactgctgcacacatttccttttaaacgaatagggatgattatactttctttccattttgttggtatttgtttttcgtttttaacatgttgtgtgccttacttacttacttacttactccatggcgttacaaccctccgtgggttttagccgactcgacaacatgcctcctctcttctctgtcttgagcaacatctatccaattctccgcgcccatagctttcaggtctcctgctatattatctcgtcaccggagtcgagggcgtccgcatggtcttctttcagttgggacttcctctgttaccagccttactgttgtttgatcagaacgtcttctaaggtgtcctgcccattggagttttctggactttatttcttttataatgttggcgtctgggtaaagtgtttttgagctttttgttagttctagtatggtagctgtcgtgagacacaaattgtgtctcatgctgttt

SEQ ID NO: 7990 - DNA, 961 bp, Diabrotica virgifera
  misc_feature (424)..(454): n is a, c, g, or t
  misc_feature (704)..(704): n is a, c, g, or t
gaaaaaaatggtttaataagaataatttatacaaaagtgatatttatatattttcgttgacgcgttgaggatattgtgaaatatatcaaatagtgtcaacatttgaacaaatgactatatatgtgtaaaagactgtagtgatcaccagatccaaaaaagggtgtcttcaagaaatgtgttaaacccatgaatctttagaaaagagttaaattgaagatatgagtggccgaccaagaactacttcttttgcagagggcaacaagcaagctaagaatccacctttggggggtatgaaaatcagcagtaaggatggaagcaaagtgactacagtagttgcgacgcccggccaaggaccagacagacctcaggaggtatcatacactgacaccaaagttatcggcaatggcagcttcggtgtggtctnnnnnnnnnnnnnnnnnnnnnnnnnnnnnnnggtagcgattaagaaagtactgcaggacaaacggtttaagaatcgggagttacaaatcatgcgaaaattagaacattgtaatatagtgaaacttaaatatttcttttactctagtggagataagaaagacgaggtgtacctgaatttggttttggaatacatccctgagacggtatataaagttgcacgacactacagcaaatcgaagcaaactataccaattagcttcatcaagttatacatgtaccangttgtttcggtcactagcatacattcactctttagggatatgccatagggacataaaaccgcaaaacttgttgttagatccagagactggagttttaaaatatgtgattttgggaagtgcaaaacatctcgtcaaggcgaaccgaacgtttcatacatttgcagtcgatattacagagcaccagaagtaataattcggagcgatcgactacacgacaaaaatcgacgtatggaacggctggggtgcggttttggccg

SEQ ID NO: 7991 - DNA, 630 bp, Diabrotica virgifera
  misc_feature (9)..(29): n is a, c, g, or t
tcttgtccnnnnnnnnnnnnnnnnnnnnncttccttgcatgtttttttgtgagtaagtgtatctagggtagtagtgactgaatacatcgcttagatgtaaaccgggcttctataatagatttttgaggctaggacgtaggtaaccgggtcatccatggaaaaactaaacaggatatcaatgaaccctctgtgcctggtcattgcattgtgggtggcaacaacaggaataccgctgaaacatggcgagaaggcgcgtgatatgactggaaaacctgttatctcagatataatcaaggaagttgctgctcaaatcttggggaaagttgggatagacgctggctctgtagactcattatctgaccatgtcttgccttcgacaaaacgagagatgatgccaatctattggggttggaggcgcggggctacaggatgattgtgacttctacttccaggtgttatggaacgactgcgctttactctcatcctacttgaaactttctacaaagatgatgatcaccacccacccccagtggcctgaaaaacaaatcgtatcagctgatctcaggggaaatggagcagtgattggaaaactcgatctcgacttaatgacttagatatcacgcataccat

SEQ ID NO: 7992 - DNA, 459 bp, Diabrotica virgifera
  misc_feature (178)..(195): n is a, c, g, or t
tgcattccgggccccaccctcctgcacgatagaatataaactgatatgtataacgtgctatccaatataatctaccctttgctcaaattcgcgtgtaagttatattccccctgaatagctccctgatgtcaacattggtaatgtggttccttttttatctttgactgtacgtcacgannnnnnnnnnnnnnnnnncctcataacattatgtgaaacgaacgcggatgagtatagtatatagatatacagtatacatactgtatgagcacttcaacgttcgtttcctagattgcttgaatcagatagtgtggaatgagacgagcatattgagaaaagctgattggaacaactatatattggacacctggattgcaccttataaatcttcggaatgtctaacaaagcctttcggttgatctataattgtattttactgagtttgacctaatatccaccacc

SEQ ID NO: 7993 - DNA, 858 bp, Diabrotica virgifera
cccacgtgtccggaatgataggagctacggtttgggagcaacccttaagcttacagagaaggaacagagggtgaacaatgttcttatgaagtacaaactctcggagtatgatgctggattggaagatctggatacgtttctggccgctcaacattactttaaggtgaaggataagattcagtattcgaaagtgtttgatataataaagaggattcctaaaggtgcgtctctgcattcgcatgatgaagctcttgtgtcagaagactatttatttagcttaaccttcagagacaatctttatggttgtatagatggagatgacttcaagttatacttctttcaaaagaataacatcagcgattcgtgtaactggaaattgctcagtgacataagaaaatctgatgtcaggtttaaccgttttttgaaaacaaaattgacgataatcacagatgatccagagaagagctatcctgacataaacaaagtctggaaaacttttcaggcgattttcaaatcgattaatggcttaataacatacaaaccagtatttgaagattacttctacatggcacttaaagaactttacaacgataacatcaagtacatggaacttcgaggttttcttccgacactatatgacttagaaggaaacatatacagccaagaagaagtggtagggatctactcagacgttttaaagagattccaaagagacttccccgatttttttggcgccaaatttatctatgcccccagtcggcactgcgataactctacaatggacacatttgttgaaacttttaggaaaatcaaaaaactgtatcctggatttcgttgttggctttgatttagtgggtc

SEQ ID NO: 7994 - DNA, 886 bp, Diabrotica virgifera
  misc_feature (331)..(358): n is a, c, g, or t
ttgctgtgagaagtagtcgtgtatgtgtagctgctaagaaaaaaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcnnnnnnnnnnnnnnnnnnnnnnnnnnnncacactaaggtttgatagaatcatatttatttaaccctgaaagaaaatttaaatactcatttgctgaaggtttttattatatttcatgagtatttcattatacacttattgacaaagatagtgggtattttgtgattatagtgtgaagggaactttttttgtactgctatccttagcccccccccccagtgtcgtcatcatgattggctctacaaccaatggtgggtctttgcctgttccagaatcagcttccattcctccttgttcttcgcctttgattcccaatttcatactacttgtaaattgtcttccacctggtccttaaatcatattctgggcctgcctcttgtcgctccatccagtcattggttataaatgtgtttcgagggctccatttcattctctttaacatgttgacggacagaacatctaattttcattgatgtaatatgacacatgtataaatgttgctattttccctattctactttgcaaatatattatagtgtcacaacacttgcttataca

SEQ ID NO: 7995 - DNA, 115 bp, Diabrotica virgifera
  misc_feature (10)..(34): n is a, c, g, or t
  misc_feature (48)..(48): n is a, c, g, or t
  misc_feature (53)..(53): n is a, c, g, or t
  misc_feature (61)..(61): n is a, c, g, or t
  misc_feature (70)..(70): n is a, c, g, or t
gccagttcgnnnnnnnnnnnnnnnnnnnnnnnnnctggcacatctccncattntttagaanacttacatntttcatatgagtgctataccaggaagtattgcattttgatgatat

SEQ ID NO: 7996 - DNA, 899 bp, Diabrotica virgifera
  misc_feature (167)..(183): n is a, c, g, or t
  misc_feature (729)..(797): n is a, c, g, or t
gtctatccgtttcggatattggcgaccatcatggcaatctgcactttgcatactgctgctctaaaaatatttgtagtagctgtgttgaaccacgtacgtagatttttcagccaggaaatcctttgccttaccggtcctggctttccttctttttccctgcaggattnnnnnnnnnnnnnnnnntctttcactgttcctcatgatgtgaccgaggtattcgattttggttgtatttattttgattaacagctctttttctttttggattctcagcaaaacaccctgattagtaatggtcggtataagatatctttaggattcgacgatacagccacatttcagaagcctcaattttcttgcaggttgcgtctgtgagagttcacgattcaactccgtacaacagtataggaaagatataacatcgtagtaatctgacttttatgcgtatcgacaaatcatgacatttgaataattttgccattttttgaaatgcagatcttgctttctctgtcctacatttaatttctatggaatggtcccaattttcattgacgttcataccaaggtaggtgtatgtttttactttttctatttgttgaccattcacactgattcgtccaaattgctgttcattcttagatatcatcataaattttgttttcttagtgtttagtaaaagtccgtatttgaaagtagttgtaattaatacatagcaactccatctagcannnnnnnnnnnnnnnnnnnnnnnnnnnnnnnnnnnnnnnnnnnnnnnnnnnnnnnnnnnnnnnnnnnnntcggcgctgtagtcggcttctcttatatttccggaatactgccgcttcggaaagaatctacatctctcttgttaatcactttgttcctgtcctggcctactg

SEQ ID NO: 7997 - DNA, 932 bp, Diabrotica virgifera
  misc_feature (358)..(376): n is a, c, g, or t
  misc_feature (650)..(650): n is a, c, g, or t
  misc_feature (809)..(809): n is a, c, g, or t
  misc_feature (836)..(836): n is a, c, g, or t
aaagagtatgtggtgtttaatgttatttcgagtgggattatctatcttatttttctttcatacaacattagctcttcctgatgaatgtagttctatttcgcctgtaagaagttgtttactgaggacaaactacatagatatacggctgtggagatattacgctggctatttttgctacatttatacaaatgaagccaggttggatatcaaatataattccactagttacaacataacatgtggcggtgaaaacgcaacgattcccgtagcaagggtggaggagaacataatagctagttatgattatacagataaagaagatgtccagcatatcagaaaatcgtttaagactgacgannnnnnnnnnnnnnnnnnntcttgttgccaaggagctataaggtgttgcaatgatcacatggacgaggaaaatgttattccaacgcaatcacaatgtcctgtaatatgggatgcctggtcttgttttccacaaactaaagttaatactacagccaagctaccatgtagtagccaagcataccaatctcccgatgaagtctgtactttagaaagcgaaaaacactgcatctggaacggaacaaatcaaaaagcacaatggatccaacaaactgactacacaacgtgtgccatangcgccggtttacgaacgaagatacaacttccatattatatttctggggagtctgtatcggcttttgtataccggcaatatctatatttttctttttcgaaaaacttcgaaagaccatcagagttattctgcataggaaccttttgatagcccattgtgngtcaggaatgtcttgacaattatgtgncaagaactagtgctgctagacgctttaaaagcttcggctctaagtcatcgtacgatggacaacaatggagtcccatggtcggatattggcttttat

SEQ ID NO: 7998 - DNA, 923 bp, Diabrotica virgifera
  misc_feature (208)..(225): n is a, c, g, or t
  misc_feature (448)..(472): n is a, c, g, or t
  misc_feature (626)..(643): n is a, c, g, or t
tttacgattatttttatatttctcattataactttttttattgtatatttgggtatatacattgtctaacaaaaaagaaagcttattttctttactttgaaatggtgtattgtagggaattctaggactatttttaaacaatctatggttttttaaaatgtgacttatacacatgcaataggtcccactaagttggaaccatatggannnnnnnnnnnnnnnnnnctttatgataaaaaaaattctttataaaattctctgcatagtctaaaacttaagatgcaatcataagatataaaatgttatcaatagtgtacgaggtatgttaaaaaatatgaatttcgctcaagagtaaagtacctttatatttcataatatcgaaaagtgttattaagaaaaattatttggaattaaaaattatgttataatatgcaattacatttttctnnnnnnnnnnnnnnnnnnnnnnnnnctcaaattacggatacccttggatttcatacggatatcttgcttaaaaatggccctagaattttttgcaatacaccattttgaagtggagaaaatgagctttttttatttcacaatgtatatacttaaatgtacaaggagaaaaaacataatgnnnnnnnnnnnnnnnnnncattaaaaatatcaaggatcattaaaagtataaaaccttgaaagggcataacgtgcttagaaagagccgtatacccttgtacagtagaccattttaagggtatgtaattgacttttctttctactggatgtaccattgcatatacctacaactgcgtagaaaggaagttacagaacagtgtttgcgaaataacgggaaaaaatgcccagaaatgctgtaagctgcgaactttgaagatcctattttcggactgtaatcctatagactttaccaaacttcg

SEQ ID NO: 7999 - DNA, 1105 bp, Diabrotica virgifera
  misc_feature (3)..(23): n is a, c, g, or t
  misc_feature (299)..(331): n is a, c, g, or t
  misc_feature (398)..(415): n is a, c, g, or t
  misc_feature (1006)..(1026): n is a, c, g, or t
  misc_feature (1064)..(1085): n is a, c, g, or t
gcnnnnnnnnnnnnnnnnnnnnntgttctcctgatccaaccctttacatgacattgaagaaccccaatttgttttcatactaagaactcgacacttaaagagtgaatgccagacagtactttatatcagtaaaatcagcaattggagttacattactgtactacattacaagattatgtgtcttaatatttattgtaggagtgtatttttccatatacagtatgcgtcgcgctagtcgacacacgggtatagtcggttcactgagctcagacacaactggctggtgattttagtaagtnnnnnnnnnnnnnnnnnnnnnnnnnnnnnnnnntaattatgtactaatagttaataatcactaaatagttagtagttttgccaactttggcacaattggnnnnnnnnnnnnnnnnnncctactaaagtcactagccagttgtgtctagtttaaacagagtttagcgaaccgactatatctatgtaattactaggattatgggctaatgcatgtgactttcatgtctgtcatgtcatgtgaccttcatgtcatgtatgttatgtattttataacttttacaactgttctataaactgtcaactctctatctttatatacattttctgacatcctagacatttctaggttattcaaggacatctcgaatattctccaacttaatagttcttctttaagttagatatatgtaggatcaatctgtttacttcttggcataaaattaaacagtgtaacgagtgaagagtccaagactgtattagcgcaatgtgcacgtgtgtctagtagcgtgacggttactgtataacagttgctctaactctaaataatatataatagcaaagttttttgcttctcagatgttagactcaaaactttaaatttgtctgcagtatgattagtcattgtacctttgggccaaatatttatgcaatggttcaaataattggtttgggaaatcatttacttaaagctttaatagggatattgggnnnnnnnnnnnnnnnnnnnnngaaaaaagtggaaaaaatggtttcctggtgggaaaggnnnnnnnnnnnnnnnnnnnnnncttggaaatattgggcaatt

SEQ ID NO: 8000 - DNA, 371 bp, Diabrotica virgifera
  misc_feature (12)..(12): n is a, c, g, or t
  misc_feature (21)..(21): n is a, c, g, or t
  misc_feature (23)..(25): n is a, c, g, or t
ctagagcggctnattagctgngnnnggcggacgagggagcccctatcaaccacaaaagacaacaggagagaccacgacggcgcggcacacggcgcagacaacggagccggcaagtttccttctaggaccaccggagaagacgcaccccgcggcgacggccccacaaccaacggacgcccaagggatgaaggaggcagggaggagaggggacgaaaagacgcacacggaggacacgagggccaaagcgagggaggcgcccgcgcacagcaacaccccagggagcacggaagccacgccaaagggaaggacgagaaaaaaggcggagcccgcgcgacgccaaaaggggaaccacgcatttccaaatcaacccc

SEQ ID NO: 8001 - DNA, 777 bp, Diabrotica virgifera
aaacggatatatgcacaaacacgtgcaaaacatttaaagaagtatatttttgtactaatttttttctgattttattagctgacggtaccaaaaatcattattaaatggaaggatttgatcgtattcttcactaagcgttaagtttgaacaaaaactgaaattgtggctcccgatccttacctgtgcatcatttccagaaactggatattacgcaaaaagacctgtacagggacgaccaatgttaacaaacacggtgaaaggtctgtttcatagacttcgagcttcaagaaaggacagctactgctacagcattgactaggagactggtagatgttcatggtaccatagtttcacctgatactatacgtcgaagattaaatgaacaaaatatatcatatgtacctactgcaggctctttattggtagcagctcatcgaagaaaacgcctggaacctggaattgcgtcgttctcatgcaaattgggatatagaagattggagaaactttctgtttatagacgaatctcgttttactaaatatttacctgatggccgccaaataatgtgaagaaggcctggaccacactatgtccaatgttgcttagctcctaaagtacactgtggtggtggagatataatgttatgaggcggcatttctttggaagcaatatgcagtccgcacatagccaggataacaatgcaatacttgacagatttcagttattaagctggcctcctagaaagccagaccttaactatataggataaagcatttgtg

SEQ ID NO: 8002 - DNA, 772 bp, Diabrotica virgifera
  misc_feature (13)..(41): n is a, c, g, or t
  misc_feature (45)..(67): n is a, c, g, or t
  misc_feature (81)..(117): n is a, c, g, or t
  misc_feature (120)..(176): n is a, c, g, or t
  misc_feature (192)..(212): n is a, c, g, or t
  misc_feature (236)..(259): n is a, c, g, or t
  misc_feature (279)..(304): n is a, c, g, or t
  misc_feature (306)..(345): n is a, c, g, or t
  misc_feature (363)..(386): n is a, c, g, or t
  misc_feature (397)..(491): n is a, c, g, or t
  misc_feature (495)..(587): n is a, c, g, or t
  misc_feature (598)..(631): n is a, c, g, or t
  misc_feature (696)..(751): n is a, c, g, or t
tacgggggggggnnnnnnnnnnnnnnnnnnnnnnnnnnnnncccnnnnnnnnnnnnnnnnnnnnnnnttaagggggggggnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnaaaaaacacccaacannnnnnnnnnnnnnnnnnnnnttgggtaaaaaaagaggggccccnnnnnnnnnnnnnnnnnnnnnnnngaaaggggggtccttcctcnnnnnnnnnnnnnnnnnnnnnnnnnnannnnnnnnnnnnnnnnnnnnnnnnnnnnnnnnnnnnnnnnccacaccctccccttctnnnnnnnnnnnnnnnnnnnnnnnncccaccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcggcccannnnnnnnnnnnnnnnnnnnnnnnnnnnnnnnnnctcccctcccctcttttcttttcacaccgcagaaacaaagagaggcgggggccgcgccccccacnnnnnnnnnnnnnnnnnnnnnnnnnnnnnnnnnnnnnnnnnnnnnnnnnnnnnnnnctcccacccaccccccccccc

SEQ ID NO: 8003 - DNA, 696 bp, Diabrotica virgifera
  misc_feature (427)..(448): n is a, c, g, or t
tttgtccgaaaccatttacatacactgattatgtaggtacatatttgatatacatattggcatagtaatagtatgtaataaaactacatattggcatagtatgtaaaactacacattggcatagtatgtaaataatattattacgtatattcggtaacacttatttcgactagctatcaatgatcggttattagaatatcccggttataagaatatttttgccttgcacaaaggctattccaatgggcgggttcgactgtatataatcagttactcgttttaccctaaagtgtacgagaattactcccagggttacccctaagagtttacacttaaatttcatgtacaaattttccccacttctttttgtctcttgctaaaatctttgcttccgtccacgttttcctctcttcttaagtgcgtctcnnnnnnnnnnnnnnnnnnnnnnccttggtctgcctcttccacgtttgtgttgaattcttgcttcccacacttggttaactggtcggctgtcattcattctctgcaaatgtccccaccaacttaatttgttattttctacaaactccaacaccgacggaatttctaattctgctctgacatctacatttcttattctatctcctcctaattatccccctgaccttacgtaaatatttcctatccatcgcttgtattctgcttttttttctc

SEQ ID NO: 8004 - DNA, 136 bp, Diabrotica virgifera
  misc_feature (2)..(56): n is a, c, g, or t
  misc_feature (58)..(70): n is a, c, g, or t
  misc_feature (87)..(127): n is a, c, g, or t
cnnnnnnnnnnnnnnnnnnnnnnnnnnnnnnnnnnnnnnnnnnnnnnnnnnnnnnnannnnnnnnnnnnngaaaaaaaacctgtccnnnnnnnnnnnnnnnnnnnnnnnnnnnnnnnnnnnnnnnnncttaatttt

SEQ ID NO: 8005 - DNA, 523 bp, Diabrotica virgifera
  misc_feature (10)..(44): n is a, c, g, or t
  misc_feature (47)..(110): n is a, c, g, or t
  misc_feature (122)..(287): n is a, c, g, or t
  misc_feature (295)..(350): n is a, c, g, or t
  misc_feature (383)..(403): n is a, c, g, or t
cttcgtccgnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnngattttgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaagcnnnnnnnnnnnnnnnnnnnnnnnnnnnnnnnnnnnnnnnnnnnnnnnnnnnnnnnncagaaattcaactacttttaagttattatatgnnnnnnnnnnnnnnnnnnnnncattattagattataagaataaattaccttaaggatagcagcgtaattttattggagagatgcgatcttataatagagattgcgacctctatgttgagacaaatctactacatgaagata

SEQ ID NO: 8006 - DNA, 521 bp, Diabrotica virgifera
  misc_feature (312)..(330): n is a, c, g, or t
ttcggcctttttttcgtcagtttttcacttcacatcctttcttccccatatatcctactcattatttaccataacacatcaacctttcctcttttagaccctttcaaaaatacacagatactccattaagccttactgcctgctagtttgttgacagacggtatactttgatttaacgcttataggttctatcggggtaaaagaacaaaagatgtgcaaatgcgtctaaatttttttcgcatacttttaatcattaacaatttaagtgtaaatgggtgattgttagaattttcgactttcatttaaaaccgnnnnnnnnnnnnnnnnnnnctgaacaagatcacatgataagtcgtacgctcaaatgatacggtgtgaacctgtgagactcttagataagatttaagtatttagtgtcattgagtgatggttatttctgctgcagtgacatacttacaaacttctgctgttttaaaatgtataatgatagttttgtcaataaatattattttgagattaag

SEQ ID NO: 8007 - DNA, 507 bp, Diabrotica virgifera
  misc_feature (9)..(308): n is a, c, g, or t
  misc_feature (315)..(352): n is a, c, g, or t
  misc_feature (372)..(385): n is a, c, g, or t
  misc_feature (388)..(410): n is a, c, g, or t
  misc_feature (418)..(440): n is a, c, g, or t
  misc_feature (470)..(501): n is a, c, g, or t
cgagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8008 - DNA, 868 bp, Diabrotica virgifera
  misc_feature (22)..(47): n is a, c, g, or t
gagaagtaaagttttatctatnnnnnnnnnnnnnnnnnnnnnnnnnnagctcgcgatctacttttggacgcgtgacgcgtatgagggaataccgagacaggacacatgaaggagtaacagcagatcctctccctagtatagtaggttagacctatgtctcctacgccatcacatacaaccatgagatatcacatctagctatcaacagagagcataaaattcttaagtatggtgaatcagaagtatactcaccgtgaaattattgatgcaacgaatctgtaattcattgaactacattatgaaaacacaagcttaaaaaatatgattcctgatgatgatattaccagatgctcatcacccgttgttcgaaattagctgtagatttagatgatattcttcaagaaatgctaatattgtcatccccacctgattattatccattgttagtctctcgtcaaagcatacccagttaacttgcaattgctgttccatgacgatacatatctaccaggtgccactggagtactcctcctagaacttactgatgagggtagtcatgaacaaatcaatataaggcaccgcggatttcatataatctttactaaaacatctaataatctgcttactaatccgaacatcagaacgtccttcgctgaaactgtaaaaaaaacaagaagtcggtgttcatcacacattatctatgaattgaaaacttgcctgatttcgtcctcttaattttctaatccaacccacaaaacagagggactttttagcttgtgtactttatacaaactgaaaatttagactccctttttggtccccaataaaccctatgcttgctcaaattcttatcctaataaccatttcc

SEQ ID NO: 8009 - DNA, 920 bp, Diabrotica virgifera
  misc_feature (820)..(820): n is a, c, g, or t
ctttcttactaaaataagaaaattatttataactcttataatcgattgaaagtattttttaaactaaaatcgacactcagtttttttgacacctggacagatttcttttacctgcgcaaattacaagaatcttatctgtgactacattcaatagttgattaacagaaatttgttcattatatgtattaatcatctgtggtttataaaaaatgactaaaaagtaataacttaacaaattattattagagttttgtctctcagttacttataggcctgcaaataattaccttctgcatatttactatttaaaagaaataaaaatagttgattataataatttaaaaaaaggttaaaattttgtattcagttgataataatcaacagcaataatcagcaatcctaataatatcaataagaaaaccgtaaaaagtaccaaattgaaatcctaaatttggttaattttaacaatgtattgaatagttattatgtaccaattccaaacaacttaaaaaataaggctccaggcagtgatgatatattcacatagtattttaaaacacagaaaagcacagatctacatatctacagcctagttcaaggcatttgacaagaagaaacaatgcccgatgaagggaaagaagttattgttcttctccgacttcttccttgagcccttgtcatggcgtggtaacagatagacgggttcaagtagccaccagtcttcatttggtctgttcattgtgttgaagattttcctcttggtcttaggaattctacctttctattaccaatagttccattgcttccgttcttctgactnatgtggcgaagtaatttgggtatgctgggaaaaataaagcattgaccactttagctagtattctatgtgcttagctatgttgatattagctcttacggtc

SEQ ID NO: 8010 - DNA, 955 bp, Diabrotica virgifera
  misc_feature (36)..(53): n is a, c, g, or t
  misc_feature (725)..(745): n is a, c, g, or t
  misc_feature (780)..(780): n is a, c, g, or t
  misc_feature (863)..(863): n is a, c, g, or t
  misc_feature (872)..(872): n is a, c, g, or t
  misc_feature (939)..(940): n is a, c, g, or t
tggaattgtggcttgtttcccatttgaatgtacttnnnnnnnnnnnnnnnnnnagacaataccagtaggtaaccagtatgaagagaacaaattgttttcttagaaaaaatatttggagaatgttttaatatggtctcgtagcttattagaaccactaaaacttataacaataaacgatttcattaaaccatgcctattcatactataaacatatatctagttgatctgatctagtaaaatgttcatgcaaatctgaattaaaatatcaaattcatcaaaataagatggatacataaaaactaggttataatagtgttatggactagttctaaattcgttcgcggtgtaaataaatcctgaactgattctgaaccgcgcttgcgtacaacccgagtactaagagaattcgtaactggtcctggacgtgtacaggattgttaccgcgaacgaagcttttatttgtgctttttaagaatatgtttttaattcggatacttttataataactttaatagtattattaacatagtgcatacaacatacaatggtgtcctgttctcaacacagttggagtagcagaagcaatgtagataaaaaatctgcaggaataacgtttcaaaggttagtatgcaaatatgtaaacaaaggcatgccccgtatttcagaaaataaaatgcataaatcagaagaattattattttataagttaataattggtcatatcnnnnnnnnnnnnnnnnnnnnncgaataagccacaaacttcgcttattcctaactanaatagtaaataaagataataacaaaaggattataatttgtaaaattaaaataattcttcttggtgcgtttttgctaatgtatngctttatanaacaggatggtagaccacacgctataatagtaccaataaatggatacacagataaattatagtcggnntcgctaactcagtct

SEQ ID NO: 8011 - DNA, 938 bp, Diabrotica virgifera
  misc_feature (551)..(572): n is a, c, g, or t
  misc_feature (576)..(588): n is a, c, g, or t
  misc_feature (590)..(604): n is a, c, g, or t
  misc_feature (634)..(652): n is a, c, g, or t
  misc_feature (779)..(779): n is a, c, g, or t
gataaaaaaaagttgcttttgtgttccgtttggcccctaaagacgattctaaattcaaattaaagcagctagtccaaaacgcgtcgtgacgtcatatggttaatgtttacattctgcaccaacaaagtaaacaaaattgtatataattttaaattagacattataaacgtcatgcgtcagtagaaaaacagttagtgacgtcacaagtgtttttgatcgtttgaactattcatagaaaacttgtacttttacaaaatggttttattttccataggaaaccttctttcctttccttcaaaaactgtatcaaactccaatctcaacaaactggtatatattattacaatgacgtatgtacgataaatgtcattagaatattttttctcttattccgcgacgacgagctggccaaatacccaagtaggtggaggccaataaactaaaggagaagaagaatatacctaaatataaccatagatataaccatattgtaaaactatgtgacgtcacgggctgtttgaactacatatttcaatatcgcagtagatgtnnnnnnnnnnnnnnnnnnnnnntatnnnnnnnnnnnnngnnnnnnnnnnnnnnnctcatttttaaacaaaactgaacattattnnnnnnnnnnnnnnnnnnngcaagttccctattctccatggcaaagacacttatgggcagttgcattatccttatggaaaagttttgttttatttaagccgggtgtgcttttacaaatgcttgcgaccagatttattagaaattgngagtagtatttaccagttatggttttaccttttgcaagatactcaacagcaaaattcattttgtgttccaaaacaccaacgacttagttcctatactgctatttctttttagtagtggttcatccctatttcaatattctaccactgctttaaacgact

SEQ ID NO: 8012 - DNA, 972 bp, Diabrotica virgifera
  misc_feature (333)..(354): n is a, c, g, or t
  misc_feature (895)..(915): n is a, c, g, or t
ctggagcccgccaaggcatatatgaggtttgcggcgccgctgtgccgtaacggttgcttatgcgaaagaatcaataggacatagtttttggagtgaatagtggtctttgactttgtatgggttttgtttgcaaagaatacataggtaatgagaaaatcgtaaaaacatgctcgccaaggggtaggggtggtttctgcagtgtgttttcagggataggggtggttttagcagagatgttgcagtagccatatatatttttgaagggcgctgttgatgaggcgtgtgcccatgtggatcgaaaggcggaaaacagaaaaaagattcaaccccccnnnnnnnnnnnnnnnnnnnnnntacagggcaaacactgggaaattgcttttggtgtccatgcgtgggtggtggtagcgtgcacagggtgatatatgaggcatattaatgaagggcgttgtgtgtgagggattccaagaaaatcaatttatttattggttcttcttttttttggggtaattccggggaaaaaatgggggtgcattatacaggtttgtgaatggcaccagtacatgggtaatcgctgaaagtctttttgctctggaataaacgggttcggatggtagggaaaagaggttttttaaaatgtggcaccctgtaattgaaaggaagggcaattgcccttaagtgagacctataccgagggatcagtcagttatttgtgaataattgccgcgggattgcttcttagtttccgttacagttggggaaaggtatatttttttgaaaacatcttttttaaaacttgtcaaatttggggcgccacccccgctggacggtggatgatagagagatggtgtcggagggtaatcgtagaaggtatggtcctcttcatgtttctatnnnnnnnnnnnnnnnnnnnnngttacaggaaggggctgcgtttccgcaaagaaccacgatttgcccccctttaggggg

SEQ ID NO: 8013 - DNA, 206 bp, Diabrotica virgifera
gaggacctcacgcctgtagttacaatccctaatagtgtacccttttattctaatgtagattttgaactgcagattatacttattctcttaccatcccatatggtaaaacagaaattccgtatgaacatgtttgtcattggaccctttgattctgtaggatctgctgctattgccaatttatttcccaaatgtgagctgtgatcatg

SEQ ID NO: 8014 - DNA, 721 bp, Diabrotica virgifera
caagtagacgtgatccccaatatttttttcttctgtgtattacgactaagtgtttttgtattagatataagggctctactgcccgatgtgtaattttgatgatctcaagattttgacggtgctagggaaccataaactttagttgttaattgaaagatgacaatgcctgctaccctgaaaaaaacactgccttgattcttattataatgaatgatatttttaaattatacttatgaaataatgttaccaaagctgaaaacccatatcctgcatattctcccgacacgcgacgtggagttaccaaacatgcggctctcattggtgaaatcctattgttactaaatattatccagaccactgctggtgtcctccacaatggattagacatcaaggatatacggtgacctacctatcctcattttcgatgtgaacgatggtactttatgatgaatccatccttcctcttgcttacgtaatatctaaagaattatcgagtgctgaagacactaccttgttaggcgtgaactacgacaacaaagtggacaatcaatttgttgtagatttatatgagagagtaatacaacgatctaataaccataccacgggccctccgtcgattgagaacaaactgagagatagctgatggaaacctttcctcatcaacccaagcctacattgcaatcaattctctatttgagcgtattgacttctacacctctct

SEQ ID NO: 8015 - DNA, 908 bp, Diabrotica virgifera
caaagaccgtatagaggaaccgatactcagcaagaatttcttaatacgtgtttccgattgtttaataatttacaggtaattaattttaaaggtgaaatgtaacaccaagaataaaatgtgttaatggttggaaaataaccattaatggagtgattcatttgtggaatctactacagtcacacggaatggattattttttcacaagacggatgaatcaaaattgtctagaaaacttttttggttcaatcaggcagctaggtggcaattgtgttaaccctactccggtacaatttaccgcagcattcaaaagatatttttgtttagacaccatgcattccggtacagaaaattgcgaaagagatgccggcgatattttgttaaatttaaccgatatatgtaacgacgaatcacggcccgaaacccctgctttggttcctgaaaacactttggatgaccaagaatatcaaacatcagataaattacagaaaaacttcacaagatatatatgcggttatttaataaaaaagtgtcttaggaaacatgtttgtcaaatctgtgaagcatatgggagagagtacgatgaactagacgattcgtctctgttttgttacgttaaagcctacagtggtaatgaaacaaacgtttttggcaagctctatatgccgagccaaaattttgtgcagtatattacagatttggaaattatttttcaagaaaattttcaaaattttagtcatcaaccgaaaatcttacaaaactacgtcagtttattcgaaaaaataccatatacgcatccttgcagcaatttccaaagggttatctcattagattatatgctagaataagaatatattacacattaaaaacattaatagaaattttaaagtatctaagacaaaggacatagg

SEQ ID NO: 8016 - DNA, 1000 bp, Diabrotica virgifera
  misc_feature (24)..(41): n is a, c, g, or t
  misc_feature (722)..(740): n is a, c, g, or t
  misc_feature (808)..(808): n is a, c, g, or t
  misc_feature (862)..(862): n is a, c, g, or t
  misc_feature (877)..(877): n is a, c, g, or t
agaggttactgatcatttcttgcnnnnnnnnnnnnnnnnnngtcgcaaaaatggatgtagaagaacttttggactataagcctcctcaagctctaaaacgaccagtacaagttgacgaggaggaagatgaggccgaaagaaccagaaagatgagaagattagccagagctaaagctagtagaatggctagacctatatctcctacaccatcaacacaaccattggatcacataagtgaagaagagagagcagaaattcttaagtttgttgaaacagaacaaactcagggtgaaattattgatgaaacggctctgaaaaagattgtactaaattttgaaaagagaagcttaaaaaacagagagatgaggattaaatttccagattctcctgaaaaatttttggaaagtgaagtagaattacatgaaattcttcaagaaatgcgaatattggcaaccgcacctgattattatccattgttaatcaaacttcaagtcatacccagtttacttgaattgctgtcccatgacaatacagatatagcagttgccactgtagaactcctccaagaacttacagatgtggatagtctgaacgaatcagaagaaggtacggaggctttaatagaatctttactagatcatcaaataatcgccttactagttcaaaatttagaacgtcttgatgaaactgtaaaagaagaagcagatggtgttcataacacnnnnnnnnnnnnnnnnnnnttgactgaattgagctcagaaattataaacgaagccacaaaacagggacttttagcttggttacttanacgactgaaattgaagactccttttgatcccataagctctatgtttgtgaattntgtctatattattancaaataacgaaaaaatagattggcactcggagatacggacggtattgatactctatttgcacaactggggcttttataaagacacgatcctaccagttctgaagagcatgaactaatggaaaa

SEQ ID NO: 8017 - DNA, 960 bp, Diabrotica virgifera
  misc_feature (218)..(241): n is a, c, g, or t
  misc_feature (456)..(475): n is a, c, g, or t
  misc_feature (507)..(531): n is a, c, g, or t
  misc_feature (837)..(837): n is a, c, g, or t
  misc_feature (846)..(846): n is a, c, g, or t
aaaatgattgtaaaatcaagcaggaatgatattttaggatctattaacttcttgtaaattatatgatgtttattgataaacttcaccatcgaaaaaacataatttttcttcagatagtgaaaaactattgaggtaatgataataataaacaaatagatctacgattgactagaacatttcaaaaaaaaagttcaccaattataaagttcctaattcannnnnnnnnnnnnnnnnnnnnnnnagtctaaaattaagtgtacctggtgtattacacgtctgtgaactttatagtcggtgaacactttttaatgcgtttattgttggtaataaagagcataaagatgtagatatccaaacgtgttcgaatttgcacatcaatcagttacttttttagtgttccgggttttgggatgacagtatttgacttatttatatatcaacgtcattctcgaacgnnnnnnnnnnnnnnnnnnnntctacagcgaaacaaaaattacaagaaattgnnnnnnnnnnnnnnnnnnnnnnnnncaacagtttgaaggcgttttatgtcttaattgtccaacgcagtgtgaagcttatcactgagataagtaacttttacacattactcatccgtttcgaaggaccacctgtgttttttattattgtgaggtccagtaatatacaaatatacgtatataagacttcaaaatgtaagtagctcatcaaaaactcgagtaaaaccaaattttagtgcacatttctaagttttttattcgtagagaagaatcaaactgtaaatgtactttttaatgtagactttatgctgtgagtccactttttgtcaattanaaataaaanagaactgtgcacttttatgacaaaaaatacttttctttcccagaatatgttcagacgatgtattaatggtaaaaaatgtctattggactatttttttgtctgtcctacaacata

SEQ ID NO: 8018 - DNA, 957 bp, Diabrotica virgifera
  misc_feature (18)..(38): n is a, c, g, or t
  misc_feature (96)..(113): n is a, c, g, or t
  misc_feature (315)..(351): n is a, c, g, or t
aatgctgtgaaactggcnnnnnnnnnnnnnnnnnnnnncatgtcttgtttttccgagtacatactacttacaacgcttaaatgcaaatttacaacnnnnnnnnnnnnnnnnnnggttgtttagataaaagtgctattttattttggttattaaaatcccatcgtacggcaagaaatttgaacaaacgttttaaaaagcactctttttaatcaccaaaaaaatttaacaagggtattttttatatatgtttttcctctaaattttccgttaaagtggagcatgaagaatcgatatttttattcattttaaattacnnnnnnnnnnnnnnnnnnnnnnnnnnnnnnnnnnnnngtacatatggatatcataaaaatcttagtgagcgtttacatatttagaaatctcagtataccattcgtcttttactgatttttaataccaaaaatgttttatcaaactattattttctttaacagccgaaaaactataaacattttttgtagaaaaatatgtcattggatttaaatattatatcgaacaatattttttataggtaactgtcttacagtatttaagaatatcttcttagttcagaaaacactcattaatctttggcacttggttttaacactcctgtaccagatcttgttttttccattaaactttatctaatgaattctggggcctcaactaagaccaacagtttcctcattggtagttttaggatctcttctggttcaatcctcagttgaccagtgaattcctgcctcgataggcacattggaatggcatatgtgtatggcgatatcttcttccatttcgcattttttgcaccatggttcattcacctgaccaagtctatacatttatctgttttcttaaacgacaatgtccatcccactattttcggtccatcacactattttgatctctcgttttattgaggatcatcaaatt

SEQ ID NO: 8019 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8020 - DNA, 680 bp, Diabrotica virgifera
  misc_feature (488)..(500): n is a, c, g, or t
  misc_feature (503)..(533): n is a, c, g, or t
gccgcccttttacgctttttttttgtgacatacttgtgacttgatcttgtgaccttgtgaacttatgacataaattaatttacaacgtgacattggacatgtgtagttcaagatcaagttatattttgagtttagtgaaggatgtaaaaaatcgaaacgaagatgatcctgacgatccgttgccgctagcagctattatgtcaacttcaacaactactcctgttgttaactttgattttaataatagtgaggagcacgacaacagtcttgttttaactcagctttcaccagttcaacttactaatttcgacaataattcaggttctcatgacctcgacgttcaggatggcctaggcgtagggattgttcagcctattaacttattgccagaaagcgaagaccatcctgctgaaaatatacaaccgaaagacacccgagaggtaactaaaaaagggacaccaataattagaaaaaagtcagttttaagnnnnnnnnnnnnncannnnnnnnnnnnnnnnnnnnnnnnnnnnnnncatgacttgtatcctccttgccaagcttgtagactgaaatgcattgaaaatattccagaagtaagaagaaaacaaatcatttctgtgtattgcgcaagaagttggctagagagaacaaactttatgttgatttcgacaactaggtgt

SEQ ID NO: 8021 - DNA, 701 bp, Diabrotica virgifera
agtgacacatatgacatatatagtgtatttgtgcccaaagatgaatactatatcataacatgctgcccaactggccacatgcagaggatcaactaatacaccctgagctgggagacatgctgaaaacatataaatcaaaaaaacatttcaattcctgaatacctgatgaaaaaaatccctactattctacgtgaccttttggactccttaattaccaaaatgatctgaaaagagtactcttgttaaccaaatgcatttctccgcattttttggaggaaactcctatgatggctaatgagtcgaaaccccaaaccacttctatttggactcgcttatgcctctgacgatgaagctaaagatatatttaaatgtcagcaccagttcaggcttcatccctgagaagatcactaatcctttataatttatcaaactgcctcacttataggaacgctgtaacggattgcaaaagttaatatataacccacaccatcgtgataatctgaaagttcgtcagcgtatggaacgtacaatgacactgcaccagaaacgattgtccccaatagaatgtctcccttgtcatatgcattagaagtggcaagattttggcgacttttagcaaagcaggcccagccattaccactgagaggacatggacgacacaaagaggataatgtcgctttagacatagacttgagacccct

SEQ ID NO: 8022 - DNA, 610 bp, Diabrotica virgifera
agcggggcggaatatcgcggcgaccctttccccccgccggtacagacaataaaagccactgctgtcatattcttttaatacaagaattgacagaaaatttgcagtcgttgtcagtcatatgggtagcttcgttaaagaactcctatctccagctcgcacctgcgctaattggtaaaggtgattatctcctatagacaaagtcgtgaaattcttgtaactaaaatgcgtttcaaagcaagacgatgagcatcagagacaggacatattgatgagacgttcttagcaccgaatgcagatcaacagggcgttatagaatagtggtgcgtcagcagcgtgagagtgaaccgttagtacgagacttaagtccagatgttcacactgacaaagacaagtacaagaagtatctcaatgaaagaagcctacaaaaatacacaattcagaggatgctttatcaggatgctagaaacatgaggagagtcaccgaatcgacgaccctccttgatgaaattattctactgttggctccgcgaggctgcctggcctacaatcatctagaaggatgacctcataactacgagtctctgagcaggtcaactgagcagaccaaata

SEQ ID NO: 8023 - DNA, 977 bp, Diabrotica virgifera
  misc_feature (269)..(301): n is a, c, g, or t
  misc_feature (708)..(722): n is a, c, g, or t
  misc_feature (848)..(875): n is a, c, g, or t
gaaggaaaacacctttgatgattggaagtgtaaaggctaacacaggtcattgtgaaaacactgccgctatagtatccgtaataaagatcctcacagcttttgaaactggaatcattcctggcaacatacacgctgaaccagttgatgaaactctcaaaggaattaaagacggaactctacaggttgtaacaaagcatactgaatggcccaccggtcttggtgcagttaactcctttggaattggtggatccaatggacacgccgtgctnnnnnnnnnnnnnnnnnnnnnnnnnnnnnnnnntaatcgtaagcatcgtctagttcaagtttctggaagaactcaggaagctgtcaaccatttcttggatggcgttgtaaagaataaagatgatgaagaattcttggcactgctcgacgaaattcataaaatgaacatgaagagacatttctttagaggatatactgttcttggcaaacaacctgtaagaaacatttcaaagtacacatctgaacgtccattggtatttatatacagtggattaggcacacaatgggccggtatgggaaaagatttgttggaattcccagttttccgtagcacattcattcgatgtgccgctgctgtggagccatacggattagatcttatggacctcatcttgaagggatctgaaaattctgtcaatgacatcgtatttgtatttacannnnnnnnnnnnnnncaaatttctttaacagactttttgtactctttagatattagaccagatttctatgctgggcattcttcaggagaagtaggctgtgcttatgccaacggtgacttaacacctgaacaagcagtactnnnnnnnnnnnnnnnnnnnnnnnnnnnnaaaaaacaacaactggaggttggacaatggccgctgtgggtcttggggcagaacaattgaaaaaatttactggaaatatattgttgtttgcacaattctaaa

SEQ ID NO: 8024 - DNA, 818 bp, Diabrotica virgifera
  misc_feature (7)..(26): n is a, c, g, or t
  misc_feature (193)..(209): n is a, c, g, or t
attcccnnnnnnnnnnnnnnnnnnnngacattattagctattatgaacgatctgtcgaccgtctgtttctctcgtggtgcattagataagactcatcacccaaaaaggctagagtgtatcgtccttccatgattggtccaaccggagtcaaaatcgctaatgcatgctgggattagtactgactgcaacatgnnnnnnnnnnnnnnnnncaaatgcaatcaaacaagactgttgtaggaggagatgacagttatgatacattattcattgaaactggtgtcgtcaaacatgtacctagagcagcattcgcagatctggaagccaagaggagcatatgaagtacttaccggcacatactgaaacttgatgctccctgaacaactcatcactggtgaagaagatgtcgacaataactatgatagaggccactataaaataggcaaagaaatagttgacttggtattgaacagaatccgtatattaactgatcagtgccctggacttcaaggtttagtgactatccactccttcggtgctggtactggatctggcttcacttcactgttgatggaagaatctatctgtcgactatggtataaaatcgaaactggaatgcgccatctacccagatcactcttgtatctactgctgtgagacaatcatactactccgtcttgaccactcacaccactcttgaacattcagactgtgtcgttatggtagataatgaagccatctatgacatcagtcgacgtaatctagacatcaagcgtccaacctagaccatcttgaacagacttattgtccaaatcgtatcc

SEQ ID NO: 8025 - DNA, 895 bp, Diabrotica virgifera
  misc_feature (46)..(46): n is a, c, g, or t
  misc_feature (791)..(812): n is a, c, g, or t
  misc_feature (868)..(891): n is a, c, g, or t
caaacgaatacaaatacgaacaaagtatatcgatctttaagctcgntccttcctcgggtagagcagctgggtccttcagttacagagagcaataaaaagaaagacttcctagctagcttcatcctcgaaagaaaatacggtcagatgaaagtcagctagaaattcattcgatacatagaaaatttcaactacctaccctttctttcttcgatcggttattcaataatcgagccagaaaaaatgctcaaatgcataaatcggtccatgaactctcggaaagaaaaaaacttcgtacgatcattcttccgagaaaataattcgtaaataatcggcgttcgtacgaaaatccgaaacttcggattcagaaaacttttccgcttctctcgtcaagaaacaacttggctagaagttccaaaccagccatcgatctaattgcctcccgtttaccagaggaatccaaagacctttcccgtattggcccagaaaatcattgttgccgtagtaaaacaagcatgcagttccactcgttgaagaaaatttcggaaattgttagaaacccatcgtggcccttcgaaaaagagactttcgctttcttttccctagcttcggcagagaaaattcaaataccagttaattcgacgaaagcacagaaaacataactttccattcgaaaatcacttcacctggcttcaacttctccccaagaatcagggaatggcgccaaagcttcacatttgaagctttcctgccaaaacacagtcaccagaaaagctggcttgaaattccacgannnnnnnnnnnnnnnnnnnnnngaagaacggtgatggccttaacaaagcctaaatcatttaatgacaaaatggttccnnnnnnnnnnnnnnnnnnnnnnnncagt

SEQ ID NO: 8026 - DNA, 313 bp, Diabrotica virgifera
caagtgttacctaatctaaaaaatattaaaaaacgttcgccgcatcagctaccagaatcgcctcaaggctacaactccagcaagttagaaacatcgtcagccatctccggcccaccaaaaataaaaatctcctccgccgaaaagtttgtccatcggtattcgcctcggcagtaggaattgtagctcgtcccagcccgggtactagtcaacatcaaacactacaggggaggacctgctgaataaggggtttaaattatagttgtgtagtcaaatttttatgtaccattctaatttaagaataaatttattgatg

SEQ ID NO: 8027 - DNA, 882 bp, Diabrotica virgifera
  misc_feature (277)..(315): n is a, c, g, or t
  misc_feature (569)..(587): n is a, c, g, or t
caaagcttacaagaatcataaataaaaacaataacaaatacaatttactaaaattatacaaatcgtcaatataaataaaacataataaagtcaaataaaaatcagtaacaatctatcgcaaaattaaaaaaaaatcgcaaatcgcgtaatctaccttaagaaatttaataagtgatttaataagttatgccgctcgcatatcgacactcaaatatagattaagattctacttatacataagaatactgtaatttctagttattggttaagaaactcnnnnnnnnnnnnnnnnnnnnnnnnnnnnnnnnnnnnnnnggctcctaatattaaaaaaggagtacaacagagatgcctcttatcacacctgctttttcaacgtttactccgaaagaattttcagaaatcgccctttctgaaaaacaagaaggtataattttggatggtgaagtcattaataatttgcgatatgcggacgacacagtactcttagctttctgcttaaaaagatctgcaaatattacttgatagtgtcgttgatagctgcgagatagcaggtctggatctgaacnnnnnnnnnnnnnnnnnnnactagtagtaataagtaaacaacagaatataaaacagtctatattatgtaaatagtatcaaatttgaggaagataatcgaataatttacctgggaaataagttaaattataacgcagagactaacggtgggaattagatccagaatagagcacgccaaagtcccttagaaggatgtccaagatattataacagagacctaaaattggcattgaggatcagcctacttcgttgctacgggttctcggtcttactttattggtgtggagtcttttactgtgaatacaataaattgat

SEQ ID NO: 8028 - DNA, 939 bp, Diabrotica virgifera
  misc_feature (808)..(808): n is a, c, g, or t
  misc_feature (886)..(886): n is a, c, g, or t
ggaaacctatgagacacagaactactaccgcaaccacacaacgtcatccaaatcataggtacgaagacgaacacgcaaacgaagttcccaccagttcaagttcaaccacgtttccaagtaatggaataaacatagttcaacctccttcacttccaccaaaaatcatcaacgaagatcttttgagagctcaggatgagaagaaagaagtgtatattgaaaaagatgtgccagtatcgtttataccagtaaaggatatcgacttgagcgttggagatgataaagaacaggatgagaatgttcctttaatcgtggattttccagaagatctgaaaggcgtattaagtgatcttaatatggagtcggcactaaaacagaagacgaagaaacacaacaaatcaaaaacgaaacctactcagaagcctactcagaagccgactggtgagataggagacgagcagttaaataatttactggcaacactaaaattgctagctgcacagcaaacatctacaacaacaacgacaactcgtaattccagatgttagtgatgtagtcgacaatctttcaccagacatgaaagatctgttgatgaatcttggcctcattcccaatcccaacccacccaaacctgaaccggaaagcttgagtcaggcatacgaatcttataacccagaaaaagcagaagtcaaaccagattcctatacaggcttcaaacctctacctgaagataataacagtaggaatgaaatgcacgaactacttgctaggtttggtctgggtagaaacgcgagaaaacagaagtcgttanataaaaataaagagaaagatatagaaatggttcctgaaagagtacaaagattttagaggacattgggatttggtgaanaagatgaatacgtttcagctgagagtcagcaacatcgacaaatctaaacacgt

SEQ ID NO: 8029 - DNA, 926 bp, Diabrotica virgifera
  misc_feature (2)..(77): n is a, c, g, or t
  misc_feature (79)..(126): n is a, c, g, or t
  misc_feature (151)..(190): n is a, c, g, or t
  misc_feature (203)..(267): n is a, c, g, or t
  misc_feature (295)..(315): n is a, c, g, or t
  misc_feature (321)..(427): n is a, c, g, or t
  misc_feature (443)..(471): n is a, c, g, or t
  misc_feature (479)..(503): n is a, c, g, or t
  misc_feature (506)..(521): n is a, c, g, or t
  misc_feature (523)..(548): n is a, c, g, or t
  misc_feature (566)..(589): n is a, c, g, or t
  misc_feature (592)..(607): n is a, c, g, or t
  misc_feature (609)..(664): n is a, c, g, or t
  misc_feature (673)..(709): n is a, c, g, or t
  misc_feature (752)..(856): n is a, c, g, or t
  misc_feature (860)..(885): n is a, c, g, or t
  misc_feature (906)..(925): n is a, c, g, or t
gnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnggccgcggggggggggcggcgcgcnnnnnnnnnnnnnnnnnnnnnnnnnnnnnnnnnnnnnnnngggcggggggtgnnnnnnnnnnnnnnnnnnnnnnnnnnnnnnnnnnnnnnnnnnnnnnnnnnnnnnnnnnnnnnnnncccccagagggagaaaagggccgtgttnnnnnnnnnnnnnnnnnnnnnttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaaaacaagaagnnnnnnnnnnnnnnnnnnnnnnnnnnnnnctcttcgnnnnnnnnnnnnnnnnnnnnnnnnncgnnnnnnnnnnnnnnnnannnnnnnnnnnnnnnnnnnnnnnnnngccgcgccccggcggggnnnnnnnnnnnnnnnnnnnnnnnngcnnnnnnnnnnnnnnnncnnnnnnnnnnnnnnnnnnnnnnnnnnnnnnnnnnnnnnnnnnnnnnnnnnnnnnnncccgcccgnnnnnnnnnnnnnnnnnnnnnnnnnnnnnnnnnnnnnggggggggcggggggtgggtttgttgttgggggggggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnnnnnnnnnnnaggggggagaggggaaagagnnnnnnnnnnnnnnnnnnnng

SEQ ID NO: 8030 - DNA, 807 bp, Diabrotica virgifera
  misc_feature (8)..(29): n is a, c, g, or t
  misc_feature (119)..(144): n is a, c, g, or t
  misc_feature (162)..(232): n is a, c, g, or t
  misc_feature (246)..(802): n is a, c, g, or t
ctttttcnnnnnnnnnnnnnnnnnnnnnnatctcaacgataagttaaattcagtatccggcgagatgaatcactctctcctttctcaaaagaaaaaatctcactttctcgtacctcgcnnnnnnnnnnnnnnnnnnnnnnnnnncatcatcatcttaccacnnnnnnnnnnnnnnnnnnnnnnnnnnnnnnnnnnnnnnnnnnnnnnnnnnnnnnnnnnnnnnnnnnnnnnntaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 8031 - DNA, 932 bp, Diabrotica virgifera
aagtgacgtaaatccactctggatgcgtgaaaactacacttgaagaccacaaaaattaaatgtatgtatggtaaagtaggtactcagttaattgggccattttttaccgaaggaaatttaacgtcagatagtcacgaaatgttacttagaaatgaaattgtaactacactgagaaacttgtttgggatcagttttaatcagatatggtttcggcaagatagagctccaactcattttggtgtaaatgttaggcgttatgtagatgagatatttcccggacgatggattggtagacgaggtagaattgaatggcctccacgttcacctgatttcaatcctaaagattatttttattggggatacttgaaaaatttagtttacaaaactaaaccagaaagtcttgcagatgtacaagaattcatctgtactcattagatatcttttaaaaacaccctttaattatccacgctaatttctttcggttatttaaatgtcatcataaacaattccaaccttctttcgttacataaacattgttgacctagatcgtgaggtgtaattatacatacagccactataaacacttttcagggtcgacgctgactttgcacttttaaatatatttatacaaccaaaacataatgagggaatcctcattacacattccacattcgtcattctattttattagatgtaagattattcacattaaaagatagtgtcatctacactccgcgagacgaagttacgtaggttgctaccagcttatactcatgcgagtataataaaacaacttcaacagtgaaacgactattaatcattccacccctcggataagggttaccacccttatcgggagagatagccctagtaatctggactatcatatggcgatcctgccaggatttacacggaatagacctacctatagc

SEQ ID NO: 8032 - DNA, 472 bp, Diabrotica virgifera
  misc_feature (108)..(121): n is a, c, g, or t
  misc_feature (124)..(136): n is a, c, g, or t
aatttcttgcaataaacatgaaaaagtggaacgttctccaaacagtcgttacttctccgctcactgaaactaaaaacgatgctggtaaacctcaaaccgcagatatcnnnnnnnnnnnnnntcnnnnnnnnnnnnnttccaagaaataaaatgcaagaaatgccgtaaaaccatctttagcccagatcaaatcaaaactaacctaattttaaatgctcatggtcatccaatggacaattctagagtttgtgatattgacgttgaagaaaccaatgtatttataaatgacgagcaccttcctagttggataaaagatcgaatcgaagctgaagaatggtctaaaggtagaattaattgccctaattgtgattcaagaattggtagttttgattatgtgtctggacaaaagtgtgcgtgttttactaatttgttgcctcctattcattttataaaaagtaaaatagatttaatc

SEQ ID NO: 8033 - DNA, 653 bp, Diabrotica virgifera
  misc_feature (6)..(32): n is a, c, g, or t
  misc_feature (164)..(181): n is a, c, g, or t
  misc_feature (183)..(217): n is a, c, g, or t
  misc_feature (545)..(572): n is a, c, g, or t
cggtgnnnnnnnnnnnnnnnnnnnnnnnnnnncttctgcttttcattgaaagctgggatgaatggttgtatgaaacagaaactgtctttatttagattcatagagaattttattcttagggtacttcgctgaaatcttcttctaagacgatactaccctatatnnnnnnnnnnnnnnnnnncnnnnnnnnnnnnnnnnnnnnnnnnnnnnnnnnnnncacatttatttaatggaggtgattcacaaagaaatttaacttttgttatattatcatatcaactaccacttctttggtccaagtcttttgactatataattatattacctacaaggatggcagtcgtaattttattgtctagttcttatctataattgacactgcgacctcgactgttgtattcaatagactataattgagtgtaacagctatattattaattctgttcaactattaaaattttacctgatctgactttactccggtgtgagccatgctggtacctatcttcacccccttaccatatttaaccaccacaggaccatgnnnnnnnnnnnnnnnnnnnnnnnnnnnngatattaatctatggttaatatcagtaagtacagaatttatgattcattatgaattatgatcattgccgtccgatcttact

SEQ ID NO: 8034 - DNA, 867 bp, Diabrotica virgifera
  misc_feature (7)..(117): n is a, c, g, or t
  misc_feature (130)..(799): n is a, c, g, or t
  misc_feature (804)..(846): n is a, c, g, or t
  misc_feature (850)..(850): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgannnnnnnnnnnnnnnnnnnnnnnnnnnnnnnnnnnnnnnnnnnatanttttttgatccaatttt

SEQ ID NO: 8035 - DNA, 487 bp, Diabrotica virgifera
  misc_feature (33)..(53): n is a, c, g, or t
ggtcattataaaatagagtcaaaatataaagcnnnnnnnnnnnnnnnnnnnnnctcgtaacgcaagtttttgcttatcttattattaactatcaacgtcgtaggaacgctcacattgcatatagtgtgagaaaacagctgggacaactggattggatggaagcagagatcaggccagtataaatatgtgtaacttaataggatccagtctgagtgtagatatttacagtctgtagatctctgcttagtttctatggtagtgataatatacattgacaggcatgaggttataccctaataagagattactcttaaattggaatatgagaaatgtcattagatatctctctgatgttccactaccctattatatctttgcacaccgtcttatatctcatcattatccatgtggaatacaaaaagacatattgctactttccatttagtgctccagataactgcaatcactgaagcaactcgatattcac

SEQ ID NO: 8036 - DNA, 885 bp, Diabrotica virgifera
  misc_feature (306)..(320): n is a, c, g, or t
  misc_feature (871)..(871): n is a, c, g, or t
caccaaacttatttcttccaactcaactcttcgcagaatagtgctcatttatttggttctataagtgtagtgtcatcagcaaatctttgttaatatgtgagtgtataaaacgaatcaaaacacggaggtaattcattattctactagctagtcaatatcaaaatatatgttttccacacacttgtcttatgacctctatacacgtcattttggacctcaacaacaacgcaagaaagctcagactagatcagactgtcgtcccaacataaaccatgccgaacattacttgctgtcgacatgacagtnnnnnnnnnnnnnnnacatcagagcgagtaagtagtttaataattggtacttggttctattgggaaattcacaccgagaatacagtacggctaagatagggcaatacatttctaatggggaataaacgcacagggctctcggtcttcatcagttgttgattgatctctcaagagagtcgcacaagaactgtggcaacactgaatgcgcattcctaccttaaccatactgcaatcccagtgtgaatttcacgttagattcagtccagttaaaaagtcgtcaaacattacaaaaggtaaagtgactcaaagcagtataaaattgaagcagctgcaataaaaatatgaatttgcgaattttagttgatgaattctcgcggcatcttgaacgcttattgaatcctatcggaacaagtaatatcataaaaaaccagagtctacatatcaattgctgccaaatatgtacctattgtcctcttataggtattacagtttttattacgtccgactaattctgaaaaacaaatttgatatcagataaatacatatattatacctacctattatanaaatgtgacttaca

SEQ ID NO: 8037 - DNA, 889 bp, Diabrotica virgifera
  misc_feature (13)..(30): n is a, c, g, or t
  misc_feature (613)..(628): n is a, c, g, or t
caaagacctccgnnnnnnnnnnnnnnnnnncagtcttttccacaattactgaatgtgtggatggtatttttcgtaactatctctgtatttcctgctgttcaatcaggaatacaaagaagtgatgacagtttctttgttcccgaattcatttatgtgaatctgatgtgttttatgacctttaacatatttgcaatgataggtagttgtttgcctgccttttttgtatggcctagtccgaaatttttgtggattccagtaacggcccgaatcgtgtacatacctttgtttttgttatgtaattaccaagtgaagggcatccagagagttttacctagactgatcaccaatgactacgtatacttcttgttaagtgcctcgatggccttgtcgagtggctatctcagttccttaggcatgatgtatgccccaagatctgtggacgatcggtacgctcccacagctggaatgttttcggccgcagctttaatcactggaatcttctccggcattctaatagccttcttgtggccttgggtgatcggccatgttggcgcctagcaaaaatgtgtggtatatggcacagaaaaggagttcgcgattaggttcagtttannnnnnnnnnnnnnnntcatatgccccaaaatattattgttagttagcattttgtgaaccaaaggattgtaattataaatatacaaagggattacggaaaaaatagcgacaaaatgtgacactatgtatacagtttagtattatgtttatattggacgacgctggtaagcgtcgtgctgccatttttgtgaaggtccaatagggcatgccaacatgctgtcaaaataaatcaatatggtagccgggagcatacataaatgtattctatcagtcttat

SEQ ID NO: 8038 - DNA, 921 bp, Diabrotica virgifera
  misc_feature (23)..(38): n is a, c, g, or t
  misc_feature (328)..(356): n is a, c, g, or t
  misc_feature (471)..(492): n is a, c, g, or t
  misc_feature (874)..(874): n is a, c, g, or t
  misc_feature (886)..(886): n is a, c, g, or t
gtaagaaaggcttcatatgattnnnnnnnnnnnnnnnngaatgtcgtcgtgcgttctaaccctcgcacgtttaaattcttataatgtgaaacagcgctaaggtttgtgtaccgtttctttgtttctagagtgtcgtttctggtcgtggagttttttactaagttttcaactaatgtggacaacgaggaagcactttctgcattactaagacttcctcgtgcttatattaatacagcttctcatatagttttttgttttttactgtagacaatcttgtagaacatgagttttattgaaaattagacttcacttcctttctttcctttcnnnnnnnnnnnnnnnnnnnnnnnnnnnnntttttgtacccagtggttgtaatgcattgttttttagcttatagaccaggggtggccaagctccttgataatccgagccatttttcaaaatttgaaatttttcgcgagccgcaannnnnnnnnnnnnnnnnnnnnnaaagtgtaaaaaaagtataaaatttttctctcaatggtttggatttcacgatttttaaagtgaaataaaatggttcacaacgttgtttcaaatatggaaataattctacaagcagcctttactatttaagcatatttagattcttcatcatccttccatctttttctgggacggcctactgatcttctaccttctctcaaaaaaaaaactgtaacactctgtcttcctctgatcttaccacatgacctgcctatcttatcttagcttttataaatatgtcttacgatgtttttattaccatacagtcaatcatttcagttctgtcatttcatctctttgggggctaaatatcattctgagaacttttcttttaatacatcancatatttatttntcgctgatgtagagtccacgtttcacttccatatg

SEQ ID NO: 8039 - DNA, 531 bp, Diabrotica virgifera
aaccttgagaatcccgatctctgaggtattctgtattacgttcactcacctgtgttcactccccactggaaagatttgtggtgatcgtctgtgagcaatgttgacaggagtgaaggattaagagttagataaagactagataattcaccaactatacgaacaatgtatggaccggagcagaacgattgcatattcacaagaacatagaagccataatctactgaagacattaacccattatgagtaccacagaagtcaggaaaactctcatgtcctgcctcgcaacgtaatacactcatgcacaacgatttgggaagaacttccgaaaatatccaaaggtgtaacataagtatttttacaccgaatttttaaaagggcaaacactctagagcataccaccaaacaatcacgaataagtctggactcaaatcttctataatgtcaccactcgtcgaaatactgcagcgaactacagcaataaggtgcactaggaattcccagaacagcaaccaggttaatcccctttaatct

SEQ ID NO: 8040 - DNA, 925 bp, Diabrotica virgifera
  misc_feature (19)..(44): n is a, c, g, or t
  misc_feature (204)..(223): n is a, c, g, or t
  misc_feature (253)..(270): n is a, c, g, or t
  misc_feature (422)..(442): n is a, c, g, or t
  misc_feature (603)..(617): n is a, c, g, or t
  misc_feature (626)..(640): n is a, c, g, or t
  misc_feature (806)..(806): n is a, c, g, or t
  misc_feature (819)..(819): n is a, c, g, or t
  misc_feature (848)..(848): n is a, c, g, or t
  misc_feature (901)..(901): n is a, c, g, or t
aatatcgattatcttcggnnnnnnnnnnnnnnnnnnnnnnnnnnttcgtttagtaaacgcaatgggaaactaaaatttagctcgttagttcttacgtttcatattccggggcaatcttattaaacgtgattttcgcaaacgtaaatacatacattacattcaaataaattaagaaaatcgtacacacgttacgtagggtatttnnnnnnnnnnnnnnnnnnnngtttacattttcttctcgtcagatcagtgnnnnnnnnnnnnnnnnnngataattttacatttctctcgtccgtctcgtcggctatttcgctggtcagtccaattttagacacaatcgatttcaaatttgaaagaagaaaatgttaggttcggggttgaaaagttaggttgttgcggttgttgggttttaatcaggaatnnnnnnnnnnnnnnnnnnnnnctttttacaactctgacgaaaagatgaacatgaaagataattacttaaaaaataagtaaaaatgcgagtcaaaactttacgtctttcatacccttattatttaacgatatgccttgttgtaatgtttatcttttcagctattttaatcttctacatcttannnnnnnnnnnnnnnatggtaatnnnnnnnnnnnnnnnaactacttttactggcagttatatcaaagaaattgatcagctccaaacataagcttgcagttttggtaccatatagagagagatttgaagaattgatggaattcgtaccctatattgcacaattttttaaataaacagaaaatagtgcatgatattatagtcctanatcaagtagaccnagtttaggtttaatagagcatcacttatnaaatgcaggatttttgggaacaaagtcaaattatgatttatatcgcatgcatngatgtagatctgctacctcttaat

SEQ ID NO: 8041 - DNA, 874 bp, Diabrotica virgifera
  misc_feature (199)..(216): n is a, c, g, or t
  misc_feature (861)..(861): n is a, c, g, or t
aaaatacttctagtcaaaagttaattacaaaaacattacgtaaagaaggacttggtgcagatccaaataaacctccccgtaaaaaagccaagcttttaaggatagaaaggaaaaaagcaaaaggggcatctgttcaaaaaaactctactcccgttcaaccaaagaccctagaagagtttttggaagaaatatcagttgnnnnnnnnnnnnnnnnnnggatcaccgtggagcggatgtcaacgaccaatgatacatttaacttcagtgccaatttgtatagaaaatatcaaatcaaaattcaccaagatactcctgaggaatgcgatgaagagcagttttttcatttcctggtcgaatcacctctacagcctaaaagcttcccgaacaatgaagaaggtcccggatatggatcatttcaccaacagtattggttgaatgaaaagttaattgcagttggagttatagatatattacccaaaggagttagttccgtttattttttctacgatcctgattacgcttggcttaacgttaggaacatatggctctctaagagaagtagaattaacccggaaaattcagaaaagtctacccgagttctcctactactacatgggtttttacattcattcttggtccgaagatgaggtacaaaggaaaattgacgccatcttatttaggctggcctgaaacctacacttggatacctatagagaaatgtttaaatttattagaagctaacaaatattctaggttaaatgaagacattgatgcattagatactaatattcccagtgaggaggatattttacatattaagatcatttacaagagaagtttattatattttagcgattttanaaatttcgtggag

SEQ ID NO: 8042 - DNA, 866 bp, Diabrotica virgifera
  misc_feature (23)..(51): n is a, c, g, or t
  misc_feature (65)..(117): n is a, c, g, or t
  misc_feature (119)..(175): n is a, c, g, or t
  misc_feature (177)..(292): n is a, c, g, or t
  misc_feature (294)..(426): n is a, c, g, or t
  misc_feature (428)..(441): n is a, c, g, or t
  misc_feature (443)..(472): n is a, c, g, or t
  misc_feature (494)..(544): n is a, c, g, or t
  misc_feature (554)..(830): n is a, c, g, or t
  misc_feature (859)..(859): n is a, c, g, or t
aaaattcaaaattctttatccgnnnnnnnnnnnnnnnnnnnnnnnnnnnnncgtaacgaaacgtnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnncgcccaccgattaatttgaacnnnnnnnnnnnnnnnnnnnnnnnnnnnnnnnnnnnnnnnnnnnnnnnnnnncgaaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagaagtcanatcgata

SEQ ID NO: 8043 - DNA, 451 bp, Diabrotica virgifera
cccacccttgcgggcgcttgtaaccagcaaatatgccggacttgcaaggtcttctacttttattattggagggatctttgtacagcaatgcctaatcccctttcggcatcggtgatagaaagcgctgtagtaggcagtgaatcagtatgtgcacaagtaggaagggtaggtctaagagaaggaaagaatgagatagggacaggaatagtcggtgtacttctgtgaacgtgtatactatacggcaggagatgatggaagggaagagggcgaggccgggcactgaggttgcgaaacttgtataagaattgcacaattgcatgtgaagagagtctgtatctggagcaatccgagataaatgaggacggagaccaaaaggaggatgaggacgggatgcggcccgacagaaaaacgcagaggagaattatatgtccgaaactgctgcgataacagt

SEQ ID NO: 8044 - DNA, 508 bp, Diabrotica virgifera
  misc_feature (49)..(61): n is a, c, g, or t
  misc_feature (63)..(80): n is a, c, g, or t
  misc_feature (82)..(127): n is a, c, g, or t
  misc_feature (136)..(158): n is a, c, g, or t
ttctaggtggaggaagttaagagagatggggtgaatgattcataaaagnnnnnnnnnnnnnannnnnnnnnnnnnnnnnngnnnnnnnnnnnnnnnnnnnnnnnnnnnnnnnnnnnnnnnnnnnnnnggggaaagnnnnnnnnnnnnnnnnnnnnnnnatacaaccaacaaagacaagaacagagacaaaagaacaaggagagaggacaacaaaacaaaggatcacaaaggagcaaacgcaaaaaaagaaagagacaaagaaggacaacccaaaaagggaaacagccaaacaaacgagaaaaaaagaaacacacctaaggaaggaaatgacgacggaagaggaaacaagacagagaaatcacaccaacagacaagagagcggaagacaccgaaaagcggagaaaaaacgggaagaccacaacaccgaaaccggaacgaaaacaacgagcaactgcaaggatagttgctttacttatcggaatctgatagaattgttatatctactgcc

SEQ ID NO: 8045 - DNA, 877 bp, Diabrotica virgifera
  misc_feature (821)..(821): n is a, c, g, or t
  misc_feature (837)..(837): n is a, c, g, or t
  misc_feature (861)..(861): n is a, c, g, or t
  misc_feature (874)..(875): n is a, c, g, or t
caaagtttctgacaccgttgtagaaccatataatgctaccctatctgttcatcaactaatagaaaacacagatgaaacttattgtatagataatgaagctctttacgacattggtatgcatactttgaaaccgccatcgccctcttacggagacttaaactacttagtttctttaactatcgtcaggtgtgacaacctgtctaaggttccccggtcaattaaatgcggatcttcgtaaattggccgttaatatggtacctttcccccgtcttcacttcttcgtacctggatttgtgcctcttacaccaaagcaaagtattaagtatagagctttaactgttgcagagcttacacaacagatgtttgatgccaaaaatatgatggctccatgtgatccaaggaatggaaggtatttaacagttgccaccgtgttcagaggtcacatgtccatgaaagaagtcgacgaacaaatgttaagcattcaaaacaaaaatagcagctatttcgttgaatggattccaaacaacgttaaggttgccgtttgtgacattccccccagaggcctgaagatgtctgccacatttataggaaataccactgccattcaagaactgttcaaacgtatttctgaacaattctcagctatgttcgcaagaaaggctttcgtacattggtatactggagaaggtatggatgagatggaatttacagaagcagaatcgaatttgaatgatttgatatctgaatatcaacaatacgaaaacgctgcagtagatgacgatgctgattttgaagatgacgtggaagaagtcgctgacganaattaataattcctanaagtggtcattttttaataaattnttaattattttannat

SEQ ID NO: 8046 - DNA, 990 bp, Diabrotica virgifera
  misc_feature (5)..(760): n is a, c, g, or t
  misc_feature (767)..(804): n is a, c, g, or t
  misc_feature (826)..(826): n is a, c, g, or t
  misc_feature (840)..(862): n is a, c, g, or t
  misc_feature (870)..(891): n is a, c, g, or t
  misc_feature (894)..(894): n is a, c, g, or t
  misc_feature (925)..(948): n is a, c, g, or t
  misc_feature (963)..(986): n is a, c, g, or t
tcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagnttaaccggtgtgagcccaggtggttctatcnnnnnnnnnnnnnnnnnnnnnnnngaaagaccaatatannnnnnnnnnnnnnnnnnnnnnnnatat

SEQ ID NO: 8047 - DNA, 960 bp, Diabrotica virgifera
  misc_feature (866)..(866): n is a, c, g, or t
tagtgagatggatgtgcttgcattttatttactagtatgcctattcgtggctgagttttagtaagtgcacagcacaagtcactagcaacatcaagtttattccgatattttgttttaattgccaaaagtgttgaaaaaggcaaatataaatgaagagcttcccgtgatacactaagatacactttgaaatattttaaccaaaatgaaggtttgtccattataacaaagtatttggcggaggaatcatgcaaaaaatcatttggatttatttgcaaagcatcttcttgaagtgattcaggcagggagtctatgtttacatggaatggatcagttgacattctgtaaataaaattgtcacaaatgtttgggaagtatttctggaactcttcaattatgctctccaaatggtttgatatttggattttcaaaatttgatccttcataaaaatgtccttgaagcgtgtttcttctgagattggctctactgtagagaaatttgaataatttcaggggttttctgatattttacgcctccaaagttgagtaactaagcctccatcacaatgagtaactactatatttcttagtcttcaccctgcagttttaggttaaggctgttcaacgagtcaaagatgtctgacaaataagccaatattacttggatacaatgtttttttgaaggccatatttagctcattttgcttttgatgttccaaggtgattacttcatctcaaaggtcaaataatcttgccaacatgtttccttttgagagccatcgtacttctgtatgatgtggcagtgttgtgtgatcactttctaaatcttcacaaagagttttaaacagtcgagtatttagcgcactggntttttatgtaacttcactattttaatacacaactttaaaacagccagaagtcattttggaaaagttttttgtgccaggcttgtcgatgtatcaa

SEQ ID NO: 8048 - DNA, 202 bp, Diabrotica virgifera
gagtgtcttctatagaagaatgtaaatgcgattctcaggccggcgcccgaatacgagatgagtgggagaggcataggtgcgaatgcacttaatagacatgcaatccatgcacgttaagttgtgtgacctaataacggaaaggagagtacctgatgggacatccaagtagttgtcgattcgtgccatggaggatgggacgcgg

SEQ ID NO: 8049 - DNA, 878 bp, Diabrotica virgifera
  misc_feature (824)..(824): n is a, c, g, or t
aacgtgttgtagcaccagatagaaccgaccgtctcagacaaatacttaaaggtaaagcagactctttcggtatttctctccagaagatctggtagcggcaaacaatcgaaggagtacaaattctaagtcacaaatggaactcgagaatatcgtaaatacacctttcgattatgaagtcgttgctcgtagttgataagaaatctgggataaaaagccgacatcgatcttaagggaaagaattactcgccatcctggtcatggatatgaaaccgactggacaaagatcctggcaaatttctttgaagcatctgtgaccactccatcatgcgatccattactatcgttatctgagaacagagttaaagccacgtctgacttttttggagcagcttgtaagggtggaccttgggtacatcgatcccatccttgatatacaattaaagagaaaatatacaaatctttgcgatctttgtggcgatcccgaaaaatgttcaatgggatgataaatattggggacgaagaggatccctatactgtctcacagatggagccggagatattagttgggctcgtttggacgatgtcagacctcatttcggattggttcctggatctccagaagcatcagcagacggatactatttcttatgtcccaacgattctataatgcctctaaacagtacaaatccttgtgtttgggtcgttaaaccatggccagttgtagcaactagaaggacggtagcagacgacattcaaaaaatagtaagtcccttatcacacagtgacagaatttcgtggagatacagtttactgatgcttcttgnaacggcttatacaacgttttacaagcttgcaaacatcgatccctatcgagacta

SEQ ID NO: 8050 - DNA, 974 bp, Diabrotica virgifera
  misc_feature (566)..(578): n is a, c, g, or t
  misc_feature (581)..(597): n is a, c, g, or t
gtaaagaatattactaaaccaggaactttaagcacagaatccgctagaataaccaatcttaccccatcatactcacttacttcaccggccgtaagtgttaggagtacagataccgttagtcaacgcagtgatcggtgtagaaatcgtgacatcaccaaccgctccttccgttcccttaaatcgtaactccatcaaatgttactaattcttcaattactgtgacgtggtcacccccagataaattaaatggtccactcaatgcatattatattcattacaacaagggagtacagaaggtagatgcaattaataaaacgcataataaagaaattttaactggtctagagagttatacaaaatacgtgatatacatgcgagcttgtactggtagtatttgctcagaaaattctaaaaatgaaacagttgttacaaaaatgggagttccagcaaagatccccagaccatactcaaacggaaacgatgagaatattatacgctgggatagacccgatccacctagaggagatattaactattatcagttgagtataactcgcgatggtttnnnnnnnnnnnnnggnnnnnnnnnnnnnnnnnctaatgcccaaaattataccatagaaaactgtcgcgaagcaggactccacacgttcttttttgccgtaagagctgtcaatatcatcgacggagaacatgtcatggcaccatggagtgatacttccaagatatactgctatcgatcttcctggtatatattcatttacgtattccttggcatttgtggaatggtacttataggatatggacttaaaaggctctacatgtgtttggatatcgctagacacgttgaaatttaactacctcctggtctggcaccagctgtagaacatcacaacgagaagaagatggatataatagaaagaaatttcactaacgatccagatgaagaacttcttctgggaacgatgaatgaa

SEQ ID NO: 8051 - DNA, 315 bp, Diabrotica virgifera
gatataacaggtcttctaaagaaagaaggaactgcgactctcagggcgtcgcaaggatacgagatgggcgggagcggagtgctgcctaaccactaaatgtcgaagcagtcctcagacgttcaaagcaggtaacccaaaagctccaaggtggggaacgatctaacatctcagaagctgtcgacccgagccatggaggatgggacgcggcacatagacaaccactccggtgatcttgatagggagattacccgtatggagaaagcactcttgacaacactatcaacacagctcccttgaggatcctcagtgcttttt

SEQ ID NO: 8052 - DNA, 619 bp, Diabrotica virgifera
  misc_feature (209)..(226): n is a, c, g, or t
gaatttaattcttctctaaaataaataatgacgtccaaaaatccaattcgagtatcactttcaaagcaataatttctcaacagctttaaaaaggtttatacgagtatacagcctcccctcttcacgataaacggaccgttccacccgccacgaaatcaatatagtcggttcgctaaactcgacacaactggctagtgattatagtaggnnnnnnnnnnnnnnnnnncgaattttgccaaaattgggaaaattactaattatttagtaattattaactaatttgtaatcatttttttttgcccaattggcaaaattatcgactaaaatcactagccagttgtgtctgagttaagcgaacagactatattttaattacatgggaaatggatcagtaattatgtcttgatgtatgctgttactgtcttctaatggaaaaaatgtttgatgatttttgtcatattatgaatagcaacaacattttcatttataaatctttatatttctattgtgaagaaaataaagctattatgacatattatctattaatgttcgagaatatctgatgcaaccacatagaatagtatattagtttattacaaggattataacatgtatcaat

SEQ ID NO: 8053 - DNA, 443 bp, Diabrotica virgifera
tactctccggaagaactggaatgcgcatcccatgcgggtgcaccaattctagactcgaaagaactgagagctgcatgtgacctttcggttatgaagtcggtgcagtataagataacaaaactggaagtgtaagacggcgtgatgtggaggtatgtctgtaatgccggactgtccatggacgcgattccaagtgtacaaaaagcctggtcgtgagccctgaaggatctgtgaacgattacttacgagcaattgcttactatcaatagctgccgagagagttaaagacacgaatgacttttcttgaagcggcttgcaagactgggccctgtgtacttgatgacattgttgatacacggttaaagaagaaatgtacgaatgtctcctgacatcactggagatgcggaataatgctcactggttggaaatattgacgataagaaagc

SEQ ID NO: 8054 - DNA, 281 bp, Diabrotica virgifera
gggccggaattcccgggccggcccccccccccgccggctgcaagccgccggaacttgacactacgtatcctctatacccgctcagcatctgaacactctcatatctgctgtaagctgcagtagaattaaatagctgccgatgtattgccagccgtaataccaaatttcctagaacggcatacctacatatgcatacaacccaagatctgtcgacgactcccccacactgctaagtggctcttgcagcatcggagtcgattcctgaatccaaggcccgcccg

SEQ ID NO: 8055 - DNA, 120 bp, Diabrotica virgifera
cacgcaggtgataacaattatacgtttacaaattcaatatctaaataaatcgaaactagggtgaaatcaaatcctggtatcatcggacaaatggacatccatcatccatagggaaataat

SEQ ID NO: 8056 - DNA, 73 bp, Diabrotica virgifera
  misc_feature (52)..(52): n is a, c, g, or t
ggaagctggacgcctgcagtccggtccggattccgggtcgcccacccgtccngactcgttcagtgtcaacgta

SEQ ID NO: 8057 - DNA, 940 bp, Diabrotica virgifera
  misc_feature (478)..(496): n is a, c, g, or t
  misc_feature (774)..(774): n is a, c, g, or t
  misc_feature (835)..(835): n is a, c, g, or t
tgaaaccgtacagatattaagtatcgagttcagaactccaaaattttttcggagtatttaactccaaatcgaatttttttcgggtatcggagtatttaagagtattttttttaagtatttttcggaaaaacgaagtaaaaccgcaaagatattaagtatcgagttcagaactccaaaattttttagagcatcgagtccaagagttttccaaaagtactaaaggtaaatcgtggggtatgtggtatttttgagaaggtaattgaatgaccttcgaaatgagctatcgctcaacccccctttccattagagattttggggttgtgtccgcccccgctggagggttgatgtagtttcgttgaagactggtctacgaaatgtccccctgacaaataaatttgacgtgtttttgtatatttttggattttttatagggagtggcaacatttcaaattgacacactgtatatattttaaacacnnnnnnnnnnnnnnnnnnncatcttcttcttcctctttataagcaattctgcttgttgattgggtgattgtagctctatggacggttgtcattccatcttttgcgcggtcgtccgattactgctactgtccgatttatctcttactattttgactacacaggtctcctccgttctacttatgtgcgtattccttttttcctttcagtgtcctttcgtttacgaaatcgtcgaaaatgtaacgtacactgtactttacattttcttctaatgtcttcactacactgtcgatctcttangcataatagagggttgatatttcgagtaatataagtttttgggacttgaagagaaggaaancaaacattttttcgagttttagcttttcgacttgatatttcttagaaatccttctctgtttacgagatctcgtagttttttatgtcagctcttctcaggtcccct

SEQ ID NO: 8058 - DNA, 543 bp, Diabrotica virgifera
acactagcagtatgtaaatggataaacaattatgtcagctacaaactgtacaatgtcaataaacatgaccaccatatataccgtttaagatgatcagatgagattttcatcaaaaggactattataaacgacatgctatattttatctcacttaatcgtcaaccctaacggtactccaacgttaacgatatataaaactgtctgtgcggaacttgtcgtgaccttcgtacttaacagactagataattggttaccgctgtggagtcatgacgacaaacgttgttcgaagataaaaaatactgaaggtgtgttttaccaagatctaactaatgatagactaatctttagatttatcaattccatggcctcgtcttataagatatcacctatcgacgagtgtctattttgtgctttgtcacacactgttcagtccggtactaccttctcttgctagattatatagacacccttcttctgatactacctatgcctttatttatagaacatttttaccagctgataattttgatattatgataaatg

SEQ ID NO: 8059 - DNA, 758 bp, Diabrotica virgifera
  misc_feature (9)..(26): n is a, c, g, or t
  misc_feature (45)..(66): n is a, c, g, or t
  misc_feature (121)..(152): n is a, c, g, or t
  misc_feature (158)..(194): n is a, c, g, or t
  misc_feature (198)..(228): n is a, c, g, or t
  misc_feature (240)..(757): n is a, c, g, or t
tctttttcnnnnnnnnnnnnnnnnnnctttcactaacgatagttnnnnnnnnnnnnnnnnnnnnnntctctttctcttttctcaaaagaaaaaatttcactttttcgtaccttcgtgtatnnnnnnnnnnnnnnnnnnnnnnnnnnnnnnnnctctcnnnnnnnnnnnnnnnnnnnnnnnnnnnnnnnnnnnnnatcnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8060 - DNA, 807 bp, Diabrotica virgifera
  misc_feature (41)..(69): n is a, c, g, or t
  misc_feature (86)..(197): n is a, c, g, or t
  misc_feature (199)..(525): n is a, c, g, or t
  misc_feature (527)..(560): n is a, c, g, or t
  misc_feature (586)..(605): n is a, c, g, or t
  misc_feature (618)..(806): n is a, c, g, or t
cttaacgatagttaattagtattctgagagaatctctttcnnnnnnnnnnnnnnnnnnnnnnnnnnnnngtacctcgtgtatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngttattaaaacatgtcttttgtattnnnnnnnnnnnnnnnnnnnnactgatttattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 8061 - DNA, 89 bp, Diabrotica virgifera
gcgatttcactataggacacacctgcagcgccgtacatttctctgctgataatttcaatcttttctttaattggtcggttaagttgata

SEQ ID NO: 8062 - DNA, 646 bp, Diabrotica virgifera
  misc_feature (489)..(514): n is a, c, g, or t
gtcaattgatcacagtgaatcttaattagttttcgtgtacagccggcaaatcaagatgactttaacagaactcctgggaaagaaatacaagcttgacaaaagcgagaatttcgacgaatatatgaaaaaactaggtgttggattggtgacccgcaaaatgggagcaacagtttcacctgtagtggatctacaaaaggaaggcgatgagtatattctgtcatcgatatcaacctttaaaaatgtaattctgaaattcaaaccaggagtggaatttgaccaagaaactcctgatggccgtaaggtaaaatctaccattacaattgatggaaacactttgcacgaagtccaaaagaatcctagtgggacagaaactgtgattgataggacattttccgctgatgaaattaaaatggaaatgtccgtgaacaacgtcaaggccaccaggatctacaagattcaagtttgatagtttatgcttacctaataagnnnnnnnnnnnnnnnnnnnnnnnnnnctggtccgatacgtagtgattataccaaaatgagtttgtttatctatactttttattactttattaaatttgtactgatttgtaattatgtatgtagtggaatatatactcatggaaataaaagcatagaat

SEQ ID NO: 8063 - DNA, 898 bp, Diabrotica virgifera
aaaatgagtttttaacatattttttaaatttcgtacacgaggatattagtattcacagtaaatctggaaccatttctcaaacacgtacacccagaaagataaaacctactacaaacgagcagaaaacgctaaggcaacaaatcaatttaatagaaaaatcatcaacttttcctggttcgtctgtaaagtcacttcgacaaaagtttcgtagacctttcatgcaattcaaatgtaagcactccaaaatgtatcaaaaacaactcggactcacgtttaaatttaagttactatagtccagtatctccactttatagtgaacatagttttaataattcaaaaggtaaaaaacatactgtttgtcttggagattttgttattacaaatgtaatgaaacctacaaagaagaaaaccccactgaaaaaaggaaatgatgatttcaacaagaggattactccaacaagcattaataacatacctactaatgaagcttttaaatcgtccaatagttttaatgagtttaatacaaaagcagttggttgtgataatgtaaatacatctagaatgaatttagctaaggaacgcttaaagtttttaacgaggaatgattcagatgatagatcagcatgggttagttcaagaaagataatactacctgatcaaagagaacaaattgagcctcagttggatttaattacttataaaaatgaattaactattttgtcagatatttatatccttatattaaaaaacaacatggtattaaacattaccggagaaatatattttttgacatctttgttagttagtaaacaatacatttcagaatcagtttgatgatcacatgtaggaatagattttttaagtgaggatgtaaaacatgagtttacatcaaaaagca

SEQ ID NO: 8064 - DNA, 68 bp, Diabrotica virgifera
tgcagtacggtccgaatccgggtcgacacgcgtcgctcaagactgcagcagcacactagtgacaaatc

SEQ ID NO: 8065 - DNA, 828 bp, Diabrotica virgifera
  misc_feature (162)..(183): n is a, c, g, or t
gtaccaattagttcggattatcgacgctctaccgtatatttaaattttacaaacgtttacggaattcgatcgtttccgttagtacgacgacttcttacgtagtgattcgccttaagaaacttaaacaccgaatttatcgtccagatatttacacgtcgtagnnnnnnnnnnnnnnnnnnnnnnggtcttaaatcgttaaattagatatatggatatgatgtgtataaataataagcggcctttaacgttgtttaataaggttccgtcagtcttcaatatatctaaaaatcatgggtaggaggagaaaataacattcgatacatatctctttagattattagaatctaatttaaagaaaaggtataccggtgttgtgttctatgatatataatatgaatagaatcaaaaccattacttcttattttattgcagatataccatttttatctttttgttcttgagtatagtttaagtttaaagcattttgaaattgcagatagagatgtaactaccaggtttatactggctgactgtttcgcatttttgattcatgattttcttctattataggttgattctgcgtgactttatctattggtcatatcagttagatctcagggtatacactcttcagcttgatatgattttcaaattacctgttgatatatgattttggataaaattttataaatagcgcatatcaatgatctataacaagttttcttttcaagatgtgcagtttctaactgaaagtgaagtagtctgtgcaacaaatatattatgttctagatgctaatgccaagcatctgaacaacaggagtatatctg

SEQ ID NO: 8066 - DNA, 862 bp, Diabrotica virgifera
  misc_feature (9)..(28): n is a, c, g, or t
  misc_feature (99)..(132): n is a, c, g, or t
  misc_feature (266)..(353): n is a, c, g, or t
  misc_feature (357)..(374): n is a, c, g, or t
  misc_feature (386)..(565): n is a, c, g, or t
  misc_feature (568)..(678): n is a, c, g, or t
  misc_feature (680)..(766): n is a, c, g, or t
  misc_feature (768)..(853): n is a, c, g, or t
gtccgaatnnnnnnnnnnnnnnnnnnnngaaaaatttatctttctcgtaccttcgcgtattcagggattcttaattaatcattctctctcttctcctcnnnnnnnnnnnnnnnnnnnnnnnnnnnnnnnnnnctcttcggtaaaataaatcttttcaatcattttttctaacgaaacttcttcgttttcaattatctaattttttcaagaataaattaaatttctttcttcaacaatctatttctaattaaatctttttctattcnnnnnnnnnnnnnnnnnnnnnnnnnnnnnnnnnnnnnnnnnnnnnnnnnnnnnnnnnnnnnnnnnnnnnnnnnnnnnnnnnnnnnnnncatnnnnnnnnnnnnnnnnnncattaattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnaaaataaat

SEQ ID NO: 8067 - DNA, 1000 bp, Diabrotica virgifera
  misc_feature (146)..(169): n is a, c, g, or t
  misc_feature (182)..(199): n is a, c, g, or t
  misc_feature (233)..(255): n is a, c, g, or t
  misc_feature (481)..(501): n is a, c, g, or t
  misc_feature (580)..(599): n is a, c, g, or t
  misc_feature (664)..(712): n is a, c, g, or t
  misc_feature (805)..(805): n is a, c, g, or t
  misc_feature (845)..(845): n is a, c, g, or t
  misc_feature (852)..(872): n is a, c, g, or t
  misc_feature (880)..(880): n is a, c, g, or t
  misc_feature (896)..(896): n is a, c, g, or t
  misc_feature (905)..(905): n is a, c, g, or t
  misc_feature (913)..(913): n is a, c, g, or t
  misc_feature (923)..(924): n is a, c, g, or t
  misc_feature (929)..(929): n is a, c, g, or t
  misc_feature (947)..(947): n is a, c, g, or t
  misc_feature (958)..(958): n is a, c, g, or t
  misc_feature (979)..(979): n is a, c, g, or t
  misc_feature (993)..(993): n is a, c, g, or t
  misc_feature (996)..(996): n is a, c, g, or t
ctattcgtttgagccgtcgtaattacagcaatccttcttctattatctttaccagttttagccggagctattacaatattattaacagatcgaaatttaaatacatcatttttcgatccagccggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatganatattgtatcttctattggatcactaatttctttaattgnggtattnnnnnnnnnnnnnnnnnnnnnagaagctntttctttttcacgaanaagattaangactttangaaatacttnnctcanttgatgactacaatttancccctcagctngacacagatattctgaattgncaatattatcatcnaanttat

SEQ ID NO: 8068 - DNA, 720 bp, Diabrotica virgifera
  misc_feature (5)..(80): n is a, c, g, or t
  misc_feature (82)..(110): n is a, c, g, or t
  misc_feature (114)..(221): n is a, c, g, or t
  misc_feature (225)..(251): n is a, c, g, or t
  misc_feature (253)..(283): n is a, c, g, or t
  misc_feature (287)..(348): n is a, c, g, or t
  misc_feature (354)..(379): n is a, c, g, or t
  misc_feature (389)..(408): n is a, c, g, or t
  misc_feature (530)..(634): n is a, c, g, or t
tgggnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnntccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatannnnnnnnnnnnnnnnnnnnnnnnnnnannnnnnnnnnnnnnnnnnnnnnnnnnnnnnngcannnnnnnnnnnnnnnnnnnnnnnnnnnnnnnnnnnnnnnnnnnnnnnnnnnnnnnnnnnnnnaccccnnnnnnnnnnnnnnnnnnnnnnnnnnggggtgggannnnnnnnnnnnnnnnnnnngccgcccgccccccccacacacacacaaacaaaatttcgtttcttcttttctttttttatttcgctctccccccccgacgggtgcattgaagtattcttttaagttttttttcgtggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgccgggagggggggggcgggcgggaggggtggcgagggcgtggacaaaaccacgaaacaacccacacccacccccacccccac

SEQ ID NO: 8069 - DNA, 154 bp, Diabrotica virgifera
  misc_feature (10)..(134): n is a, c, g, or t
ctcgttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatccatttttttgatta

SEQ ID NO: 8070 - DNA, 200 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (163)..(194): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccagggttggttnnnnnnnnnnnnnnnnnnnnnnnnnnnnnnnngaaagg

SEQ ID NO: 8071 - DNA, 822 bp, Diabrotica virgifera
  misc_feature (11)..(28): n is a, c, g, or t
  misc_feature (62)..(84): n is a, c, g, or t
  misc_feature (310)..(330): n is a, c, g, or t
  misc_feature (409)..(428): n is a, c, g, or t
  misc_feature (493)..(541): n is a, c, g, or t
  misc_feature (681)..(701): n is a, c, g, or t
catcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttctttttcaacgaaaaagattaagacctttaagaataacttcttcaattgaatgactacaattttaccctccagctgaacacagatattctgaattgccaatattatcatc

SEQ ID NO: 8072 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8073 - DNA, 208 bp, Diabrotica virgifera
  misc_feature (3)..(27): n is a, c, g, or t
  misc_feature (33)..(33): n is a, c, g, or t
  misc_feature (101)..(101): n is a, c, g, or t
  misc_feature (157)..(178): n is a, c, g, or t
cannnnnnnnnnnnnnnnnnnnnnnnnaccttnagggataacagcgtaattttatattggagagttcaaatcgataaataaagattgcggaccctcgatgnttggattaaaagtttataatttggtgtagcagctataattattaagtcctgtcaannnnnnnnnnnnnnnnnnnnnnaagttaaaccggtggaagccaggttggttc

SEQ ID NO: 8074 - DNA, 498 bp, Diabrotica virgifera
  misc_feature (3)..(45): n is a, c, g, or t
  misc_feature (62)..(96): n is a, c, g, or t
  misc_feature (99)..(167): n is a, c, g, or t
  misc_feature (195)..(248): n is a, c, g, or t
  misc_feature (261)..(290): n is a, c, g, or t
  misc_feature (293)..(333): n is a, c, g, or t
  misc_feature (353)..(447): n is a, c, g, or t
  misc_feature (454)..(496): n is a, c, g, or t
gannnnnnnnnnnnnnnnnnnnnnnnnnnnnnnnnnnnnnnnnnnctttttccctccccccnnnnnnnnnnnnnnnnnnnnnnnnnnnnnnnnnnngannnnnnnnnnnnnnnnnnnnnnnnnnnnnnnnnnnnnnnnnnnnnnnnnnnnnnnnnnnnnnnnnnnnnccgccgcccggccgccgggcgaggaggnnnnnnnnnnnnnnnnnnnnnnnnnnnnnnnnnnnnnnnnnnnnnnnnnnnnnntccccctccgccnnnnnnnnnnnnnnnnnnnnnnnnnnnnnntgnnnnnnnnnnnnnnnnnnnnnnnnnnnnnnnnnnnnnnnnnaggggagggcgcccaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgcnnnnnnnnnnnnnnnnnnnnnnnnnnnnnnnnnnnnnnnnnnngg

SEQ ID NO: 8075 - DNA, 393 bp, Diabrotica virgifera
  misc_feature (5)..(44): n is a, c, g, or t
  misc_feature (52)..(79): n is a, c, g, or t
  misc_feature (122)..(151): n is a, c, g, or t
  misc_feature (172)..(199): n is a, c, g, or t
ccccnnnnnnnnnnnnnnnnnnnnnnnnnnnnnnnnnnnnnnnngtgggggnnnnnnnnnnnnnnnnnnnnnnnnnnnnaacccacgtaaattggcgggggttaaattttttcccaaattcnnnnnnnnnnnnnnnnnnnnnnnnnnnnnngaccccttacatagcgccgannnnnnnnnnnnnnnnnnnnnnnnnnnncaaagggaaaactaccgggccacacaacaaaacccctagcccccccgaaagctggacgaaaaacagcaaaaagcgaagtatcgggagaaaaatgaaagagagctgattagcgccacaccgcaaacaacgaccacgaaaacccggagaaagaggatgtatatcgaaatgagaaagatagggaaaaaaagacttca

SEQ ID NO: 8076 - DNA, 788 bp, Diabrotica virgifera
  misc_feature (457)..(474): n is a, c, g, or t
  misc_feature (562)..(584): n is a, c, g, or t
  misc_feature (745)..(745): n is a, c, g, or t
aaaaaccgttatcgtctccgttaaattaagtcttcgtaagacgacgtcgctccgatatagcgtggtataaacggtatagtcgtcgcatccgtgatattacctcgtttagtgggacgtccctcgtttaaaacaggctccgccagctcaaacgacactccgataaaatcaagttgaaaatcgaattcatcgaattttttttttcgtttcggctctctttttttttctttcagattcgaaaacacgttcaccgtttcatcatcgttccctcccgtatagaccacctttattatcgtacttttttcgcaagtgctcagatatttatttatttacttttaggcttgaagtgtacagattttattatttttgagtaaatcgctctttattatcgtagattttaagctcaaccttataacttttagttcaaacatcggaatgtaataaagagcttttactcatnnnnnnnnnnnnnnnnnngttggagtttatgtaatgtaaaataaagtatttgcccaaagtatactaacttatataagtaatgagaaataaaatatatttgattcgnnnnnnnnnnnnnnnnnnnnnnnggggtcgatgattttgttagaatactatctttgcctttttatcactgcagcctaatagcaatggtaaggaagcacccttagctacaagaacgatagctattttcagaatagtgtctctgacaatacatgattgaatgaatgctatatggtgggtattttgncttataaaattctgaaaatgtaaataacatctcattctctttt

SEQ ID NO: 8077 - DNA, 866 bp, Diabrotica virgifera
  misc_feature (810)..(827): n is a, c, g, or t
ttcagctatttatcatattcctagtcaagaaagactcttttcacgtggatttcggttagctaagaaatcgggttttggaaacatcagtttgaacctcgttttggtaacttttcagctttcttatttaacgattcctttattggcacccacatcaacgataccttgtttgctgaccgacacaagctttgatttacaagttaatgacttcagagcctttattacactttggttgtcagaaatataatgcaaactattgtctgaagtacatctctactgagacatctagtcactgctgtataggtaatggattttgggaagagctatgcccttgaaaatttcacataaacttgtgtactaaatcggcataattcatagctcttgtatccaataccttaataatataactaaatattttcaattctaaaatattgtaagactttaaagagtctgagtaagaaaagagatgtttaggtaggtatattctttgcgacattttcaaggtaatagctgttcccaaaatccattacctataaatatatgatgttttttagcttgaaaaatagttatgtgccttttagagatttaagagcctaaaattgttactgtaactccagttcttagttcttttatctatcttaaatccatttgtataccatactacgacaaagttaagtattaatttgatttctctacttatagcttaaattttaacagaactattaatatttgacgatttcgcatgtatttggtccaattgtaataaactccaaaagctctactgatacggaaaaacgtagatatcagcgacgnnnnnnnnnnnnnnnnnncagaagctaagatcaatttgtatacctacgtatgacaat

SEQ ID NO: 8078 - DNA, 931 bp, Diabrotica virgifera
  misc_feature (51)..(68): n is a, c, g, or t
  misc_feature (107)..(130): n is a, c, g, or t
  misc_feature (148)..(164): n is a, c, g, or t
  misc_feature (822)..(822): n is a, c, g, or t
  misc_feature (886)..(886): n is a, c, g, or t
atttccgtttccttattgttatatataaagaatttgaaatatgcgttaacnnnnnnnnnnnnnnnnnngtgacacattttccgtagtgccgcttattttcacttatnnnnnnnnnnnnnnnnnnnnnnnnccgggtgctacactgaannnnnnnnnnnnnnnnnacgacaaaatactaaacattccttcttggtaggaatgtgtaggagatgaaatcagcacatccagtagtaattttacataacgtcagttttgaagaagtgaaagccatactgtcgtttatgtaccgaggtcagtgtgtggtttcccaggatcagttgcctagtttactttcagttgcgaaacttttaaaagtccaaggcctttgtgatatgaaggtaccagaaaatcgaccacgaccggaaggtctttcaaaaaacgaacccctacaaagttctgataaactgatcaacgacgataatttccacagatacgaatacgactgcaaattgcgaccagcagacagactaacagagaatattctctctaaaaggcactacgacgatgatactcccaaaaacgagtacagtaatattcatcataactttaagtcacttaattattatgatgataatgttttacctttgacaaaagactccactgaacccattccgttaaaatacgaagaaccgtatctttttcccagaaaatgtccctcaaaggactcttcggaaacttgcaagtgctttctgtgtggaaagtacctcagtaaccagtacaatcttcgcgttcacatggaaacacacgaagaagcctatcacgcatgccagtcatgcccgcacngtgtcgaggagtcgagatgccttacgtaagcacgtttcctacagacatccagaagaataccacnaacagaagcgaaggaagacggatacctgataaatatagtggtaat

SEQ ID NO: 8079 - DNA, 959 bp, Diabrotica virgifera
  misc_feature (152)..(182): n is a, c, g, or t
  misc_feature (305)..(334): n is a, c, g, or t
  misc_feature (342)..(372): n is a, c, g, or t
acgaaagtaagtaattaatttataattcgccctgagattgaaaacatattgatatgtgatctggttaattaattggattagttttaatacattgattaaattaagtgacatataagaatattatctcatatcaataatcaagatcacatcannnnnnnnnnnnnnnnnnnnnnnnnnnnnnnctaacaaatcttctatcagcatccagtgccgtgtcgttaatgtcgggtcgttattatcggtaaaggtaggagtatagttatttctggtggagatgtgagatacataaaagcttaaataatacnnnnnnnnnnnnnnnnnnnnnnnnnnnnnngtttaagnnnnnnnnnnnnnnnnnnnnnnnnnnnnnnntaatgatataataatttaagttccaatattgaaatatttattaaaggtagggactccacagagtaagagtgagagcgtgattttgatagctgtgagatataagagtggatcattgacagtttctaagtggtcaataaacgtgactaatctgtgaatctttcgagaccggggtaagtcgttcaaggctgatccgggtgctgccaaaaagttgtctaaaagagagattttgatatgaagaaagaagtgggacaaaacaagattaacgaagaggagcgagatgtaattgttatagtgtaacaaacttacattaatatcatcgtaagtgctgtaaattgaagaggaatcatcaaaatctcttatttagacttcttgatggccaactaatagaaactgtttggtgatggtgtaaatatatgtcagaatgagttggtcgtcgccgggatcagaagatgtccggagcgattcacgcgaactatcgttgaacggatgcaaaaaagctccagtttacgcaagggcgccccccggaggggggcccaggggggggccatcctccccccctgaaaaattggggggaaaaagaggaaaaa

SEQ ID NO: 8080 - DNA, 852 bp, Diabrotica virgifera
  misc_feature (56)..(74): n is a, c, g, or t
catgtgaagtatcatttaataaatagacataaaaataaattagaactttatacaannnnnnnnnnnnnnnnnnnatataaattacccaataacagctaattctttggccacctaatataatttctttactagcgaatataatccctctgtattaatgaaaatgccaccccattagtccatccaaaaccagactgtactgtatactctccaccacctccatactgacctacactaatagcatcgtacttttcgaacatctcgttggtggtattcatacctgccatgaatgcacgtaaaatcctattggagaataaatttgcaagaattttagctttcttgttttttgtttcatctagacctaggacaaacatctcttgcagtggcggccaagcgtttggcaaatcccactgctgaccgctttgaattaacgaagtcggtactccacccaaaaagttgctcactttgtttctatttaagtagtctgctgcgcgtgacccgtaatagtcagcacgtgcaggagcaaaacatttggcccacaaaggagctaagctgctgggataaaatcctgctctgtatctaccaacttttgcatctacatcataccaaataccatcgtgtttgtggtagaaaattttgtcgattgcaattctccatttatcaacctttagcttgtattctgtggatttggttttgttaccaactagcgtataaaacttagaaagttgatcaaacgctccgcatataaaagcgtttagatccactggaagtatatcacttgtatgaatatcagtcagattaactcctatgcctcctgagctgttcttatccatcttgaaaaaagtcccatcctga

SEQ ID NO: 8081 - DNA, 863 bp, Diabrotica virgifera
ctcggatcttggctgccctggacacgttttttgcctttaacagtgcgtttaatgaacctactgctttgctaccttttaacaacggtttatctatctctctctcttcgtttcccctatttgtaactgatactccaaggtactcaaattcagttaccttctcaaatttataatctttgtcgtttgtccttagagtaatccacttattttcttcagcgttttctcatctcatttctcatttccatatacttggtttttccttggtttatagtcaggccatatttttttgcttcttcttcaaattgcttgaacattttttgaagctttgttcttgaacgtgtcagaaacaccaagtcatctgcaaaacccatacctacactgttgtcttctgttaagaatcgtgccgattgtctggatattggctcctctaattatcttttccagcactagattaaataagtctgttgacagggggtccccttgttttaatcctctgttgacgttaaactgatttgattaactgccttctatcatgactttattgactgtgttggttaacgtcattttttactaatcgtgtcagattctctaatattcctagtgctctcattgcttcgtatagcccgtttcgtgagatggagtcgtaagcctgtttaaaatcgataaagagcatatgcaagcctagattttgttcataactattgttctgtaatactaatcatttttaggatgatgttgtatgtaatccagatgattggagtaaaaatgattattcaaggaatccattgtgtggattcaatgccacttgtaaatttataagaatgaataatgatgtgatgtatccatatttacaagcttacaacata

SEQ ID NO: 8082 - DNA, 246 bp, Diabrotica virgifera
  misc_feature (13)..(13): n is a, c, g, or t
  misc_feature (18)..(43): n is a, c, g, or t
  misc_feature (103)..(103): n is a, c, g, or t
  misc_feature (179)..(201): n is a, c, g, or t
  misc_feature (214)..(242): n is a, c, g, or t
taacagcgtaatnttaannnnnnnnnnnnnnnnnnnnnnnnnnttcgggacctcgatgttgggatttaagtttataattgggtgtagcagtaatattaaattnaagtctggtcgactttttaaaattttacatggatctgagttttaaaccgtgggggggcccagtttgggttctatcnnnnnnnnnnnnnnnnnnnnnnngtacgaaaaggannnnnnnnnnnnnnnnnnnnnnnnnnnnnggat

SEQ ID NO: 8083 - DNA, 758 bp, Diabrotica virgifera
  misc_feature (2)..(44): n is a, c, g, or t
  misc_feature (52)..(659): n is a, c, g, or t
  misc_feature (670)..(732): n is a, c, g, or t
  misc_feature (735)..(751): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggaagnnnnnnnnnnnnnnnnnnnnnnnnnnnnnnnnnnnnnnnnnnnnnnnnnnnnnnnnnnnnnnngcnnnnnnnnnnnnnnnnncgagaac

SEQ ID NO: 8084 - DNA, 953 bp, Diabrotica virgifera
  misc_feature (810)..(810): n is a, c, g, or t
  misc_feature (851)..(851): n is a, c, g, or t
  misc_feature (900)..(900): n is a, c, g, or t
  misc_feature (924)..(924): n is a, c, g, or t
cgactccgcattccacttgtgtgctatcaaagtttgttgtatgtcttggctttcgttacaattttcttccactcatttcgatatgtgtatagtttccctccagtttctcactttaagaattttgatatctctcatgacgcggtcctcccatctctctctgcgtcttcccctcggtctttcagtttctggtttccatctggtgatcttcttaatcagtaggtcgtttttccttccctctatatgacatagccatctcagtatctgcgctttaataacttacttacttacttaagccgtcctcttgtaccttacggtgtcgaggtaagtggagaaatcagacgtctccatgactttcggccagtagctagtctttctgcttctctccacccaatatttctttttacgcaagcctttccaatatttgcgttcccttgctggcctgcctcttcgtcgtttgttgtcagatgccgctttccataccctctttacagttctaccttcactcattctcgccatatgtccgaaccacgataactgtttcttttcaagtctgtctaaggtccttccaacaccgcacctttcacgtatgtcttcatttcttatacgatcacgtctggtcaccccggataccgcaagtaaatatcgcatttcgcatgcttgaattttactacggatgttgtcgttcactgttcacgtttcactaccgtagagtagcaccggctcgtatacagtttgaaatactttcatttttgttttcaggcttacttctttcttcctaataaaacttttatttagtgcatagtataattntgttgcactcattaccctgctgtttatttctgggtctatanttccttgcccattcattattgatcctagatacttgaagtcctctacttngtgtaatggtctcattattcagcnttacatttatatttttcgatattactaaa

SEQ ID NO: 8085 - DNA, 209 bp, Diabrotica virgifera
  misc_feature (76)..(76): n is a, c, g, or t
  misc_feature (117)..(138): n is a, c, g, or t
  misc_feature (170)..(201): n is a, c, g, or t
taacagcgtaatttttaattggagaaagtcaatcgataataaagatggcgaacctcgatgttgggattaaaagttnataattggtgtagcagtaatattatattaagtctggtcgannnnnnnnnnnnnnnnnnnnnnagtttaaaacggtggagggcccaggttggttnnnnnnnnnnnnnnnnnnnnnnnnnnnnnnnngaaaggga

SEQ ID NO: 8086 - DNA, 827 bp, Diabrotica virgifera
  misc_feature (764)..(764): n is a, c, g, or t
  misc_feature (781)..(781): n is a, c, g, or t
aaacaactgtgtcgttattaatagaaataaggtgtaataaaagtcgttattattaggattccattaccacaggataaatggttattgataaaaaagtaatcttatcttgacattatcgaaaatgtagtaatagaaatgtttataatgttgatgcctaatgcttgtttagtattagtaacgaagtaagcggaaaactaaaaaatggcacggaatgatccagaaaatatacccatggatgacgttgggtatattgactcaagaaagagacagatatttgaacagtgtgatactgacggagatggatatattacactggacgaattggcaaaatttatctccgacaatgaaacgtcctgtgcctgcattaaccctcgagctatcaaaaaaatttaccagaacgctgataaagataaagatcacaagctcagttttcaagaatttgtagattttgttgaaagtgaagcttttcaatctttagtaaatagatgtatcactacatatattcatcatctaataccacatcccaaacaggcagtaagcctccgtgcagctcgtagtggtggcagacgtggtagtcaaggcgacctttgcgatgaatactcatgctttcctccacctgtttttatgttacttatttccatactcgaatttgctttattcataacagatgaactaacacaggaaggatcttcacttactgcaaccggtgttaccggccgatatcttctctacgatccagacaagaaaaaagaggtatgggaggntcgtgacgtacatgttngtacatattggatacatcatataatacgaaatctcgttgtacactg

SEQ ID NO: 8087 - DNA, 104 bp, Diabrotica virgifera
  misc_feature (7)..(60): n is a, c, g, or t
  misc_feature (66)..(66): n is a, c, g, or t
aaaatannnnnnnnnnnnnnnnnnnnnnnnnnnnnnnnnnnnnnnnnnnnnnnnnnnnnntttganttatagaaataattaccttaggggatacagcgtaattt

SEQ ID NO: 8088 - DNA, 882 bp, Diabrotica virgifera
  misc_feature (631)..(631): n is a, c, g, or t
  misc_feature (727)..(727): n is a, c, g, or t
  misc_feature (754)..(754): n is a, c, g, or t
  misc_feature (793)..(793): n is a, c, g, or t
  misc_feature (800)..(800): n is a, c, g, or t
  misc_feature (807)..(807): n is a, c, g, or t
  misc_feature (818)..(818): n is a, c, g, or t
  misc_feature (824)..(825): n is a, c, g, or t
  misc_feature (840)..(841): n is a, c, g, or t
  misc_feature (849)..(866): n is a, c, g, or t
  misc_feature (874)..(875): n is a, c, g, or t
gaaaattatttgtatggtatctaactataaattttatgaagttattcgtgatcggcttaaaaatattgaacataatcgatgttggtttgcaattagtgacggcaaacttgaggatggtgtttcacgttttgagcataccgttgttttatcttacagatggtaagacgccgtcgccccaaaagcgtacctcggctccaagcgacatcgacatctccggttcaggaaacggcgtagatagttgggcggaggaggcgaatttaaatcctccaagtagcgcttcaagcggcttctccgatgatgattctcttcacggagatggtgctgctttgactgctatgcaattagtagattatgttagggatagaggaagatctggtttaatgcaagagtatgctgaaattaggtcgagacctcctgatggtacatttaacatagccaaatcaaaaagtaaccttcccaaaaataggtataccgatgtgctgtgctacgaccatagtcgcgtgattcttactgaactggacaatgacaaagatagtgattacattcacgcaaattttcgtggatgggtataagcaaaagaatgcttttattaatacacaaggacccctctcaaagacaacgccagatttcntggcggatgatttgggaacaacacacattagtaattgttatgacaactagagctatggaaacgaggaagaccaaaatgccaccaatactgggaacncctgaaaggttggttgggaaacaacgntatggggtcagtttggggcgttaagaacggagtctatangaaactngataagngattatacagnttactnnactattagttttaanncgaataannnnnnnnnnnnnnnnnntcgcgaanngtctctc

SEQ ID NO: 8089 - DNA, 335 bp, Diabrotica virgifera
  misc_feature (5)..(63): n is a, c, g, or t
  misc_feature (66)..(66): n is a, c, g, or t
  misc_feature (75)..(108): n is a, c, g, or t
  misc_feature (241)..(259): n is a, c, g, or t
  misc_feature (284)..(324): n is a, c, g, or t
taagnnnnnnnnnnnnnnnnnnnnnnnnnnnnnnnnnnnnnnnnnnnnnnnnnnnnnnnnnnntanatttaactnnnnnnnnnnnnnnnnnnnnnnnnnnnnnnnnnntccattttttgatataagataattacctagggatacagcgtattttttatggagagtcaatcgatataaaatgggacctcgaggttggattaaggttatattggtgtagagcttattattaagtctggtcgannnnnnnnnnnnnnnnnnntcgagtttaacccggggggggcccnnnnnnnnnnnnnnnnnnnnnnnnnnnnnnnnnnnnnnnnncaaaaggggcc

SEQ ID NO: 8090 - DNA, 1058 bp, Diabrotica virgifera
  misc_feature (19)..(46): n is a, c, g, or t
  misc_feature (677)..(762): n is a, c, g, or t
  misc_feature (926)..(945): n is a, c, g, or t
  misc_feature (958)..(981): n is a, c, g, or t
  misc_feature (987)..(1036): n is a, c, g, or t
  misc_feature (1039)..(1053): n is a, c, g, or t
cggacgcgtgggatagtcnnnnnnnnnnnnnnnnnnnnnnnnnnnnctacgatcagtgaatttgtttatggatattcatcaatccacaccaagactgtgtttttgttgttcccgaactgttgttagtgtgtgttagcgacgatacgcgaagtcttttgtgccagaaatttcggaaattcgccaatatttgtgtgaatttggttgcataacctcaaacgtaaacaaaacgcaaaacatgtattataaacccatcgagcttgtgtcgtccaaaataacgccacatttctgcagaccagaaataagaaaggtcaagagagttcttttcgagcctgtcgaccacatcgccactcagagattcgtggaggaagagttggaaaaagtcagagtgacgaagtcagaaaaatggaacttcgacttccagcatgaacgatcattgagcccaagcggagattaccagtggaaacctgcgactcctgttaaaaaacaacctttgagtttgaaacatgccataattgaattcgaaggtcaagatttgtaccccgttcctggtgatattatcagacctattcctattatgctttcatcaacgccgagaaaagaggtgacgtcacccagaaaaacgcatccaagaacccaccacagcgtcttatacccgacatatcatcatggcattcaannnnnnnnnnnnnnnnnnnnnnnnnnnnnnnnnnnnnnnnnnnnnnnnnnnnnnnnnnnnnnnnnnnnnnnnnnnnnnnnnnnnnnactagggaacagagaccagcacgccattttgagacaaagaaaatgaacattttaaaaaacgtctaatgaaatcgggaaaagcaccaaacaaccccaaaaaaaacggaaagccgaaaaggttcttttaaatgccaaaaacaagggatgcggtttttgaatttgcnnnnnnnnnnnnnnnnnnnncaaggtttttttnnnnnnnnnnnnnnnnnnnnnnnnccaccnnnnnnnnnnnnnnnnnnnnnnnnnnnnnnnnnnnnnnnnnnnnnnnnnntgnnnnnnnnnnnnnnnccctt

SEQ ID NO: 8091 - DNA, 227 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (168)..(191): n is a, c, g, or t
  misc_feature (200)..(224): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccggttggtttctatcnnnnnnnnnnnnnnnnnnnnnnnngaaaggacnnnnnnnnnnnnnnnnnnnnnnnnngat

SEQ ID NO: 8092 - DNA, 664 bp, Diabrotica virgifera
  misc_feature (641)..(661): n is a, c, g, or t
cggacactctcagctatattactcaaagtatatgtcatttctgctgtcaagaatggttgtgacctattgcgccaaggtattttatgttgtccaatgattcacactataatctagaccttgtgtgtcttccgtcctctgtgaataatgatctatttttttttatcgattataagtgaactctcgaagtattaatataattgtatcacgaatagcgtaaaccatttgttagttatgacatgttatccggcagtgaaagtaccttacgtccctgcctatattgtagacttatttatcaaaaatatatttatcaacaaatacttttatattactactatataactaatatctcagacgagctgtatgcacaggcttccctaaaatttaatggctgaatgaggatgaaggtgaaactactcctagttcgagaaatgctagtacactatatttatataaggatactcttattgtctataaaattattattgcactataggtctagacattgttgctcagttatgcagagtccattagtgttagaaagtggtatatatcgtcagaacccatagctgtaaatgatgaattccgcaccagtgtcttcagctgagtattgagtgcgtgcgccgacgatgttagatctactnnnnnnnnnnnnnnnnnnnnngtt

SEQ ID NO: 8093 - DNA, 864 bp, Diabrotica virgifera
taaataacaaggtattttttatgtaattggtatatcaagtaagacgtaggaatcaaaaatgttgcaattagtactagtcttggccgctttggctgtattgttctattattttgccgtcaaacccatgagttactggaaagaaaggggaataaaacagacgaaacctgtatggttgcttggcgatagttggggtactgttataaagaagcacagtttagtggattttgtccaatatatctacgaccaagttcctagtgtaagatattttggatgctaccagatggtaacacctactcttgtcatacgagacccagatcttatcaaaaatattgccgttaaagactttgaccactttatggaccacagacaaatgatcccagcaaatgccgaccctctattcggaaagaatctatttgcattaaaaggtcaagtatggcgtgatacgagaccgatccttagtccaaccttcaccagcagcaaaatgcgtgccatgttcgttctgatgtctgaatgtggtgagaacttcataaaatatttccagaacaataacaaagatatcatcgaaatggaaatgaaggatacttttagacgttttacgaacgatgttattgctacaacagcttttggcgttaaaacagattctttaaaggacagagataatgaattcttcactatgggaacgagagcagtagattttggattctggcgaagtcttaagttttttggctactttctgataccgaaaattttagcgtttttcaaagtttcaatatttggcaaagattaagtgactctttatagactgatttgatagacagtcgactagagagagagaggaattgtcgtctgactgatacactacta

SEQ ID NO: 8094 - DNA, 142 bp, Diabrotica virgifera
  misc_feature (13)..(13): n is a, c, g, or t
  misc_feature (18)..(53): n is a, c, g, or t
  misc_feature (59)..(59): n is a, c, g, or t
  misc_feature (65)..(65): n is a, c, g, or t
  misc_feature (72)..(72): n is a, c, g, or t
  misc_feature (83)..(83): n is a, c, g, or t
  misc_feature (85)..(85): n is a, c, g, or t
  misc_feature (96)..(141): n is a, c, g, or t
gctggaatgtganggggnnnnnnnnnnnnnnnnnnnnnnnnnnnnnnnnnnnngaattnttattntttaagnttaaaagcttnanattttttttannnnnnnnnnnnnnnnnnnnnnnnnnnnnnnnnnnnnnnnnnnnnng

SEQ ID NO: 8095 - DNA, 928 bp, Diabrotica virgifera
  misc_feature (725)..(739): n is a, c, g, or t
  misc_feature (906)..(926): n is a, c, g, or t
acttacttggttttggatgaagcaggatgttagatatgggttttgagcctcagattaggaagattatccaacaaattaggccggacaggcaggttctgatgtggtctgctacatggcccaaacaagtacaacagttagctgaggagtttttagaaaattatattcaggtcaatgttggaggtctctctctatctgcaaaccacaacataaaacaaatagtagaagtttgcgacgaactagagaaggaagaaaaactgattaggtacttgaaggaattcggctcagacagacaaaacaaaataatcatcttcgtagaaaccaagaagaaagtcgatgatattacaaaagttgtcaagagagaaggattttccgcaatttcaatgcatggagacaaatcacagcccgaacgtgattacgtattgaatgagttccgttctggtaaatcgtccattttagtagctaccgatgttgcagctagaggattggacgtggaagatgtcaaatatgtaataaactatgattaccccaattccagtgaagactacgttcatcgtattggtagaacaggacgttgccaacaagcaggtactgcctatgctttctttactccaaacaaccaacgccaagccaaagacttgatagctgtattggaagaagcaggccaagtagtgaacccacaactgctcgacctagcccagcaagccaagagcaccaatcctaagcannnnnnnnnnnnnnnacagaaataaggacaattctccgcctagcagtcaaattccaacaaggtgaagacttggacgactcaagaagcttttcggtgagtcaagccccacagtggggcctaggattaccaataacatgagaaacgacgcgatgcagagaaaccagaggaaacattttacacannnnnnnnnnnnnnnnnnnnnac

SEQ ID NO: 8096 - DNA, 231 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (134)..(134): n is a, c, g, or t
  misc_feature (162)..(193): n is a, c, g, or t
  misc_feature (201)..(219): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnangttaaaccggtggagcccaggttggttnnnnnnnnnnnnnnnnnnnnnnnnnnnnnnnngaaaggannnnnnnnnnnnnnnnnnnttatatttagat

SEQ ID NO: 8097 - DNA, 533 bp, Diabrotica virgifera
gaaactcatcaagagcgtatatagtgtgcacctcaatttctcttttttaagcggcgaagatctagaatcaatcaaatatgcgccatttaaatgaaataaagacatcataaatactatttatccaaaaatccaacggttaaatccacagtaaccaaagttatacgaatttaagtttcaaaaacacaccgtaatgacgatggcgaccaattattaataactgtcagctgcacacacattctagacttcgccgcatcccatagtccaaatccttggaatgttgtagagcatcctaaggacacctgtaactagactttgtttccaacagccttccagacgctttagatgttgtagtgctaagaggatttcgtcctaaatagacctgtcttcgtgggaataccagtgtggaagataagataagcttttagtttatttattttttgctgttaacataaaggcaagttgcttctcattcctaactataatataataacctgtaaactttttgtgggaacataatcagggacatgttgtga

SEQ ID NO: 8098 - DNA, 63 bp, Diabrotica virgifera
cttagatttactagtgacgataatattaatattaatcagttgaatattgattaccaatatata

SEQ ID NO: 8099 - DNA, 971 bp, Diabrotica virgifera
  misc_feature (152)..(177): n is a, c, g, or t
  misc_feature (440)..(457): n is a, c, g, or t
  misc_feature (460)..(472): n is a, c, g, or t
  misc_feature (631)..(658): n is a, c, g, or t
  misc_feature (792)..(792): n is a, c, g, or t
  misc_feature (800)..(800): n is a, c, g, or t
  misc_feature (842)..(860): n is a, c, g, or t
ttttcgtttactctggtttaacctcacttaactagatagatcgagaaatattaaattactattactattattcaggttgaaaaatgccttcctctaaggtaaaaggttgcgaagtcgattggggggaaaaataatgtgaaaatgaattcttnnnnnnnnnnnnnnnnnnnnnnnnnngtgtggattaaaaatatagggttaaaacaagatccaaacaaatatgctgttgtttgtgaagtaagttcttcaagtaaaattaattgaatatttgcatttgatgcattctctttataatatttatatcattaaaaaatattgtattcaatttttgaatgtttaggaacactacttctgacatgtggaaaaaagttagacaagatggcagcagaaaattaaaatgcaatgctgtaccaacaatatttagagaagaaagcgaaagnnnnnnnnnnnnnnnnnnggnnnnnnnnnnnnncaccaatttaacacctatagatatttgtataacaagagagcgaagtgcaccttttcctcccaagaataaagtttactagtttactacagtaatcattcaagggaggaaaaggcacttctcccatgttatacatttttccacctccctcaaataagtcannnnnnnnnnnnnnnnnnnnnnnnnnnnctgtcgattgaatacatgaatcataattgaatacaggaatttgtgtattcaatcaacaatagaagtaacaaaatttattagagaactaaaactaacaattaagtacagtataactatcaaattattaatgaganatttttanatcaaaataacaatttactgtttttaccatttttgcacatcnnnnnnnnnnnnnnnnnnngtatggatacttacctaatagaaatatagtaataggtatagggtggtcataagttatttcatctatgctatgacatagtatgacgtcaacatcacttttacttttactccc

SEQ ID NO: 8100 - DNA, 574 bp, Diabrotica virgifera
  misc_feature (2)..(73): n is a, c, g, or t
  misc_feature (94)..(131): n is a, c, g, or t
  misc_feature (134)..(152): n is a, c, g, or t
  misc_feature (194)..(211): n is a, c, g, or t
  misc_feature (246)..(287): n is a, c, g, or t
  misc_feature (307)..(337): n is a, c, g, or t
  misc_feature (503)..(526): n is a, c, g, or t
  misc_feature (529)..(562): n is a, c, g, or t
gnnnnnnnnnnnnnnnnnnnnnnnnnnnnnnnnnnnnnnnnnnnnnnnnnnnnnnnnnnnnnnnnnnnnnnnngtggatgacaaaaaaactggnnnnnnnnnnnnnnnnnnnnnnnnnnnnnnnnnnnnnnaannnnnnnnnnnnnnnnnnncgagaaagaaccatagaaggtgatagaaatattataaaatgnnnnnnnnnnnnnnnnnngtttatatacaaaacttattccaatgggggtgggnnnnnnnnnnnnnnnnnnnnnnnnnnnnnnnnnnnnnnnnnncaacaaatttttttgagccnnnnnnnnnnnnnnnnnnnnnnnnnnnnnnnctcaagggaacacgggggaatttttatttgggaagtttcaaatcgctaaaaaaaaattgggaccccccaagggggggttataggtttaatattggggggaagaagccttttttatataaatctcgtctgccttattttatatttttctttaattttgttttaatannnnnnnnnnnnnnnnnnnnnnnntcnnnnnnnnnnnnnnnnnnnnnnnnnnnnnnnnnngaaggggggcca

SEQ ID NO: 8101 - DNA, 387 bp, Diabrotica virgifera
  misc_feature (7)..(141): n is a, c, g, or t
  misc_feature (180)..(207): n is a, c, g, or t
  misc_feature (278)..(295): n is a, c, g, or t
  misc_feature (333)..(381): n is a, c, g, or t
attattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataaattacccttagggataacagcgtaatttttannnnnnnnnnnnnnnnnnnnnnnnnnnntgcgaacctcgatggttggataaaggtttataaattgcggtagcagctaattttattaaagcttgttcccnnnnnnnnnnnnnnnnnnatgggtctggggtttaaaccccgggggggggcccgggnnnnnnnnnnnnnnnnnnnnnnnnnnnnnnnnnnnnnnnnnnnnnnnnnggggcc

SEQ ID NO: 8102 - DNA, 225 bp, Diabrotica virgifera
  misc_feature (177)..(216): n is a, c, g, or t
acccttagggataacagcggtaatttttattggagagttcaaaatcgataaataaagattgccaccctcgatgttggaattaaggtttataattggggtagcagctattttaataaagtctgttccacttttaaaattttacctgaatttgagtttaaacccggggggggcccggtnnnnnnnnnnnnnnnnnnnnnnnnnnnnnnnnnnnnnnnncaaaggggc

SEQ ID NO: 8103 - DNA, 797 bp, Diabrotica virgifera
  misc_feature (2)..(729): n is a, c, g, or t
  misc_feature (736)..(770): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattnnnnnnnnnnnnnnnnnnnnnnnnnnnnnnnnnnnacctttagggatacagcggtattttta

SEQ ID NO: 8104 - DNA, 499 bp, Diabrotica virgifera
  misc_feature (2)..(358): n is a, c, g, or t
  misc_feature (363)..(376): n is a, c, g, or t
  misc_feature (378)..(447): n is a, c, g, or t
  misc_feature (456)..(484): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgnnnnnnnnnnnnnnannnnnnnnnnnnnnnnnnnnnnnnnnnnnnnnnnnnnnnnnnnnnnnnnnnnnnnnnnnnnnnnnnnnnnattttttcnnnnnnnnnnnnnnnnnnnnnnnnnnnnncaacagaacaaagaa

SEQ ID NO: 8105 - DNA, 681 bp, Diabrotica virgifera
gcgcgccccgtgatgcttaagaataggtaaggatattaaattgtaattattaatgacgtgcttcgtttatgcaaacggaatagaagttattacccttgacgatgccacctgaataaactactcacatgtgggcgcccttgtcttgtgacattagacgtaagtgacacttgtatgcgtaagcaagtctgaaaatataatgaaggttagcacggttgtggggctttacaggggtcatctgggatctgaagttcggcgagaatacgggtatagataggttatgaaatttgaggggattccgatataaactatgccctgggactagggtttatgtaggagtctgcacttcataaggtgatattgttactatgtgtatgtacggggctggttgaagttctttgctctaccagcgatgagatatttgggttctttgagtaatagtcttggcgtgagtagattgatcgcagtctttgactcagctgcagaaacatcttcaatgtagtatgatatttataagaatgagagagcatagcgttctaaagattaaaaattgacgtgcggtctatatggattcaaggttacttacgggagcatgcgaggacgaagctctaatatccgtgtctctgagcttcgatttaatttacgtggttttactacgtcgagggtgtgaaaaacctggcgttt

SEQ ID NO: 8106 - DNA, 564 bp, Diabrotica virgifera
  misc_feature (3)..(56): n is a, c, g, or t
  misc_feature (64)..(155): n is a, c, g, or t
  misc_feature (159)..(313): n is a, c, g, or t
  misc_feature (327)..(415): n is a, c, g, or t
  misc_feature (479)..(512): n is a, c, g, or t
  misc_feature (537)..(561): n is a, c, g, or t
gannnnnnnnnnnnnnnnnnnnnnnnnnnnnnnnnnnnnnnnnnnnnnnnnnnnnngaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggggggggagannnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccaaccctttccccctattcttatttttgttttttggtattttaggggggaggggagaaannnnnnnnnnnnnnnnnnnnnnnnnnnnnnnnnngccatcactggccacaaaccacaannnnnnnnnnnnnnnnnnnnnnnnnaga

SEQ ID NO: 8107 - DNA, 1025 bp, Diabrotica virgifera
  misc_feature (355)..(374): n is a, c, g, or t
  misc_feature (414)..(441): n is a, c, g, or t
  misc_feature (490)..(546): n is a, c, g, or t
  misc_feature (575)..(592): n is a, c, g, or t
  misc_feature (612)..(646): n is a, c, g, or t
  misc_feature (674)..(766): n is a, c, g, or t
  misc_feature (791)..(841): n is a, c, g, or t
  misc_feature (849)..(874): n is a, c, g, or t
  misc_feature (880)..(918): n is a, c, g, or t
  misc_feature (936)..(975): n is a, c, g, or t
  misc_feature (1008)..(1023): n is a, c, g, or t
cgcgcgagagaatagagaaataatagaaaatgaatgtctgacgatcgcgaccttaggaggaaagccctctaacgcaagaaaatcactttcaaaaaagctgaaaacagaaaatttaaccatttgtcacataattgatcttccctgtacgttatataatcccaacatatgacgttacgttacgacacaaataatataggaatcatagggggcagatattggtattgatttgggtactacaatctcaagtgtagctgttatggaaggaaaaaaattcaaagttatcaagaatgaggaaggttctataattttattgggggggaacattttcctttatttaaacccctcttctaaatannnnnnnnnnnnnnnnnnnntttaacaccccctctcgtgaggaggagaaaaacccccgcnnnnnnnnnnnnnnnnnnnnnnnnnnnncccgcgggggggggggggatagaaaaacccaccaccacggtgtgtggtnnnnnnnnnnnnnnnnnnnnnnnnnnnnnnnnnnnnnnnnnnnnnnnnnnnnnnnnntttcccccctccctcccccaccaaaattnnnnnnnnnnnnnnnnnngtgttttttcacccaccgcnnnnnnnnnnnnnnnnnnnnnnnnnnnnnnnnnnncacccctgtgtgtgttttccccgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttggttttttgttgccccccnnnnnnnnnnnnnnnnnnnnnnnnnnnnnnnnnnnnnnnnnnnnnnnnnnngcctccgnnnnnnnnnnnnnnnnnnnnnnnnnnagaggnnnnnnnnnnnnnnnnnnnnnnnnnnnnnnnnnnnnnnnggtgtggggcggggggannnnnnnnnnnnnnnnnnnnnnnnnnnnnnnnnnnnnnnnttctctcccctcctccccaccacccaaaacagnnnnnnnnnnnnnnnnca

SEQ ID NO: 8108 - DNA, 958 bp, Diabrotica virgifera
  misc_feature (178)..(196): n is a, c, g, or t
  misc_feature (291)..(311): n is a, c, g, or t
  misc_feature (466)..(488): n is a, c, g, or t
  misc_feature (761)..(761): n is a, c, g, or t
  misc_feature (776)..(790): n is a, c, g, or t
aaaagaaatagactgattaatttgatgttgcgacaggcaattgcaaaacaatgaaaattgcaaagtgcatattatgtaaaaataaagaacagcgttataaagtgacaaatactggaactagttgtttaaaaccacatctgatgcaaagtcacaaaaaatttattgaacctactgtgtnnnnnnnnnnnnnnnnnnngttgttccttcgtaaatttttgttgaattagattaaattacacttggtgtgttaaaaaaccatccaacgaattttttgttgtgatctagtaacannnnnnnnnnnnnnnnnnnnngtgaatagaatgcataaaattatcaacgattaccgataaaacgaaacttgccagcaatcaattttacgcgtaagtagatcattttcttgaatttacgacttctattttgacttaatcgcttcccgtatcaagttactttcatatgatactcattnnnnnnnnnnnnnnnnnnnnnnnattggcaactaacatttccatttcgacaaaaaagtatatctacaaattaaattatttttcaaactctttcagaccagtttgacttgacttgagttatttgtcagaaggattgacttgagtttgacttgaaattaagtcaaactcaagacaaattcaaacattcaagtcaaacttgtgcaactctagcctatgtggtcattccattctactcttctgtttcttacccagttattaatgttatacaccttgcatctccgtcgtatatctatactntctagttctgtcccnnnnnnnnnnnnnnncgatttaatccgaagggttttcatctctgctacatctagcaatatctttgtcctgtctgtgtcaggtcgtattctgccgcgatggtattattgtccttgatggggtgttttgtaattctgcctttcatttcttttccgatatttttaattttccatattgtttcattc

SEQ ID NO: 8109 - DNA, 83 bp, Diabrotica virgifera
  misc_feature (2)..(36): n is a, c, g, or t
gnnnnnnnnnnnnnnnnnnnnnnnnnnnnnnnnnnntaacagcgcaattctattggagagtctaatcgatataaagattgcga

SEQ ID NO: 8110 - DNA, 472 bp, Diabrotica virgifera
catcagaagtgtagataaagtagtttctgatggtatcttctaaatcagcattaaaaatactaaacacactctgttgactgagaagataccatcagaagtgtagataaagtagtttctgaaattcgtcgcatttataattctttaggttgtcattatagaattgtcatattacctgcatgtaaaatagaaaactctgaaagcctacatatatcaatacagatgtattctaattttaaaaaggaatatgttgaagttggaaatgtttgcttttatgacacttatgtcagcaaaaggttgttgtttacttatagtttcaataaagataaaaaataccccaaaattattgcagggtctttaataaacgttcacaagtttttagcatgtacattagagaatattgctagtgaaaataatgtaaatttaaatgcaagtttaaaaaagaaattcgaagaaataaataatgtttgttagt

SEQ ID NO: 8111 - DNA, 934 bp, Diabrotica virgifera
  misc_feature (732)..(757): n is a, c, g, or t
aattggtacaagctagcaccatccctgtgctaattcgcctaccagggattttggaatccgtagcaaggacactctcggggaccatttagggtttgttttgggacacttagtatctgctagtgattgtcacttccactattacaccacattcattttttgtataagactcgggacatttattttgacgattaagttttatagtttatcgcacatattttgtttcaatatttaagttgcatattgtttttatatatctataatagttgatagtgttccccaaaccagtaaactctctggtcaaagaggtttgagctcagatcatcttttccccatatgagattctctttacctttatatattacctgaaatttgcttgtaccgtttatttacttaattaactttatatttttagtactaaccttgcttgtctccacttatcaatttaaatttatatactttttcctcttaatttgcttaatttattaacttattcatataacttttatctttctttagtcaatcataattatttaacttatttgcttaactttatttaaattcatttaatcaatttttaattatatctttggacgctattccctttgaatagctatccattttacttgttatattttttagtgactacgtgtcgaagcaactgatttttatatatcaagtagaccgtaggttcaccttaatgaggctagtgcctatttaactctttgagagttnnnnnnnnnnnnnnnnnnnnnnnnnnctcccttaattatattctggttcttagttctatagggttaaacgttgctgtacgtattgcatcgtaaattatttggggtgagggtgttatttacctagtatatggaaaagttgggggtatgctcccatatagagctactccatttactatgtaactatagattatatttatattact

SEQ ID NO: 8112 - DNA, 983 bp, Diabrotica virgifera
  misc_feature (505)..(521): n is a, c, g, or t
  misc_feature (699)..(738): n is a, c, g, or t
  misc_feature (775)..(775): n is a, c, g, or t
  misc_feature (818)..(818): n is a, c, g, or t
cgatgtcagcggtttagaagatgatgtaaaatgtgaagaaccaagcaacaaaaatgaaatcgaagagaatttgcagcactttgataatttcttcgataaatatagtgaatacagtgatgaggattccaacgatccaaaagaagaagaggttcctaaagacaaaccaaaagttaaagagttcaattgtgatatttgcaacaagcagtttagtagaaacgacttacttttaaggcacaggatagcacatgctatgaaaatggaagaccagaagatggaattcgacactagctaccccatcgaagatgatgacgacgatgacatcatcgatataaaaagagaaacagacttcgtttattcgtgtaatcgctgcgaaacgatttttttacacaaagaagacctagacagccatttaaaatctcatcttaaagaagagtataacgtcagctgtgagatatgccagaaaaagttttctaagctggctcatatgaataggcatttgagatcnnnnnnnnnnnnnnnnnaacaatttaaatgtgagttttgtgagaagagtttccatagacaagaacagcttaggaaccacatgaacgggcattctggtctcaaaccacatatctgtgatatatgctgtaaaggctttaaccaaatttcaaatttgagggaccacatgcgtactcataatggcgaaaagcccttttnnnnnnnnnnnnnnnnnnnnnnnnnnnnnnnnnnnnnnnnatttacgacaacacacagtgagacatagcggaattanagctcatttgtgtagtacatgtgggaagtggtttcgccagtanaggagaattgggtgcacatcttagaaaacatactggtgccaggccgtttgtatgtcaggtgtgcaatcacggctttaccacgtcgagttcactcacgaaacacaaaacgatttcattctggcgagaaacccatacgaatgtgatacctgtaaaatgaaaattttc

SEQ ID NO: 8113 - DNA, 929 bp, Diabrotica virgifera
  misc_feature (475)..(498): n is a, c, g, or t
gcgacactttccatcagtctcttgatcagttaagtatttgagtcttagaactgcgttgaagagttgcgtcagcataacgaccgcttttctcggaagttcttttaatatctggccggtaatcaggccatattcaggagccttcttggggtctaagtgatattttataacgtcgtaagtttcttgtattgtaaagtttttaatgggctttatttgttgctcattttcgtcaagaaatgcatatatttagtcgtcattaattccgtttgcaggtggtaacaggtgaaatacttcctcaaatatctaccgaaaacttctaccttttgtccatcaggtaccatcagattttctaagtggtgacctgtcaggtaaaataaacaaactttattgatttgttaccatttcatactttgcctctgctataatttacgtttttatctttttgtaaaataatatacaaagccattgaaaagtatgnnnnnnnnnnnnnnnnnnnnnnnngttaaaatacttattttagtaagaagttcagtgtacagttgatattaaatgtatatgtgtgtcggatataaagcttttgtagtaacatttttataatttatcgtaacaagtccattgaagtaaaatggatgtacgtagttgctagacaatgtttgtgtttttgtattgccaaacacctagcaagaattttaaacgtagagacaaaaatagtcaggtcacgttatggaactaaggttatttcactactgagacatatatatttcattagtttaataatgaaagctgaatttataaacaattttgtgtttttaccataaaatatatattggtcaaacaccgagacggttaaaaacttgttaaccacataaacattttgcacaacataagagaataaagttatgaggggataaccctcttgttttttggtagtt

SEQ ID NO: 8114 - DNA, 752 bp, Diabrotica virgifera
gcatagttttttgatagaaaaaatgtcatgaagatgaagatacactgcgaaattgaacacggagacgaattaaatgatgtgtcgtgtgatttgaaatgtatactaaagaatattagatagggtagacggagagtaaatgataaattagatcaagaatgatatgtattttacaccaaagaatggaggagaggagtactatgaatgtagatagtccactaattatttgatgtgtattgtttgcattagcaaggtagtgctctagtgtaagtcgctatattctcgagcgaaaagtgatagtctataatatatgcatcgaatcctatagtttgaggattatcctaacttctactacgacgaagtcagtagaatattgacggtaatatctggcattcacctcactcgatattcgaccactgaaagtttacaagtgtagttaactgccaatatttagtaatcgatactcgtcctacacatatcttgtagttgtatcacaatggagatattagacatctgtgataggtaaggaacacaaggatatgaacatgataatggtatatccactctgtaagacaggcaactgaatacgcgagatctatgcttgaaccggcctttggtggtgcacctgtgtataaccagactggacaatgagtataaagtatttgtatggctgtcccaccttgatgctattctatagctaagtatgtagagaaataagatttatgctatcacacatctcgatgaaagaaggcctc

SEQ ID NO: 8115 - DNA, 1004 bp, Diabrotica virgifera
  misc_feature (68)..(86): n is a, c, g, or t
agaatccgttgttgatagatgggaaaagctgcatcagaatggctccatgctttttaaaaaaactaccnnnnnnnnnnnnnnnnnnngaaagaaagactccgctggcttttaatttttattacattttttggaagtcccggcttccgattcccgttttttccgctagttgagtcgccatttatttttttaagacttattagtaaaattttcgaaagctttattttttatttgctcctatttttcgtttttcgattcaacctgaaacctgtgatttggtttaaaggcacgtttatttaatataataaggtctttgtatgaagccctggtctcagttcaaatataacaatttgcttaatgcaattttatgatcagtaacaacagcactgtcatatactaccacagccataggatggtaacacgggaaggcacaagcacaggaaacgtcaagagtacagaactggcactggcgttgtcatacacagacttatattaatataacgaaatgtacatatatctaaggttaaattaaaaattgttattgtttttgctcccgacgtggtgtaaaacgttaaaatctaccttttgagatcagcacggaccgagattcaaaagagagaggggaagtagcctcctcgccctccccctgattgttgttgcgccacgttgttcgttagtttagttcatatttcggccacgagtgctataaagtggcttcattcggttcatttcagttttaaatttgagaggtctttagttgaccgttaccattgccacgccctgtataagagtaactatcgtacgggctgctgacagtgctaaagatcgaacagaggcagccaactcttgttttggaaggatatatacgaattgagctgtctccgactgagtttgcctgcacttgtgtatgcagccgatgtatacgtatacgttgtaatatacatcagttttgtaaaacaagattatttgtggtaataaagttgacggcctttctgcctggcctaagg

SEQ ID NO: 8116 - DNA, 945 bp, Diabrotica virgifera
  misc_feature (272)..(291): n is a, c, g, or t
  misc_feature (405)..(429): n is a, c, g, or t
  misc_feature (654)..(671): n is a, c, g, or t
gtatttaccatgtctgaggtagttaaggatgtaggcaagatttgggatagactatttgatcacagaccttttctaaatggagaaatatcattgatattacaagcatttgaacaaagacggaaagataaggaagtagataacttatttaaagcgatagaagaaataacagagattaaagacactgagattgagaagctgaagcaagctgaaaaacttacagataaaattaatgataatttagaggaagcacttcgaatttgtgataaattttnnnnnnnnnnnnnnnnnnnnaaacagagcactcctttggaacagtcgaggaataaaagaaaactcgattgggataaattcatgggcggtatcactacaaaatattcagaaataaacagccaattcgaaaccagnnnnnnnnnnnnnnnnnnnnnnnnngaggatatagaaaagaagctgctcatttgattagttgaaaatgactcagaccaatacagctccaattgtaaacccagcaataagaatcagaccttctaaaaaattaaaatcctacattaaaaaccttaagaattgtaatgacttgtcaataggaataaataatatactaggtaaaaacaaaacagacaaaaatgataaaccaccaccgaaagtatatcacttaannnnnnnnnnnnnnnnnntttatattaaatctatttctaaaagaagtaaaaacgatgttttcacagagtggcctttaaccgaaacttctaatgttagtagtaccgaaaaattacttaagtttggaagatttacactgtctccacacacatattttgcaagaaaacaagacagcagaacagaaagtgtatctgcatgagatactgggagggaaatgtgagatcgttctacctaaaaatgaggaaattccaggaacgagatgggggaataggaggtgtaaacaactaaagctga

SEQ ID NO: 8117 - DNA, 1125 bp, Diabrotica virgifera
  misc_feature (365)..(401): n is a, c, g, or t
  misc_feature (739)..(756): n is a, c, g, or t
  misc_feature (790)..(790): n is a, c, g, or t
ccttaaacaaaacaattccacaacaatatataagtgaagacttcccaaagcaagtaatcgccaaaagaaaacagctcgcggagcatatgaaaaagcaagggaggaaggatacctggcacatttaagagctttaagatttaagagttttaaaaacaattgaagaagacagtagagcactggaaaacaaaaataatgctaggaaatttagtcaaagatctcccatgggaagcccaagcacagaagataatatagcaaaaataacaaagctaaacaatactccaaaaaactagggaataattcagcaaatgatagaaatcaggaacgaaaattggctatgaataaggaaacggttgtaaacagtatannnnnnnnnnnnnnnnnnnnnnnnnnnnnnnnnnnnnaaactaacaggataagaataggaacatggaacattaggactttattaagagcagggaaaatggaagagctcgcgaatgagatggaaaagatcgaaatcttagcgttacaagaaattcgatggaaagatcaaggatcaatagtaaaaaataaatacacagtgttttattccggagataccaaacaaggacataatggtacagccttcctaattagcagtaaattaagggacacggtgatagatatcaaagcaatatgtggaagattatcttatgtcagaataaagaacaagcaatctaatttaacattcattaatgaatatgctcccactgagaatgcnnnnnnnnnnnnnnnnnntgatttttacgagaaacccgaaaagatatatganaatatacccaaggatgacatattcattttactaggtgattcaatgcaatgataggaaaagaagtataaaacaaggacgtcgctggtaaggaactctcccacaactactaattctaatgggggaatgctttgaacctagcagaagcacagacacatttaattgagccccccttcaaacacaaaaagaacataaggtaacgtggttaaaccagaaacaactgagggaaatcaatcgaattatatttttgatttcaaaaaaaggggagaaaaaacaattcaaaagggccgggggcgaaccggggggggaaaaagggaaaatctccgccccctttcttt

SEQ ID NO: 8118 - DNA, 185 bp, Diabrotica virgifera
  misc_feature (70)..(70): n is a, c, g, or t
  misc_feature (74)..(74): n is a, c, g, or t
  misc_feature (113)..(113): n is a, c, g, or t
  misc_feature (115)..(132): n is a, c, g, or t
  misc_feature (156)..(156): n is a, c, g, or t
cgggaatgaaaaacaggaccaggcaggaatgaatccacaatagttaaagacaagtttcctagactattanaganactggttaatagtctttcagagaaaatgccaaattcgangnnnnnnnnnnnnnnnnnnttcacaatctattttccaccatancaactatatatttattgtgtatggtactt

SEQ ID NO: 8119 - DNA, 263 bp, Diabrotica virgifera
  misc_feature (138)..(155): n is a, c, g, or t
  misc_feature (193)..(248): n is a, c, g, or t
ataatttacccttaggggataacagcgtaatttttattgggagagttcaaatccataataaaagatggccgacccgatggttgggataaaagttaataattgggggtaacaagcttaattttttaaattctggttcgnnnnnnnnnnnnnnnnnncttggatctgaggttttaaaaccggggggtggggccannnnnnnnnnnnnnnnnnnnnnnnnnnnnnnnnnnnnnnnnnnnnnnnnnnnnnnncgaaaaggggggacc

SEQ ID NO: 8120 - DNA, 921 bp, Diabrotica virgifera
  misc_feature (635)..(655): n is a, c, g, or t
  misc_feature (824)..(824): n is a, c, g, or t
  misc_feature (857)..(857): n is a, c, g, or t
cgccgttcttatagcaaatggggtagccaggttattagctccaagcatatacgatttagttattagatccaagaaactgccttaccttcctgatctgttaccaaatactagcagtatatatgaggtgtatgttgaagactttatgaaaacagaaatcaaatacttaagcctgtcaatgaactatggtcaaatgaaagaactactgatatcccataaaaaaattgaagtgtttcccttggtagatcatccacaaacaatgactttactcggatccattaccagacaagaactgatcgtgcttctcgatcagcgagttggtaccgtacaaagaagacagtacttgccgactccaatgatcgacagacatgaaacatctttcgaaaacatcgaatttatccagtccatgcgaaagaggtctgtacctcatatagacgattccagtgattcagagaaggaagacgatataagagttgaggataacattacaacacatccgggaatgcacgaaatgaaagaaattaaagtaaatagtcttgaggatacaagagaccaaataatgaaaaaatgggcaccagctaagaaaacgatgactttaccgcctcttgctccaaaatcaccccttccagaaagacggnnnnnnnnnnnnnnnnnnnnnggagctacatcattactaaatttagatgtgcctggtttaagggtttgtgacctacccgatcacgaacagcaggcctgggaagttgatcaactgaaacagcaagtagatttcacaaattgtcgcatcgatccagctcctttccaactagtgggagaggacctctttgctnaaagtacattcactcttctccctcttagccatncacttcgcctacgtaacgtcgattggaaaatttggttgggttgttgtaggtctaaaggaaactc

SEQ ID NO: 8121 - DNA, 769 bp, Diabrotica virgifera
  misc_feature (2)..(678): n is a, c, g, or t
  misc_feature (684)..(706): n is a, c, g, or t
  misc_feature (710)..(734): n is a, c, g, or t
  misc_feature (736)..(760): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnngacnnnnnnnnnnnnnnnnnnnnnnnnnannnnnnnnnnnnnnnnnnnnnnnnnattatataa

SEQ ID NO: 8122 - DNA, 632 bp, Diabrotica virgifera
  misc_feature (35)..(60): n is a, c, g, or t
  misc_feature (64)..(94): n is a, c, g, or t
  misc_feature (99)..(138): n is a, c, g, or t
  misc_feature (147)..(187): n is a, c, g, or t
  misc_feature (192)..(271): n is a, c, g, or t
  misc_feature (280)..(323): n is a, c, g, or t
  misc_feature (333)..(399): n is a, c, g, or t
  misc_feature (405)..(629): n is a, c, g, or t
ccatcctccccctcccaccacacagagggaggggnnnnnnnnnnnnnnnnnnnnnnnnnncccnnnnnnnnnnnnnnnnnnnnnnnnnnnnnnncttcnnnnnnnnnnnnnnnnnnnnnnnnnnnnnnnnnnnnnnnngggggggcnnnnnnnnnnnnnnnnnnnnnnnnnnnnnnnnnnnnnnnnnaagannnnnnnnnnnnnnnnnnnnnnnnnnnnnnnnnnnnnnnnnnnnnnnnnnnnnnnnnnnnnnnnnnnnnnnnnnnnnnnnccccccccnnnnnnnnnnnnnnnnnnnnnnnnnnnnnnnnnnnnnnnnnnnnccccctcctnnnnnnnnnnnnnnnnnnnnnnnnnnnnnnnnnnnnnnnnnnnnnnnnnnnnnnnnnnnnnnnnnnncacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngga

SEQ ID NO: 8123 - DNA, 709 bp, Diabrotica virgifera
  misc_feature (158)..(179): n is a, c, g, or t
  misc_feature (447)..(589): n is a, c, g, or t
  misc_feature (598)..(620): n is a, c, g, or t
  misc_feature (622)..(648): n is a, c, g, or t
  misc_feature (650)..(666): n is a, c, g, or t
  misc_feature (668)..(681): n is a, c, g, or t
  misc_feature (683)..(698): n is a, c, g, or t
cttctagcataatcagctctaaaagagtaagaatatgctccaaaactatgatattaaagaaatttgtctcaaaatgattgagttacagtacaatcttaaactcgagaatcatttttttaatgtttgaaagcgttttataactcgaaaaccgtcatttnnnnnnnnnnnnnnnnnnnnnntctttaaaatgtttttagttatcacaaaacattaaattatttacctaacagtacctacctattattaggttgtttcagtaacttttattattctgtgaatgacatctgtcacatttaacattgatagacgtttattttgtgtttgttgatagcactctacgggtctagacgtttcatcttcgccgccggtttcgatgtcggaacgattcatcgacagacaattaatcgctatctgatatatattgatgaataatcgacagattctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtaatnnnnnnnnnnnnnnnnnnnnnnngnnnnnnnnnnnnnnnnnnnnnnnnnnngnnnnnnnnnnnnnnnnnannnnnnnnnnnnnngnnnnnnnnnnnnnnnncagtttgaccg

SEQ ID NO: 8124 - DNA, 940 bp, Diabrotica virgifera
  misc_feature (826)..(826): n is a, c, g, or t
  misc_feature (863)..(863): n is a, c, g, or t
  misc_feature (886)..(886): n is a, c, g, or t
aagaaaagcaaatcagggggaaaatagcgaatttaaatattttagcacaaaaaatgaaatcatagacgcgggaacagacttgactttgtggttccactcgaacgtaattgataaacttatggcaaaactatcagagtttgaggaaaagggatcagggtgggctttggaaaaaataatatctttggaggttaatattaacaaatatgaaatcgggaatggggcttcatccttcattaagctaccggatcaaatcagaaataaaaacgcgtgtatcaatgtaaaaaacaatgatgaggcgtgctttttttggagtatagtttcagcgctgtatccctccaaagcaaattctgatcggactagttcgtatccacattacacaactgtcttaaatgttgatggtttggaaacaccaatgactattggaggcatttcgaaatttgagaaacaaaatgacatctctgtaaacgtatatgggctggaaatgaatgtcgctaaagaaaaaacattttacgtaacaataccgttaaggttgtgtaaaattaaattagctagacatgtaaatttgctgatgatacaagataaatattttctaaaattaaacgattatgaggcacctattgaggatgatgaaattgtagatatcaaataccattattgcatgataaagaatctgtctcggcttttatccagtcaaacaagcaatcatagccataaaatatttgtatgcgatagatgtctaaataattttagcagttttgacagactaaatgatcatgcaaaatattgtgagagaatcacgactgcaaagtttcatttccccatatcnacatgttaaatttaaaatcatgtgtatagcaacacanaccttttgtgtctatgcagactntgaagcatgctacaaaaaattaaaatgacccgcttaaagtaaaacattaaacat

SEQ ID NO: 8125 - DNA, 101 bp, Diabrotica virgifera
  misc_feature (7)..(28): n is a, c, g, or t
  misc_feature (49)..(49): n is a, c, g, or t
  misc_feature (54)..(91): n is a, c, g, or t
ataatcnnnnnnnnnnnnnnnnnnnnnnggaatggagggggtggatganaaaannnnnnnnnnnnnnnnnnnnnnnnnnnnnnnnnnnnnngtaaagctta

SEQ ID NO: 8126 - DNA, 624 bp, Diabrotica virgifera
cagaatctctatgaatgaaataatatattcttatttgatcaatgcgcagaatctgacacctatatgcctatactgcagatcaacactgtgaacaaggaccgcataaataatgtatattcccactgcagacataccatggattatcttgatgcactctgtatgttctattactcaagatagcgctgtcttgatctgtgaattgtactcaagtctacggatattacagactctgtgacggacctctccgtcaggaactcactttcgtaggagaagccgtgcttatggaatgactgatgataaggaatgcgacttatcctacgtatggtgtgatgtctatctatcgagtcgatgcctatctgctgtaactgaatgcagcgatgaatgcaccggatcatcatcctacttagacagtactactgtgactgagaaagaatacggtgcaacacattaacaacatctgagctaggtcatgaggagttcataccagactgttgcgagtggctttagacaaggcgttcagtaggttcctgaccaaggctgagctactgcgcacgagatgttccagaacgacacatatctatactatctagtatgaggctctctcttgactccctcattcgacta

SEQ ID NO: 8127 - DNA, 259 bp, Diabrotica virgifera
  misc_feature (195)..(195): n is a, c, g, or t
  misc_feature (197)..(198): n is a, c, g, or t
  misc_feature (207)..(207): n is a, c, g, or t
cggacgcgtgggtttcaaagtagggatggacccaatactcctgaattctgcaaaccctggaatcctcatagtaatcaactatatcctcctcgtcgaaaatccacacagtaaaactactgcactgctcaaataaataagcacaactgaaccagaatcagtcgcttcttaggtggagggttttcatttagatcatanannctgatttanaccgactgcagatggtagactaatttttaaaatggtgtttttttaacagtac

SEQ ID NO: 8128 - DNA, 829 bp, Diabrotica virgifera
  misc_feature (175)..(192): n is a, c, g, or t
  misc_feature (344)..(367): n is a, c, g, or t
  misc_feature (491)..(508): n is a, c, g, or t
  misc_feature (513)..(530): n is a, c, g, or t
  misc_feature (743)..(760): n is a, c, g, or t
  misc_feature (762)..(774): n is a, c, g, or t
  misc_feature (784)..(784): n is a, c, g, or t
  misc_feature (810)..(810): n is a, c, g, or t
atttttgataaacaaaaccaaagtttaaatcaatggaagtaaaacaggaagttagtgatgagacatatcaagcagaaataatatattgtaatgctgttgatgatagtccttcggatattagtaaaattgaaattaaagaggaatccaagacagaaagtgcctaccatgcatttgnnnnnnnnnnnnnnnnnntccccataaagactgaaatagaacaagaggaatttaagtcatttaaagaaaaagaattaaatggatttccctcagaggagaacatattggaaagtatgaaaacaatacccatagagcaacatatgagtcaacccattgaagaaaatacattnnnnnnnnnnnnnnnnnnnnnnnngttcgctaaaaaacgtagtttaaaaacacatttgagactgcacactggagaaacgccttacaggtgtgaactttgttctaagccgtttactacagcaagtatattgaaaaggcatgtgagatcnnnnnnnnnnnnnnnnnnacatnnnnnnnnnnnnnnnnnngagcaatttagtcaatcaagtgatttaaaaaaacatatgataacgcatacaggagaaaaatcttatatgtgtgaaatttgcttaaaacagtttacgacaacaggtcatttgaaaacacatatgagaatacacactggggaaacaccttataaatgtgaattttgttttaaagtgttaagtagagcaagtgatttgaaaacacatttaagagtnnnnnnnnnnnnnnnnnnannnnnnnnnnnnncttgttttanacaatttagtcatccaagtgatttanaaaaacatacgagaacaca

SEQ ID NO: 8129 - DNA, 968 bp, Diabrotica virgifera
  misc_feature (88)..(110): n is a, c, g, or t
  misc_feature (760)..(760): n is a, c, g, or t
  misc_feature (938)..(938): n is a, c, g, or t
gaacaactgaagaaattgaaagcggaaaaggccaagcaacaacaaatcgctgcagctgctagcaaaaatactcccaaagtgaagcagnnnnnnnnnnnnnnnnnnnnnnnttcactagccggaacaggacctaaaaatcgtccacaaagaacgagcaaacaaaaagctctagagcaagtaaagtcgtggtgcggaaacatttcagacgaagagggcatcagtatgaaacgccctcgatctccggacagtgacgattcctttagcgaaaaaagaatgaagttcgaagaaatgtccgaagactcagacggagaagtgtcaaagcctaaaatgccattgaggaaaatcgctcccaagccaccagcgtctccgttgcaggtgatcaaaaacggcgttggtaaaaacacgcctttgccgcagaacattctcataccggacgccaacggggtggttaggatcaaccagaagcagctgccttctttgagcacaggagtatacatcatgtcgaaaacggctggtattataaaattggactccagcacatctaaagtagctacaagcagcggccagatgatcgtgaaagtggcacctaaaattggacagactcatataaaaatcatgaagaaagatggtacatcaacacaacaggttgtccaaatgagccctaagaatattcaacaaacaccaaaagcactgaaaagtcacctgacgaaagctaaaaaatcattatcagaactgaaagcatcgccagctgcacctaaanaggcggaagttctcaaaaaacaagtactgacaccaaccaagatggacattgacaagaaacagatggtcgtcaagaaacttccagaattggctccaaaaccgggccccaaagcgttcttgaattttcatcagtcgagagtagagaagaggatctgatgatggggtagaaagaactgcgntcccagaagaatcaaattaccggaaccgga

SEQ ID NO: 8130 - DNA, 50 bp, Diabrotica virgifera
  misc_feature (4)..(43): n is a, c, g, or t
tagnnnnnnnnnnnnnnnnnnnnnnnnnnnnnnnnnnnnnnnnggtgatt

SEQ ID NO: 8131 - DNA, 75 bp, Diabrotica virgifera
  misc_feature (8)..(67): n is a, c, g, or t
ggaatggnnnnnnnnnnnnnnnnnnnnnnnnnnnnnnnnnnnnnnnnnnnnnnnnnnnnnnnnnnnntaaagctt

SEQ ID NO: 8132 - DNA, 948 bp, Diabrotica virgifera
  misc_feature (793)..(793): n is a, c, g, or t
  misc_feature (807)..(807): n is a, c, g, or t
  misc_feature (832)..(832): n is a, c, g, or t
attggaaaatactagtattattgaaaatctgacgtagattactattgttctggtaagactgtcgaagataactactaagttgtgtaaatacagtgcataccatgtttatcatttttattatcttcacttttattgcgaagttacatggagctgatcaagggtgttctattggaggcctacagggtacttgtcagccaataagtgcgtgcagcggtgtttttagtttgctgaaagacactgatattaatttttgtcaggaggaagatcccgaactttacatttgttgccctgactatttatcaagtccaactgttgaagttgaacaatatgaggatccatcgtctataagtgtaaaaaaatgtgaggaatactatccaccaccagcagactttattataactgcagtaggaggcactaagtcacttccaaaagaatttccacacatggcactcataggatatggacaagaaaaagataagcagtggctatgtggtggctcgttaattagtcataattttgtcttaactgcagcccactgccttcaatccactgattatggagaggccaaatgggtccatttaggtgatctggatatctccactgatgaagacgacgcagaacctcaagattttaaaataattagagtaattgcgcatccgcgctactcattttcttccaaatatcacgatattgctctagttaaattagatcgaaatgtcatgttgacagaatatgtagcaatagcttgtttacaaacggtaaagaagatatatgatccatataacaatatganctgctgctggttgnggtaaaataggatttgctgaagagncaagtagctttttgctaaaagttagtttaaatgaagtgaatacagagacatgcaacagattatacagcgacgtaaaaaatcgatctacaacaggggtattgttggtaacacgatga

SEQ ID NO: 8133 - DNA, 983 bp, Diabrotica virgifera
  misc_feature (872)..(872): n is a, c, g, or t
ggatgataaacatatgattattcaaacggtagcaccagctttagtagatactccggataatttggagactatattagctgttcagagcttgcagaacattgatattccaaaacaagatgaaagtaatataagcgaaaaagagaggagagagatggaagcgttggcaatggctgtacaaagtattacagaaccttctagtaactcgtatgtagatgattatatgacgcccactatcgaatcagaatgtttaattcagggggatgtaattgaaacccaagatcaagaaatttctatgcttgtaacagaaatggaaccagtacaggaaccaatcattgatacaaattctatacaagaatccacatgtgaagcagaaattaaagctgttgttgactcagaaaaagtaaatgaaatagacacacaaccaatgatacaagataatgcagtgagttctgaaccaactgaaattgagacgtcaaactcctctcaacaaactgaagccgcaaatattgaacaagatgttgttgaaacatcgcattctgatgtatctattgctaaattgtctgatattgaacctaatattacgacttctaacattgatgcaacaaatgatattgatgaagatgtgaaagaagtatctacttctgaacaactggaagtggatcctgaatcgtcaactaccaatcaacaatccaatgcagtaacatcttttgccgacacagaatcagaagcagtaaaaaaaccagttgataattttgaagattctactgaagaacctaacttagtgacatccgttactgatgaagtcaaaacagtagaagcggtaacacagttgatagtgttgaagattctgtgacagaagtatctgctatccnagaacctgaaatagatagtgctccagataatactaatggtactatagaaagctcagaaagtcttgttagtgaagatttcaacactccagaagatcccagcgcaaatgagtc

SEQ ID NO: 8134 - DNA, 881 bp, Diabrotica virgifera
  misc_feature (643)..(660): n is a, c, g, or t
caccaattaacaaaaaaactacggacttaattgaaaatttaaataataattctactaattttcacaacaaaccagacactttttgactgttaaccatttaacatccattaaattgttaatttctcatagcctactttaggcttgtttattaaactaagcagaaaatgaggatttattgatgaaaaacatcgctagttgttaacgtacctaacttttttattatctaacataagcaaatggattaaaaaagaaaatattcataaggctagaattgagatttaatttagatattttttgtatgctagaatattccacagggtgttccgaacttaaagaaaaaaaacacagtatgattgttacactcggtgtagaatggcctttgcctgtctagcaacagtaatattacatcgattttcttaaataataaggctgtaacatactagaaaaatcactcgaatcggacagcagctttagagaattcgagacttctaacgtgtacaattcagcaagtgagtcgattattttgctcttaagtgtatttattttcaaccccttttttagcgagtaaagatagaaccgctttaaaagttctttggccccatctatcctctcagctgtcagcacaatagcatctgcaaacttnnnnnnnnnnnnnnnnnnggaaggggcacaaatttattaatgaacattagtatttagtttttagtgtactagtagcaataatagcataaaaatagtttaagtacggtatatgtagttaacaatattcttgtaaggtactttataccttatttactcatatttttacggtgattttttgttctatcaagaagttttcataaatacccaacgtagcagctaatatttttattagaatatta

SEQ ID NO: 8135 - DNA, 211 bp, Diabrotica virgifera
  misc_feature (93)..(114): n is a, c, g, or t
  misc_feature (122)..(144): n is a, c, g, or t
  misc_feature (174)..(205): n is a, c, g, or t
gataatatactcgtattttattttaatctaataacgttctaatcgataataaagattgcgacctcgatgttggattaaagtttataattgggnnnnnnnnnnnnnnnnnnnnnntgttcgannnnnnnnnnnnnnnnnnnnnnnagtttaaaccggggggagccaggttggttnnnnnnnnnnnnnnnnnnnnnnnnnnnnnnnngaaagg

SEQ ID NO: 8136 - DNA, 912 bp, Diabrotica virgifera
  misc_feature (2)..(44): n is a, c, g, or t
  misc_feature (52)..(902): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttttttt

SEQ ID NO: 8137 - DNA, 82 bp, Diabrotica virgifera
  misc_feature (9)..(26): n is a, c, g, or t
  misc_feature (40)..(64): n is a, c, g, or t
gagataaannnnnnnnnnnnnnnnnngtaatttttaaagnnnnnnnnnnnnnnnnnnnnnnnnnatatataaggaatataat

SEQ ID NO: 8138 - DNA, 895 bp, Diabrotica virgifera
  misc_feature (2)..(44): n is a, c, g, or t
  misc_feature (50)..(72): n is a, c, g, or t
  misc_feature (263)..(336): n is a, c, g, or t
  misc_feature (341)..(406): n is a, c, g, or t
  misc_feature (424)..(442): n is a, c, g, or t
  misc_feature (451)..(465): n is a, c, g, or t
  misc_feature (467)..(483): n is a, c, g, or t
  misc_feature (486)..(504): n is a, c, g, or t
  misc_feature (519)..(539): n is a, c, g, or t
  misc_feature (677)..(726): n is a, c, g, or t
  misc_feature (731)..(810): n is a, c, g, or t
  misc_feature (813)..(832): n is a, c, g, or t
  misc_feature (839)..(886): n is a, c, g, or t
tnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnaccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctatattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnttaatcnnnnnnnnnnnnnnnnnnnnnnnnnnnnnnnnnnnnnnnnnnnnnnnnctccttccc

SEQ ID NO: 8139 - DNA, 857 bp, Diabrotica virgifera
caaatatggggatttcttcgaagctaatgtgaactagatatgaagtgtctgttaaaaatattctttttttaatttccgaataaaatttaaatgtaattaatcgttgtaaacgtatatttataggatattatttataaaaacccaagatgtctttccgtgtggtgcgcagttccaaattccgccatgtctatggtcaagctttaaaaagggaacaatgctacgataatattcgtgtttctaagagttcatgggattcaacgttttgtgctgtgaaccccaaatttttggctataattgtagaaagtgctggaggaggtgccttcatcgtcttacccctatcaagtataaataagacagggcgtatcgctgccgatcatccgctggtaggtggtcataaaggtcctgtcctggacatcgcctggtgtcctcataacgataatgtgatagctagcgggtccgaagattgcgtcgtcaaagtatggcatataccagatcatggccttcacaaaacactaacagaaccagtcgtcgatttagtttatcaccaacgtagggtcggtctcgtattatggcatccgacagcgttaaacgtgcttcttactgctggcagtgacaatcatgtagttatttggaacgttggaaccggcgaatccttagttgaaattgactgccatcctgatattgtttacagtgcctgctttaattgggacggatcaaaattattaacaacgtgtaaagataagaaaatcagaataattaatccccgaaactggagaagtcgaagctgcagatctagctacatgaaggttctatagcgacaagggcagtatttttaaggcacggtctatattcacaca

SEQ ID NO: 8140 - DNA, 890 bp, Diabrotica virgifera
  misc_feature (309)..(326): n is a, c, g, or t
  misc_feature (341)..(358): n is a, c, g, or t
  misc_feature (772)..(772): n is a, c, g, or t
agagaaattaagatcattaggcaatgatttttcaaataaattagtatctcaaagaattaattcctgacaggactttcttatagatgctattgtcctaatagggttcaattgtttcaactcaacaagattaccaaagacaaagacaagtcctcttttagatttggtgagctttggacttggggagccaataggtaatagttggtgtacaacttggtgaggtgttagaagtttttcctctacaatggagcgtgaatttaaccccatgcaagctttgtgtggttctggttgtggattttatggcaaccctgnnnnnnnnnnnnnnnnnncactatgtttcaagnnnnnnnnnnnnnnnnnncaacagttacccaacacccccacaagtctgagtgctctaaaagatacaacaacagcacagcctaccattagtcatatttcatcaccagtagtcacagatcttcccacagatgcttctgaagaatgttcaaatacagcctcagctgccgcaagcaactctactaccgctgaaccggaggctgtggcaaccgtctccacgtcctctggcgaaatgaacgccggcaccagtagcgaagacaaggacggcgataaagatgtaaagaaaaagaagaatcgatgcgccacttgtcgcaagaaggttggcctaacaggttttgaatgccgctgcggagaactattttgtgccacacatcgatacagtgacaaatcatgattgtagtttcaactacagagaaatgggtgcccaagaaattanacgcaacaatcctgtcgtcttaagtgaaagaatccagaagatctgaactcaccacaagtttctagaaaaatttgcgtgatgagtgataaatgagaacggacattttttctgaaatcat

SEQ ID NO: 8141 - DNA, 334 bp, Diabrotica virgifera
ccccgccctccccccccgccctacgttatgtatatattatttatcttacatcttgttctcaagaatgtgtcggaaaagatctaatccatattccaaaactatagcgagtgatagaatcgcttatacttttaggtcgcctataagttttatgcacccctagcatcagagagcggtattacttcctacctatccattattgacatcctaaaatgagataacaaaatagagctgttattggaaaacaactattgtacacaatcatcgttcgaagacagtgggtattgcactctaacccgatctactgttttaagaaataaatgaaactgaactatct

SEQ ID NO: 8142 - DNA, 760 bp, Diabrotica virgifera
  misc_feature (2)..(44): n is a, c, g, or t
  misc_feature (52)..(730): n is a, c, g, or t
  misc_feature (738)..(738): n is a, c, g, or t
  misc_feature (747)..(747): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttanatttttttnaaagacgagagac

SEQ ID NO: 8143 - DNA, 930 bp, Diabrotica virgifera
  misc_feature (643)..(661): n is a, c, g, or t
  misc_feature (871)..(872): n is a, c, g, or t
cctatttcacgcgatcgtcaaaatcattcattcatgtaccaaacattcattttattaacgaaattaacgagtaattgaggctaattatgtcatcttttgtatgttttgatttcaaataaaaatgtcttaaaaagagaactcttttcttcgagtgattgagttacctggagcaacaacgtaacgacctcgttacagacgtcctgaaaaacgttttttttatctaaataaatcgacgacatgaagagctcttcatggcttaaaaatggttttaaaagctgttaagcttcgaaaaacgttgctgaaaaatgttcttttacaattctaggtaaataacatcctgttaatagccaacaccttcttcaaacatcctagaaggctatactctaaggcactatactataagctatactatatggaaattacccgtagatagagaagatagaattgttaggaatcaaattgacttcgttgtactctatcacaactttaagaaatacataaaatctagtaaaacattccctggagctgacatttataccgatcacaatccagttataaatggattttagtttaaaaagatttctgaaagttaaaagagaaaaagtgataagaaaaatagacatctcacaactgaagaattctnnnnnnnnnnnnnnnnnnngtatcacggttgagaaagaaattgaaacggtagaaagctttggtacagatagacgttgaagtaacatggactgctctaaaaacgaaaaatacaggaagacatcgggttcacgaaaaaccagaaaacaagaatgaataacgcaagagatcatggatctcatggacgtaagatgaaaacataaaacaaacccaataaaatataaacgaattnnataatcattagaaaaatgtatataagctaaagaaaatgtgctctaccagtctaccatc

SEQ ID NO: 8144 - DNA, 785 bp, Diabrotica virgifera
  misc_feature (254)..(273): n is a, c, g, or t
  misc_feature (349)..(367): n is a, c, g, or t
  misc_feature (439)..(458): n is a, c, g, or t
  misc_feature (758)..(779): n is a, c, g, or t
ttaaaacctgaggacagacagaaatttgaatggtttttagagagatatagatataaagaaatcttcacagaaacaacactagtcaagcataaaatcgatataggaattaatgagagaaaagagaagacatactgcccagcccagcaaaccaggcacaatgccccagatgcacccagaagttcaaaggtgactgtggagattgatgagattacagtccagtttgatcaaaaagttcagtgaaattacagaaaagnnnnnnnnnnnnnnnnnnnnggctcaccctttaaatttaaaggacaaaattagattgctaaaaaaacataggtaaagttgattgttttgctcaagnnnnnnnnnnnnnnnnnnnctgtgctagtagcctagtagttaattacactaatagcattgcacttatattgttcatgttcaatgtgggaannnnnnnnnnnnnnnnnnnnaacattgatattttattctgaacaacattataaaaaataaagatctacaaaaaaattcaacacaagttgatcaaaaatgggacaaaaatcagtatacttaaaacaataataatagtatacccagcaaatgtctaatggaataaaattcgagagattagccttggtcctttcatgttttcactgtatatcagatctggtgattaagcaggtgtaacatctgtttggtggttagtggtttcaagtttcaacaaactgccactctgaggtctatcttttcctgaagcccatcttatgaataannnnnnnnnnnnnnnnnnnnnngcgctc

SEQ ID NO: 8145 - DNA, 187 bp, Diabrotica virgifera
  misc_feature (3)..(177): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttttt

SEQ ID NO: 8146 - DNA, 334 bp, Diabrotica virgifera
  misc_feature (21)..(21): n is a, c, g, or t
  misc_feature (23)..(23): n is a, c, g, or t
  misc_feature (32)..(32): n is a, c, g, or t
  misc_feature (53)..(53): n is a, c, g, or t
  misc_feature (57)..(57): n is a, c, g, or t
  misc_feature (61)..(62): n is a, c, g, or t
  misc_feature (92)..(92): n is a, c, g, or t
  misc_feature (110)..(110): n is a, c, g, or t
  misc_feature (130)..(130): n is a, c, g, or t
  misc_feature (135)..(135): n is a, c, g, or t
  misc_feature (168)..(168): n is a, c, g, or t
  misc_feature (270)..(270): n is a, c, g, or t
ccctaaggggccggaggaagnantaagaaaanatgaaagacccctttagagangaangagnnagagaggaagaggaagagaaaggagaaggngcgaccgaaacagagganacaacagaccccagaaacgnggccnagagagaggcagggagggacggcaaggagcaanccaagaccaccacaagcaaaagcaaacagggcggagcaacaacagaagacaccaagagccaaagaacaaccaacagaaacgcccacaaggagggaagagacnagggcaagaggaagcaccaagaaaacaacaaagagaaaggcggaaagcccagaaaaagaaccac

SEQ ID NO: 8147 - DNA, 549 bp, Diabrotica virgifera
  misc_feature (11)..(548): n is a, c, g, or t
tttagctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 8148 - DNA, 882 bp, Diabrotica virgifera
  misc_feature (2)..(566): n is a, c, g, or t
  misc_feature (568)..(596): n is a, c, g, or t
  misc_feature (598)..(625): n is a, c, g, or t
  misc_feature (636)..(686): n is a, c, g, or t
  misc_feature (689)..(727): n is a, c, g, or t
  misc_feature (730)..(750): n is a, c, g, or t
  misc_feature (763)..(841): n is a, c, g, or t
  misc_feature (847)..(859): n is a, c, g, or t
  misc_feature (862)..(875): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnntnnnnnnnnnnnnnnnnnnnnnnnnnnnnaaacataatcnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnagnnnnnnnnnnnnnnnnnnnnncgaagaacccttnnnnnnnnnnnnnnnnnnnnnnnnnnnnnnnnnnnnnnnnnnnnnnnnnnnnnnnnnnnnnnnnnnnnnnnnnnnnnnnattacnnnnnnnnnnnnnacnnnnnnnnnnnnnncataaat

SEQ ID NO: 8149 - DNA, 915 bp, Diabrotica virgifera
  misc_feature (493)..(513): n is a, c, g, or t
  misc_feature (881)..(881): n is a, c, g, or t
  misc_feature (897)..(897): n is a, c, g, or t
gaagtgaattgaccattccaggtcacgtggctttcgacaccgttgctgagggacaaaaattgtgtttttggtattattttggctattttctcgttttattgtaaaaaaatctgtggttttaactacaaaaatttcaaatattggatataggacaccctcgtaggggatgcaaaaaccggatataatcagaaaatcagttttcttggcccatatcgtcgttctgtttacagtgtattgtgattatagtgatttaaaacatttcggtctttaaatgcggctggtattataaaaaaacttactttatctcttttacctttactggaacactttcaaactgaacaaaacgctggtattttaatcatattcttaaattaaacaatggttttctacacttaacctagtttgtttacactattttgcccatcagtcgctgtcaaatgacgtcaccctggaatgctctatagattttgattttattaacctaatattatcnnnnnnnnnnnnnnnnnnnnngttttcatattcgcacaaatttcgcgaatgcgaatacgaatattcgttacatcactagtaggtacctaattgctatgcttatgggctaatccggtccgttctcagatgtgactttcatctctgtcatgttactgtcaagaaactattcaaaataattgtttctccatacaaaaaatacattaatagtattattactctgctttcaaataactttattcaaacaccaagaatattacaatacatactttacagctttaacaaaatgacaactataaacgtcaaaattagatacagctgatctattatttgttaactttttatgttaatattcagtttctatagtgaagggtccaggactgtaatagctncatggtcctatgtatntagtacgatggcgcttac

SEQ ID NO: 8150 - DNA, 893 bp, Diabrotica virgifera
  misc_feature (866)..(866): n is a, c, g, or t
ctcatccatgattaaattgaagagcataggaccgattacccctcttgaatttcctgcctttttgtctggtgtatttggcgaatttctattggagaacgagtaattgctaaacaatttttgaaataataattattgatcagcacactaggcaaaaactgtcctttttgtgtatatgaaatggttttaataaaagaatacgactacaaacaaaattgcttaatcaataaaaataatttctatcctagtgggatcggtacccacctgagggatcgcatacgtttggatccaattagcctctctttgtaaagtcaaagacaatgaagtcgacttaactaagtaacacgacatttactcaacacatacactacacattacactataatctgattgcgaagtcacctcttattaatttccatatattctaataaagatagctaaggcctttattttgaatatgaagaatttgaaactgttcattaaaagaatgattatgatctagaaggggaagtgcgtatgtctgtttttctattgttgaaagcccttttgtgttttgctatccgtttgtcaaaggttctgccagtttgaccgatgtaagttttcggacagtcaccacaagtagtgtttacaaactaacaaactaaagtttaacagatgaacaataagggttttgtactggacgattgtgtacagatgtaatattcgtcataaagcaaattactgagaaatcactagagtataattgaccagcatttctatgtctatacctattgactatctgattgacttaaggaaaacatttgacagagtaagatgtagtccatcttctgtataatagggaagtccccctaatcataaaaactattganaacatctaccaaaaacaacaaaatgga

SEQ ID NO: 8151 - DNA, 571 bp, Diabrotica virgifera
  misc_feature (2)..(326): n is a, c, g, or t
  misc_feature (329)..(329): n is a, c, g, or t
  misc_feature (363)..(363): n is a, c, g, or t
  misc_feature (371)..(371): n is a, c, g, or t
  misc_feature (399)..(399): n is a, c, g, or t
  misc_feature (420)..(442): n is a, c, g, or t
  misc_feature (450)..(472): n is a, c, g, or t
  misc_feature (501)..(531): n is a, c, g, or t
  misc_feature (540)..(569): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntanattaccttagggataacagcgtaattttattggnagagtcanatcgataataaagattgcgacctcgatngtggattaagtttataatggnnnnnnnnnnnnnnnnnnnnnnntgttcgannnnnnnnnnnnnnnnnnnnnnnagttaaacccgggtgagccaggttggttnnnnnnnnnnnnnnnnnnnnnnnnnnnnnnngaaaggacnnnnnnnnnnnnnnnnnnnnnnnnnnnnnnta

SEQ ID NO: 8152 - DNA, 51 bp, Diabrotica virgifera
  misc_feature (7)..(7): n is a, c, g, or t
  misc_feature (12)..(13): n is a, c, g, or t
ttgatcncattnnttttgatataagaataaattaccttaggggatacagcg

SEQ ID NO: 8153 - DNA, 783 bp, Diabrotica virgifera
  misc_feature (572)..(595): n is a, c, g, or t
ctttttaacagaaaatatacataataaaagcgacaaaccagcacgtaaagaaactcaaccgcgtgcccggcacagagattctcattttaacgtatactaatagtccaatatagctctttctctgtcacttacatagaatgctcgtaaaatctttctctctttagtcgtgccagtactgactttgtcacgaaggagattcttctgtcgaataatctccgctgtcggcagggattgtattacgcccatagttgccatattttatataatttatgaagatcaaaagaaatacacacacaaaaattaacaggaattaaaaagttttgaagataaaaaatatgtttctgcatagttagcaaggtagtgccatggctctatggcactacctcacgggccgccactgctttaaatcaattgtggcacgagatgtgcgacatgttgcgccgtcttgttgaaaccacagctcctgcacatcatggttgttcaattgaggaatgagaatgacagtaatcgtggctctacgttgtgaccgctattatagcggtcaccattaactgtaacgttctggccagcannnnnnnnnnnnnnnnnnnnnnnnatgattccaccagcccgtaaattacaccaaatagtcagtttttcgagatgtaatggtgtcttaacgtacacttgaggatcttcacttcaaatatggcagttttgtttggtgacgtagccatttaaccaaaagtgaggttcaccgctaaaccaaattcgcttatgaaaatagggatcaacgaaattctc

SEQ ID NO: 8154 - DNA, 948 bp, Diabrotica virgifera
  misc_feature (830)..(830): n is a, c, g, or t
  misc_feature (911)..(911): n is a, c, g, or t
gagtgtgttgggattttggctagagatacaattaatttataggttgtagctcatatttaatgatgtgctgattggattataccgccaattcgctgactaaaaagggaaagctgcactgatcgcacaggtttcagtatcatcgatcccacacttcttccatcaccatggaaatataactcggacttttgtcactatcaaatttaggtgttgcccaaaaaagtagacgtttggaagttcgcaataaaaaattaatgaaatgatggtgatcttcgacaagacatccagcgaatactatggaccaggaaagcgaaaataatggatgttgcaaacaagaacctgaaggtaacgtgcagtctctacaagcaacacttttcccaatcaaacctacaaattcaactagttattttgccaattttataatcaaatcccctgccgaagaagatgatattcgattcaaaattagggaatcgccacacaaggactggttttcctgtaataaagacacgcctttcgactttcaaccacctagatggcccacggaatgccaagtgttagaggaaagggttaaacacataatcgactcaccctcaacatacgaagcatactatattcctactggcaccgagtgccaacctaaaccatcaggtgaagaatgcgggaaggttgttttccattatgtaccactcagtgctgtcaattattttagtagatctagcgtaggaggaaacaaatttatcctgccatccagtctttgtgctgaagaagacacactaaaattcgagtctagatttgagtgtggaaatttagctaaggccataatgattacgccnaattattacgaattacaccttagatctgatttctacactaacagacatatgcaatggttctatttcaggattagtaatggntaaaaaggatttttatatagattttctattacgaatt

SEQ ID NO: 8155 - DNA, 397 bp, Diabrotica virgifera
  misc_feature (2)..(265): n is a, c, g, or t
  misc_feature (328)..(341): n is a, c, g, or t
  misc_feature (344)..(366): n is a, c, g, or t
  misc_feature (374)..(395): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgttattttattggagagatcaatcgataataaagattgcgacctcgatgttggatnnnnnnnnnnnnnnggnnnnnnnnnnnnnnnnnnnnnnntggtcgannnnnnnnnnnnnnnnnnnnnnag

SEQ ID NO: 8156 - DNA, 738 bp, Diabrotica virgifera
  misc_feature (2)..(721): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatttaatttgggtg

SEQ ID NO: 8157 - DNA, 223 bp, Diabrotica virgifera
  misc_feature (14)..(14): n is a, c, g, or t
  misc_feature (140)..(157): n is a, c, g, or t
cttctgcggccggnctgttacattttaacagataagacaacccttgcaactttgaaatttcaaaagatgctattcggataacaaaagtattgttcgtatttatttggaattaatgtgacttactctctagctatagttgnnnnnnnnnnnnnnnnnnctaaaagttttaagtatagggtattttcattcacagtcatatgtatcgagcttctgtctacttctc

SEQ ID NO: 8158 - DNA, 760 bp, Diabrotica virgifera
  misc_feature (476)..(512): n is a, c, g, or t
  misc_feature (647)..(670): n is a, c, g, or t
  misc_feature (701)..(701): n is a, c, g, or t
cacagatgattaaccaaaacaaatagctatggaggaatttaatgataaattttattttgtctacagctcttcaatttcggacaaaattcaaattaaaattggtactttggaaggtaaaagacataaacctgagtatactaaaattttggaggatcccatgttaaagtactctggtttgtatcaagatggttgtgctgatttagtagtatcatgtcaaatctttgataacaatcaacccctcgccctacctgttactacttcttacaaagccttcacacaaagatggaattggaatgaatggttaactttaccagttcagtataatgatttgccaagaaatgcgcagctagcgttaactgtctatgactgttttgggcctaatagactttgtcctgttggaggtaccacaatctctctttttagtaaacatagtgtgtttagacagggtatgttggatttaagagtgtggccaaatnnnnnnnnnnnnnnnnnnnnnnnnnnnnnnnnnnnnnggaaaaccaaaaacggtaaagaacagatgcagagattggccaagctagctaagaaacatagaaatggttatatcactaaggtcgattggttagacagactcactttccgagaattagaagtagtaaatgaaaaannnnnnnnnnnnnnnnnnnnnnnntacttaatgatagaattccctaccattaacngtgatggtatgccacatcatattgtttacttcgagcaaaatggggaagaaatccttttc

SEQ ID NO: 8159 - DNA, 777 bp, Diabrotica virgifera
  misc_feature (86)..(125): n is a, c, g, or t
gtaatttaactttaacttaacaacaataattttttaattcaacagtcaacgtttcgttagattcctgttgcgattttgtctttacnnnnnnnnnnnnnnnnnnnnnnnnnnnnnnnnnnnnnnnnaactgtctagcaacaaaacaaccaattatagcatttacattaattgatcttattttaatctaagatgcctcaagattatgattcaaaagttagtttgcatttggatattaatcatggtctagaaagagtaacggaattagttcagactaggcttattgaaagtggctggagagatcaggtgaagttagcttgtcgtaaggcaattttggaaaatggtgaaaaacacccccctactgtagatgaattaataactcaaattacaccaaaagcaaggtctatggtaccagatgctgtgaaaagggagcttctgcacgaattggaattaattttagttaatgtggacaaagctggatacagtaaaaatttttaaatgatttaaaaaagttgaggactttatttgtttacataaaatatgtttagtgtactctaaaccttttatgcacgaaagaatgtctttcatgttttccacctttaacatgtttatacgatttataaaatatactgtttgaaactatgtgtggaaagctagtttgcattatataatgtctatacctaaatgctggtccacccaagtgtacttaaaacttattctttagatatatttcataagacattattttaacttgaaattaattaataaaacttcttttag

SEQ ID NO: 8160 - DNA, 901 bp, Diabrotica virgifera
  misc_feature (481)..(498): n is a, c, g, or t
  misc_feature (725)..(725): n is a, c, g, or t
  misc_feature (740)..(778): n is a, c, g, or t
  misc_feature (900)..(900): n is a, c, g, or t
aaacaagaacagtatattgtgttatttttgttattacatatatcctttatgcatttaaacaatttggtacttctgctacttactcagtggaccaaggatctaagtacgtttaaaatctaatatctttttctaataataaatgttttttgtttaattattgttactaaatacattagctttaggactacttatcctataaatttagtcaatttagctcttatagtaaaaaagttctagtataaaaactttaacttcatttttctcaataacttgaaaatgccacatggacccttcatgcacttgtgtcttcaattgtccgtattttctggcctaacatcgtcagaaacgaagatctactacatctgaccgaacaaaagagggtagaaaatgaaattaagtccagaaagtggggtttgatcggtcacacactccgaaaaaatagttccagtattgcaaaggctgccctagagtggaatccccnnnnnnnnnnnnnnnnnngtcgcccagcacaaacttggagaagagaagatccatcatggatgagataagaggtcaaggaaagtattggaattaggagtggttcaacacaacatctgtgcagcttttccgcgttgctgcagataaaataaagattgccatgatgatcgcaaacattcgtcacggataggcacattaagaacatactctttggaatattttggtattaccttcctgctctgaggtgngatcatggccacttnnnnnnnnnnnnnnnnnnnnnnnnnnnnnnnnnnnnnnnattctgcttgttcattggcggattgatacccctatggaaaggtgtcactccatcttttgcgcggtctgacgatattctaccccagtgctgtttttgtgacggtacgcgccggtacctcttgng

SEQ ID NO: 8161 - DNA, 973 bp, Diabrotica virgifera
  misc_feature (632)..(661): n is a, c, g, or t
cttagctgacggggtttcgcaaactatgacggcgttcaagcccaaaacgtcggcgtctagtcccacgtctggttcttcggcatcacgcacacctcagggccccattacgaaggtcagagaacgttcccagcgatcagtgcccatgggcagcctaccaagaacatcgaaatcgtctctctcagctggaaccccagactctctctcagataacgaaagttctacattccgtactcccaggaagccgtcctacaggtcaacgttaactccaggcggttcaagaagtaattctaggccccaatccaggactggaagcaggccgggcagcaagccgccgtctaggcacggatcgaacctttctttggatagcacagatgatgctactccatcgagaataccaagaaggacaccaacatcaggaagaagctcagctctttcgacgactaaaagcatcaacggttctggctctaggccacgcacaccaagcggtttgatatctccagctagtcccgttggaaggagtgcaagttcaagcaaagtaaaacaagtgactattggcgttgccccttcgctaaggacagcctctaggacccggacaccttcaggatccaacacacccgtacatccggatcaannnnnnnnnnnnnnnnnnnnnnnnnnnnnntccacgggtggcacagacactcccacaagccaaactagaaagaaaaagtcttctctttccgatcgggagccttttaggttataatttagtctcttaactattccaaaaaaaaaactcacactgactgacatgttatgttaagaaacttaaaatgttcatatttttgtataaatgtaaaatatttactggggatttttgttcggcaatgggaattggtgggtttgtcgaacaaggacatgtttggggattttttggtatatacaattaccagcactctatactaaactacttagtatataaagcaaaaaacac

SEQ ID NO: 8162 - DNA, 248 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(242): n is a, c, g, or t
  misc_feature (245)..(245): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannaanaag

SEQ ID NO: 8163 - DNA, 701 bp, Diabrotica virgifera
  misc_feature (558)..(577): n is a, c, g, or t
ctgcaggtaccgggccggaatggccgggccccttttgcgtccgattgtgtttcgtcttatgaagggccagagaccttttcacattggcgatttctgactatgttgtatccgaaatgaaggaagataataacgtaactcacaattgaggtcagtgaacttcgtgaatacccgaatgcattaaaagacgacgattaacgaggatgacaaccgtcacccattattatttctccaggtggagattcgatctcaaaggataccctcgattagtacgctctggctatatctgtcgagtctaacaatcatgagaatgtgttttgtacaaggagaaatatcagtgcctgaccatctacatgtatccactactcacccactgagtgagaacggatgagattcgacattccaacagaagccatgactatgatgactcctagcgataccacaacgaatatcccccgaggaacatcctactctagaaccatatcatctgaaaaaaatctgctaggctgattagggagatggacgaaactattatctttgtcaaaaactttcaagcagatnnnnnnnnnnnnnnnnnnnnaatgattcttaatgctgctaaatggcaatgagttctgactgttgtctaccaggatactcaaagatatgtatttttcgcgaactaggggactggtattgtaaagggaatgcagaacacgtttgat

SEQ ID NO: 8164 - DNA, 542 bp, Diabrotica virgifera
  misc_feature (66)..(91): n is a, c, g, or t
  misc_feature (173)..(199): n is a, c, g, or t
  misc_feature (295)..(317): n is a, c, g, or t
  misc_feature (414)..(438): n is a, c, g, or t
taaaacgattatataataattacattcacctgatcataccaacaccccttgtaatgataaaatccnnnnnnnnnnnnnnnnnnnnnnnnnncatgtgcttagagaatcaggaatgattacgtagtaattttatattcattgttctcgaattttgtaggagataaaataatgannnnnnnnnnnnnnnnnnnnnnnnnnntatccattgtgtaacgaactgtgattcgtagttatctgtctctaatttttgaacagataaatgaaaattagctattatacatataagtataaatannnnnnnnnnnnnnnnnnnnnnngaggacttttgggaatgagcttaagattatgcttttattatatatttaatactttaaatatgccttgggattagaaattttcataagataatatacnnnnnnnnnnnnnnnnnnnnnnnnngatgcttatcttttataacagtttttattaggaatatataagttaaattattcgaattaagaaatgacgatatgaatagtattcaagaattgtatatctaggag

SEQ ID NO: 8165 - DNA, 949 bp, Diabrotica virgifera
  misc_feature (857)..(857): n is a, c, g, or t
  misc_feature (905)..(905): n is a, c, g, or t
gtttgaatcactgatttgaaactggagtttgcacttttttggctaaagaggttcaatctgtggatcgtaactttcatataaaattgatttttttatcattttatcattgcaagcaaatggttttctagtacagtctggaaattagttttcgtagtcttggcataaaatggaaaacacctggactgtagtcaaatttccagacgaaaatgatgctgtggaagcagtgcccacttcttggttgcataacaatctttgctactggccacccttccccaaaaatgttattagagaggcaattgaatgttgcagcagcccggaaaaaagttggtctttatttaaatttgagcacctcaaaaacaatgttgctggtagttttcaagaagccaaaaagaaagtattttatgccacccaaaagtcagatctcgagtcagattcgcaaagttgcctagagaggggcttaaataaaagaaagattttcaaaaaacgttttgaaccgtattcgtcttttgaagaagatgaagaagcagacgattttccagagcctcctgcattaaaaaaacctaaaatgagtgacttgcaacgtgctggtgcaagtaccagcagaattgaagatacacctagaagtgtctctagaaatacattatttggtagcacaggcaatattcagaggacacaatcaccaagcaggggtgccaatttatcttcgccagccgttttttgcagtacaaacaaagatacgtctgacaatgatactactacaaatcatataattctggaacatttaaaaaagttgcttaaaaagcaaaacatcttacaaagtatgatgcaagatattgtaagtgacgtaagtgatttanaaaagaggctttgacaaagggatcaagacaatacattgcaggtccagnggcatgcttcgtctctattgacagaactagaatacttacctgta

SEQ ID NO: 8166 - DNA, 52 bp, Diabrotica virgifera
  misc_feature (14)..(46): n is a, c, g, or t
  misc_feature (50)..(51): n is a, c, g, or t
gtgataaaaaatannnnnnnnnnnnnnnnnnnnnnnnnnnnnnnnnatanna

SEQ ID NO: 8167 - DNA, 764 bp, Diabrotica virgifera
attgattacgccgtatgttgggccataaagcattctacacattgacgatattgacatattgctgtcttccacttgaactgggatactgacatagctcctttgaaggtcgacgaccgatgcgctcctcccaatgcaccaaaagatgacgaatatctgcaacgccaaatgccccgcattcttacttctccattcggagctcgatcccacaggataccaactatgactaccctctggcgccttcagtactgtcctacaaacaaaagactgtgctgcagacgtagagaaatactgtgctaccatcacatgagacactatcacccctgatgagaacagagtgatcgaattccaatggaacgagacgagactgactcctagtgtatccataaaaattatcccaagaagaactgccatattagaaccaatcatctgcaaaaatatccctaggctgattacggaaagggacaaacctatcatcttttccacaatctctctaccaaaccaacaggaatctaccgatgatatgattcttaatgctgcgacatggcaatgaacctacactgtggtctaccacgatactcatagatatgtatgactcgactactgggggactggtgttataatgtaaatgccgatcttcgaagattccatacgagaattctcatctctctccattacagatacgctctaccatagaggatatctctctgcacctgcatgccatggactgcctattgataaaatacaatgatacgcttcgaggatat

SEQ ID NO: 8168 - DNA, 170 bp, Diabrotica virgifera
  misc_feature (7)..(40): n is a, c, g, or t
  misc_feature (42)..(43): n is a, c, g, or t
  misc_feature (60)..(60): n is a, c, g, or t
  misc_feature (62)..(107): n is a, c, g, or t
  misc_feature (109)..(161): n is a, c, g, or t
taatatnnnnnnnnnnnnnnnnnnnnnnnnnnnnnnnnnncnngcgtatttgaccgtgcntnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnngtaaaaagc

SEQ ID NO: 8169 - DNA, 467 bp, Diabrotica virgifera
actataagagttcttatcgacaagataagatggttcgacagtggtgaaatatagacgcggtaggctcaggaatcctatgtgtttcatgacagatcgacctttaagttgttccgtgagcgtagttcacaacgcgatgatatcttggacatcttctattcttagcctataaaataaccgtactccaacagatccactgtagtggcataaatcaatctgtagattagctaattgctaaaaaataatcgacggcggcatgcccgctctagaagaacgactcgtaagaagaggtgcatgccgagatatttcttgtttattggatattagaaattcaatatatgcgtgggtttgtgattatttcttgacatggctcacctaggcttttgatattataatcaggttggtgtaatttgcgatattgatataacggatgtcctcattattgtttaccccaatggtcttctcttata

SEQ ID NO: 8170 - DNA, 471 bp, Diabrotica virgifera
ctgcgggtacgggccgggaattcccggggccctttcgcgtgcgcatgagtaccccccggatagaatttattctttgatacttagataagattgtgtgagaaaatttaatttgtgaaaattacgtgttttttttgggaacccagttgttaaggcatcattggtgcagatcatcgttttcactgatatcgaagattgatacgtgggaaagactacgtttggtattgtagtggcaatggcgaaagtaatccatgtgaaatgaaatgtgattcgcctttatatgtagctaaatagtgaagccgtgaattaaatttgagttgttcccgatgtatgcattattgaatatggttatattattatcattaaatggttttaggggtggggttaagaataagtggtattaaaacttaattttgccggagcccttatgattaaaaactttcataatttcatgtgtgctactacttatttcta

SEQ ID NO: 8171 - DNA, 947 bp, Diabrotica virgifera
  misc_feature (809)..(809): n is a, c, g, or t
  misc_feature (892)..(892): n is a, c, g, or t
  misc_feature (930)..(930): n is a, c, g, or t
aagtttcatataatttttaagatgagtactgttattaaaatcgttttaaaatggaacggaaaagaatttaatttagaatcatcggaagatgacactgtatctgatttaaagaaaaccatagaaaatgtaacctcagtaaaatgtggaagacaaaagttgttaaatttaaaatacaaagggaaaacgcctgaagatgattgtactcttggtcttttgaaacttaaacccaactttaaactcatgatgatgggttcacttgaagaagacatagcagaagcaaatactgcacctgaaaaccttcctgatgttgtcaatgatttagatatagaggaagaggaagttgccattgaaaatcaggatgtatatcttgcaaaagtggaaaaacgtatcaaagattataaaataaatatgttaaatgatctccggcctgaaaaaaagttgctagtattagatatagattacacactttttgatcacagatctaccgcccaatctggagcagaattaatgaggccttatttacatgagtttttaactacttcttatgaacactatgatattgttatttggtctgctacaggaatgaaatggatcgaggagaaaatgaagctattaggtgtttctacgcatcctgattacaagattgccttttatttagactctctcgccatgatctcagtgcacatacctaaatatggggtagttgatgtaaagcctctaggagtaatctggggcaagtttacacagttctcatctaagaacaccataatgtttgatgatattagaagaaacttcataatgaatcctanaaacggccttaggattagaccgtttagagaagctcatctaaatagggagaaagatagagaactgctccatctttgccagtatntaaaagatctcgctgaaaaactcaatggattttgctangtgtaaccatcggcatt

SEQ ID NO: 8172 - DNA, 965 bp, Diabrotica virgifera
  misc_feature (133)..(147): n is a, c, g, or t
  misc_feature (688)..(701): n is a, c, g, or t
  misc_feature (703)..(721): n is a, c, g, or t
aagcaagaatatacaaaagaacaacttgaaacacttttaaggactcatgaagccgcatgcaataatggaccaactattggaaaaaggcacattcaaattgtactagcatcttgtataactctccttaactatnnnnnnnnnnnnnnnatgtccgttatcatagttgctatgacagattctactgccaataaaaataaagatattccgacatacaactggactgataaaagcttagtagtatcttctttcctatggggatacgtgattccccaagttgcagcaggttatttagctactatgcacggagccaaatggtttcttgctggatctttaatagcaagttcaaccttagggttgctcgtacccatagctgctgctacatttggatccaaaggactcatggccatacgaatgttgcagggactgtctcaaggagttatgttcccttcaattcacgtgtttctgagtagatgggtgccgattaatgaaagaagtagattgggaactttaccatatgtaggttctcctgtaggtactgttggttcaatgctgttgactggcttaattgcatctagctggtacggttggcctatggcagtttatttttttagtagtctgggtctatgtgtgggcttagtatttgcttatttcggatgtagcgagcctagtatacattccaccataactnnnnnnnnnnnnnntnnnnnnnnnnnnnnnnnnnctggaactgagtctactgtagagaaagaagaggtagcacctgtaccttggacagaaatactgacttctttaccattctgggcacttcttctcgcacaaattggatggagctggagcaattggacgttactgctagaaacaccaatttacatgaaccacgtaatgaaatttgattttaagtcgaacagtgtattgtcttctcttccgtatattgccgaagcagcatcagcaatatgttacagcat

SEQ ID NO: 8173 - DNA, 58 bp, Diabrotica virgifera
  misc_feature (22)..(22): n is a, c, g, or t
tgcaaaagtttatttacatctntttgcacaaaacatataaataaacttttttatttat

SEQ ID NO: 8174 - DNA, 836 bp, Diabrotica virgifera
  misc_feature (35)..(53): n is a, c, g, or t
  misc_feature (90)..(104): n is a, c, g, or t
  misc_feature (709)..(709): n is a, c, g, or t
  misc_feature (731)..(731): n is a, c, g, or t
  misc_feature (754)..(754): n is a, c, g, or t
gtacatgcatcacctatcgattttcggtttgcggnnnnnnnnnnnnnnnnnnntttgttcgtttttatcttgatatctaaataacaagannnnnnnnnnnnnnnaacaacagcggcttatgatgagtgcttcggcaaaagcacatccgcctactcaaactattagtgctccaccacccatactgccacctcctggtctacccccttcagttctagcacaatctatgcccctaccgcccatgttaccacctagcatgcaagccctcggtatacctcctcctccaatgcctcccatgcccctgaacacagtctctgaccaaatccctcaacctcccatgtcggtggacccggaccctccgttagacgctgaaccagaactttcaccgcaacctgagatggagcctgatcccatgttggaatatgaacctccagcacctggaacagaagaaatccccgagatacccattgacccagcaaatgttccagaatgagatcggcctggttgcctcaatggagtcttggcatagctgtttagtgacattactgtagccgttcgctacccggactgtgtgagggatacgagtatatctatgatttgattcaaattggagaagtcattacaggtcctggtgcacgcagcagtacaattgcaggaattttaggaggagcgctgcccaaactatcatcggacgatgcagatgcagtcagcnaagcaaagaaatacgctatggnaacaagtattcgaatggttctcnatgaacagactattgcttatcaacaacagaaaaataaaacgttccagaggcaccaagtattagttttaatgtgcagagtata

SEQ ID NO: 8175 - DNA, 349 bp, Diabrotica virgifera
  misc_feature (5)..(100): n is a, c, g, or t
  misc_feature (107)..(144): n is a, c, g, or t
  misc_feature (164)..(177): n is a, c, g, or t
  misc_feature (180)..(202): n is a, c, g, or t
  misc_feature (210)..(232): n is a, c, g, or t
  misc_feature (262)..(293): n is a, c, g, or t
  misc_feature (300)..(336): n is a, c, g, or t
ccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattgttattttgg

SEQ ID NO: 8176 - DNA, 743 bp, Diabrotica virgifera
  misc_feature (605)..(605): n is a, c, g, or t
  misc_feature (610)..(610): n is a, c, g, or t
  misc_feature (701)..(701): n is a, c, g, or t
  misc_feature (708)..(708): n is a, c, g, or t
cggacgcgtgggcgaggttttaccacattttctcaaaagtgaagataataaacagatggaccaagtagatatagggtaccacaaccaagggggattactgacagtatcccaattcccatatcatccaccactgtcaaaatcgatcctaaaagctgcgcaagaattaggttacccaataagagatcttaacggcagatatcattccggttttgcaattgctcaaactaccaatagaaacggatcaagaatgagcacagctaaagcgttcttaagacctttcgttggtagaaaaaatttgcatattcttttgaatgctacagtcactaaaatattagtaaacagtaaaaccaaagaagcgtatggtgtagaacttttacgcgcaggagtcaaaagttctatttatgccagtaaagaagtaatagtatcaggaggagctgtaaattcgccacagatcctcctcctttctgggataggaccaagggaagagcttaaaaaggtcaaagtccccgtggttcatgacctacccggcgtaggtaaaaaccttcagaaccatgtagccttcttcataaatttcttccttaatgataccaatacgactccattanattgngctactgcgatggaatatttattatttagagatggtctaatgagcgggacaggtatttctgaagtaacaggctttatcaatactaaatacncagaccncatggaagagcatccagatatttcatacttctttg

SEQ ID NO: 8177 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8178 - DNA, 253 bp, Diabrotica virgifera
  misc_feature (17)..(32): n is a, c, g, or t
  misc_feature (34)..(78): n is a, c, g, or t
  misc_feature (80)..(135): n is a, c, g, or t
  misc_feature (138)..(155): n is a, c, g, or t
  misc_feature (162)..(187): n is a, c, g, or t
  misc_feature (191)..(252): n is a, c, g, or t
ttatttgatgggccgcnnnnnnnnnnnnnnnntnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnagnnnnnnnnnnnnnnnnnncgagaannnnnnnnnnnnnnnnnnnnnnnnnnaagnnnnnnnnnnnnnnnnnnnnnnnnnnnnnnnnnnnnnnnnnnnnnnnnnnnnnnnnnnnnnnc

SEQ ID NO: 8179 - DNA, 950 bp, Diabrotica virgifera
  misc_feature (126)..(145): n is a, c, g, or t
  misc_feature (473)..(485): n is a, c, g, or t
  misc_feature (488)..(500): n is a, c, g, or t
  misc_feature (612)..(633): n is a, c, g, or t
  misc_feature (796)..(796): n is a, c, g, or t
  misc_feature (839)..(839): n is a, c, g, or t
aatgatttaaaaatgtgtaactaatacaaattttagaaaaaaactgacttgaccattgaaaaattcagaaaattttacaaaaaaaaccttatataaagaatgttctaaaatgaaatctgtatcctnnnnnnnnnnnnnnnnnnnncgctaaagtcacccttctcacaaacattggcgcactgtaaactatgcactgtaagtgcatggttgagttattttaatgtaattctttaactaatggatcaaataaaattttacaaattgagcatgaaagaagaataattaatctatattatggttataatagaaaggaataaaatgtatggtcataagtacggtgtgggcggaaaatgagccttacatgaatgttgtttaaaaatgatttaaaaatgtgtaactaatacaatttttcttataaaactctcaattttgcacaatttaccttacaagcatcttactaaatgatgtttcannnnnnnnnnnnnctnnnnnnnnnnnnncaaatgatatgacgtctcaaaaaatgtaatttttgaaatctttgtagttttatagaattaccaccactttaagatggtattacttaagtttgaacagatctattacagttgnnnnnnnnnnnnnnnnnnnnnntaggatgtaatctttaaaatgcactaaattattttactttagaaataaaataaactatttctttttgagaaaattaagaaagataacaaaaatgtaatacaaaaaccgaaaattaccagctaaaaaaatgtttatacaaagtgatcaaaacttttttctgtanaacttacctaaaatacatttaataataagcttcacaataatanatgttcagtaaaaaaatgttgttttttatattctggaatataaaggtactttactctttaacgtaattcatattttttgacataactcatataaaattgataaaatttgat

SEQ ID NO: 8180 - DNA, 273 bp, Diabrotica virgifera
  misc_feature (2)..(166): n is a, c, g, or t
  misc_feature (168)..(214): n is a, c, g, or t
  misc_feature (223)..(224): n is a, c, g, or t
  misc_feature (229)..(271): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnggtgattannaaatnnnnnnnnnnnnnnnnnnnnnnnnnnnnnnnnnnnnnnnnnnnga

SEQ ID NO: 8181 - DNA, 690 bp, Diabrotica virgifera
cccccccccctttgatcagcaagatgtttatagaagaggacttttagtgaacctttcatgaatcatgtgtgcagtgagggggatgtagaacaggctggagagtaagattcgccagtggaatcagttggttcttctacaacgacggaggccgaggactacatcaccatgcgttcattgagcagaactagcccagaaagacggagccgagatggtaggcgccgccacagtacgggagaactggctataaggatattgggacggcacatgcacttgaaaatccaaatggaggtactaaaaacagcgcccataacgattagaacgtaaaaaaacttagccgacaagtctcgcgtctcccacatgaatgttcggttaccttgactggtgaaaacaacacctgtccggggaggaagatctcaggactacagttatgttttgaaccatctaaacccgagcgtagtctgtgttgtatcagcgatatcacacacatacattttaaggaagcacagtatacgacagaaaaaccttatagaaaatagcaatatttacgaaaatcgatgtggtgcaagcttacacctactctcctcctacgatgtgtttgcggagtcaccaacctcatgaacattctgagagatagatatatgcatcatcttggagctcaagtgtaggtttgtagcactctataacaatgct

SEQ ID NO: 8182 - DNA, 188 bp, Diabrotica virgifera
gactagtcaaactccaatctatttatcttttgacacatttcacgtaaatgcaggtaatgtttatgcactcttttgtgacatttacatgtttttttaaaggctttaattgtaagatctctaccagcatgaccacattcctgatgagctcattcagttgagctaaaacagcaatactgtaaagacgtcat

SEQ ID NO: 8183 - DNA, 683 bp, Diabrotica virgifera
  misc_feature (10)..(29): n is a, c, g, or t
  misc_feature (665)..(665): n is a, c, g, or t
ctaaccgtgnnnnnnnnnnnnnnnnnnnnctccgaaaaaatcatatgaatcttttgtcggcttgttaaaaatgttgtcttttataccacggtcactcaggaaaaagggactctatactaaaatcacaataaagatgcactaaaaataaacaaaccaaagacacttgaatgttatgaggagcaatcccgaatcatgatttacaatgtacatataaacaagacgggcacgccaggtttccccaacatgactctgtattgaagctgtaatcacaaaaaaagaaatagatcagtgacagcaaatgctggtcacaagacaattctcaaccaaataccaagaactataaatgcagaagaccaacacaagaggcatctcacaggagacgttatttctcctggtcaagtcatgggaattgaacatctaagggatccacgtttgaataaggggttaggatttacattagaagaacgtcaagcactaggtatacacggtctacagccagcccgttttaagacccaagaacagcaactagaactatgtaggatatcagtcgaaagataccaagaagatctaaacaaatacatctacctcacggaattgcaggataggaacgaaaaactgttttttaggctgttatctgaaaatattgaaacattgatgcccatcgnttatactcctactgtcgg

SEQ ID NO: 8184 - DNA, 116 bp, Diabrotica virgifera
  misc_feature (7)..(8): n is a, c, g, or t
  misc_feature (30)..(31): n is a, c, g, or t
  misc_feature (86)..(109): n is a, c, g, or t
accttannggatacagcgtaattttattgnnagagtcaatcgataataagattgcgaccctcgatgtggattaagtttataattgnnnnnnnnnnnnnnnnnnnnnnnnttgtcga

SEQ ID NO: 8185 - DNA, 933 bp, Diabrotica virgifera
  misc_feature (73)..(90): n is a, c, g, or t
  misc_feature (801)..(801): n is a, c, g, or t
  misc_feature (827)..(827): n is a, c, g, or t
  misc_feature (877)..(877): n is a, c, g, or t
  misc_feature (883)..(883): n is a, c, g, or t
  misc_feature (904)..(904): n is a, c, g, or t
cgtaacattgataataaaggagttgtcagaattgaggtagctgagggtaatgttggttatctgtagtttttcnnnnnnnnnnnnnnnnnntggaaggatgtagttgcatattagaatgtagtttttaattccaaacaacttttcataatggcagttttcaatgttgtgaggaatggagctgctttgctcttgagtgaaattcagactttttgacgtgcctcgtataatgttcgaaaggattgatatgtgatggttaaatcttgggttttggacaatgcggagctttttgcgaagaaagcttttttccgtgaaatggataatagaaggttttccatatggatacaacttacagggacctattgtataataaataccattttatactatatatttttttagaagtaaataaaattctgtttgggtcaaatggacgcgaacaaaacagcagggttaaaatcaaaatgggcttggaaaattttaagagattgtgtataggtgatggattttggaaagagctgtgaccttgaaaatgtcacataaacttgtgtactaaatcggaataattcatagctcttgttaaaatccaacaccttaataatataactaaatattttcgattctaaaatattgtaaaagctaaagaatctgacatttttttcatttttcaattgtgacattttcaaggtcatcgctcttcccagggtccattacctatattatatattattcactgttttccatagatctcagtctatatagctctaccaaatcaatataaagaaatgctttgtccattttatncattagtgatataataagttgataanatcatctactcaaaaccaacagatagttattttatattccatttaacccnttgctntgtcaggattgattgtgaaanttttacagtgaaagacgtatcatcgtaaa

SEQ ID NO: 8186 - DNA, 958 bp, Diabrotica virgifera
  misc_feature (305)..(305): n is a, c, g, or t
  misc_feature (670)..(670): n is a, c, g, or t
  misc_feature (788)..(789): n is a, c, g, or t
  misc_feature (801)..(837): n is a, c, g, or t
  misc_feature (892)..(892): n is a, c, g, or t
caaaaaaggtttttaaggtgtaaaataggtttaggtttttgatgaagagaacacgttgaaatatacgtcttcatctctgtgcttctaatactaatatacgaatatcggcttagaaggacaacggacaacccacgtttgtagagtgattaacttgaagtatacaaagtatatgtccgcctttgccttatcgaactttttatatctcttgttttaagggacaagatgattgagttaacagtgaagactttggattcccaaaaccatcaattcacagttgaggatgacattacagtacagcagtttanagtcaagatagcagaaactgtgaacatttctgctgagactcagcgtataatttactgtggcagagttttgcaagacaactcaaaattagctgattatgatgtcaacggcaaagttgtgcatttggttcaaagacctccacctggaactactccaagatcaaacagtcgctcgacttctccacaaccgcaaaggagaggtttcagaggattcagaaatttggagcaaggaaatgcaatgtacctaggttcagttgcttttccaggatcctttatggaatcccaaggaatagaaccacctcctccaacatccagtttatctcgtagtcgtttaaatgttgcaagaagaatgctgaggcgagcagaanatctcatacgggtgttagaaacaaatccatctggcaggtcacaagaacaagctgcagaagaaatccagaagaggaggaaagaagtactccggttatagaagcaagagttattgttccnnaacccaacagtnnnnnnnnnnnnnnnnnnnnnnnnnnnnnnnnnnnnncgacactttattgaatggctgcaacatgggaggaatactgctccccttgacaatngctgacgacgctgcagcaacactagtactcagaacatcagcacagtacttccccagatcttcactg

SEQ ID NO: 8187 - DNA, 678 bp, Diabrotica virgifera
  misc_feature (6)..(83): n is a, c, g, or t
  misc_feature (110)..(147): n is a, c, g, or t
  misc_feature (159)..(266): n is a, c, g, or t
  misc_feature (278)..(330): n is a, c, g, or t
  misc_feature (361)..(426): n is a, c, g, or t
  misc_feature (474)..(498): n is a, c, g, or t
  misc_feature (594)..(613): n is a, c, g, or t
  misc_feature (640)..(664): n is a, c, g, or t
caaacnnnnnnnnnnnnnnnnnnnnnnnnnnnnnnnnnnnnnnnnnnnnnnnnnnnnnnnnnnnnnnnnnnnnnnnnnnnnnnccccctaaaaaagggggtaaggggggnnnnnnnnnnnnnnnnnnnnnnnnnnnnnnnnnnnnnncccccgaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaaggggnnnnnnnnnnnnnnnnnnnnnnnnnnnnnnnnnnnnnnnnnnnnnnnnnnnnnccgggggggacccaaaaaaaacccccggggnnnnnnnnnnnnnnnnnnnnnnnnnnnnnnnnnnnnnnnnnnnnnnnnnnnnnnnnnnnnnnnnnngggggcaccaagaaggggaaaaggggccccccccagacgggcccaaannnnnnnnnnnnnnnnnnnnnnnnnacccgaggggagataacaatgttggagagggccccgacgccccccttttctcttttttccctcttttttgcccgagagtgggggggtttccccccnnnnnnnnnnnnnnnnnnnnccccaaaaggaggcaaaaaaaaggcgnnnnnnnnnnnnnnnnnnnnnnnnnattgaaaagggggg

SEQ ID NO: 8188 - DNA, 845 bp, Diabrotica virgifera
  misc_feature (425)..(425): n is a, c, g, or t
  misc_feature (439)..(439): n is a, c, g, or t
  misc_feature (511)..(512): n is a, c, g, or t
  misc_feature (670)..(689): n is a, c, g, or t
  misc_feature (699)..(699): n is a, c, g, or t
  misc_feature (704)..(704): n is a, c, g, or t
  misc_feature (743)..(743): n is a, c, g, or t
  misc_feature (766)..(766): n is a, c, g, or t
  misc_feature (796)..(796): n is a, c, g, or t
  misc_feature (798)..(798): n is a, c, g, or t
  misc_feature (800)..(800): n is a, c, g, or t
ggaatacgttgtcgaccaggaatactataaaagtctgggatatacaggaccaaaacccactttttcaaaaaaagtttatactgttagagtcgatggaataagttttgagctggtagatccaattgtattggataactgtgattcgattgagactatttttgatgtagacacaagcaaatccgattatctaccaataccaggtgaacatgcgctcaacgtaagctccgattgcacgctgatgtttccgcttatattcttgaaggcaaaaggcttcagcaatcaacccttcggaggcttcatcaccatcagggcacttcacaataaatacgtcttggacattacttcgctagttctaataccaaagtcagatcctagagatattcgaataatttttgaagttgatggaaccgaatatataattttanactacttttatttnaaaataacgtttatttccattttgctgatcactgcttttattctagccgttgaattaaggagatcataatannattacacacaaggtataacatctagagactaatattaagttattaggatcttataatattattaacaataatgtggtgatatttttaatatcttgtacatcattttgttgtggtgcttgcacccttatctagtcataaatttgattgatatatattgnnnnnnnnnnnnnnnnnnnnatgactcctntgttnattatgtacacatatctcatgagtagaccacgatattanaatacaatatttatttgatgttntggcttccagaataactactattttgcatntntngagtgattccgatcattactgattcctttctcatctcatggtcac

SEQ ID NO: 8189 - DNA, 341 bp, Diabrotica virgifera
  misc_feature (10)..(28): n is a, c, g, or t
  misc_feature (102)..(120): n is a, c, g, or t
  misc_feature (189)..(207): n is a, c, g, or t
cgatttatgnnnnnnnnnnnnnnnnnnnctatccctaaagcacagaaaaattttactcaatgatagttaattaatattgcgagagaatatttcatttttaannnnnnnnnnnnnnnnnnnctgtaccctcggtgtcacgaatcattaaaaaacactgatatactaattacttcccaatataagagcgcnnnnnnnnnnnnnnnnnnngctgcaaaaactaatattaataaataacctttctgtaaggcactgttcatcctctctaaatatctcctatttccctaaggaaaacaatgataattagtcacctaccccatatatttacactcaaataaccctac

SEQ ID NO: 8190 - DNA, 923 bp, Diabrotica virgifera
  misc_feature (526)..(558): n is a, c, g, or t
  misc_feature (849)..(849): n is a, c, g, or t
aacccgacacaggtagaattgaagtattccgttccggagaaggtatgggtatccgtctcgatggagcctcagcctttgcaggagctatcatttcgccatactacgactcgttgttggtgaaagtcatagcccattcgaaagacttagccagttcctgtgccaaaatgaacagagctcttagagagttccgtgtcagaggcgtcaaaacgaacattccatttttattgaacgtgctcgaaaaccagaagttcctaaacggttcggtggatacctatttcatcgatgagaatccacagttgttcaaattcgcccctacgaagaatcgtgcccaaaaactgctgaactaccttggagaagtcttagtaaatggtcctcagacgcctttggggacgaccttgaagcctgccgaaattaaaccacatgtgcctgttgtgtcacaagagtacctggtgacgaatcccgaccatgttccaagtattgaaccaccaaaaggattccgtcaaatctacaaagaacagggaccagnnnnnnnnnnnnnnnnnnnnnnnnnnnnnnnnngagttctgttgatggacaccaccttccgagacgcccatcaatctcttctagcaacccgtgtcagaacccacgatctcctgaagatctcaccgtttgtagctcacaacttcaaccagttgtactcgctggagaactggggaggagccaccttcgacgtagctctaaggtttctacacgagtgtccatgggagcgtcttgaagacatgagaaaaatgattcctaatattcctttccaaatggtgttgagaggagctaatgctgtggggtacactaattacccggataatgttngttacaaattctgggatttagcgggtcaacggggtatggacgtcttcagagtattcgactcccctcactatcta

SEQ ID NO: 8191 - DNA, 242 bp, Diabrotica virgifera
  misc_feature (7)..(158): n is a, c, g, or t
  misc_feature (168)..(168): n is a, c, g, or t
  misc_feature (173)..(222): n is a, c, g, or t
gaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatttanttggnnnnnnnnnnnnnnnnnnnnnnnnnnnnnnnnnnnnnnnnnnnnnnnnnntttgatccatttttttgata

SEQ ID NO: 8192 - DNA, 479 bp, Diabrotica virgifera
ttaatacaaaatgtttaaatatttcttactttttctgattgctgctgctttggctgccgacacttatttgtccgatgatgaagagtttgaaaaattcaagaaagacttcagcagaaattatgagactcccaatgaagaacagcaccgcagaggaatttttgttaatactttaaatacagtcaaagcacacaatgccaaattcgaaagaggagaggtttcttattccttaggcataaaccagttcgctgatcttacccaagatgaatttgaaaacaggtacacaatgaaaaagtgggtagagcaacagggaaaaggaaaacttgccacgaaaactgctacccagaattaatctacggaattatcgatctattgtagggtttattacagaatatatggagtaatggatatgatagaaatatctatcatatccattagtcattacagctaactgttttgtttgaaacaataaatttttacat

SEQ ID NO: 8193 - DNA, 947 bp, Diabrotica virgifera
  misc_feature (149)..(163): n is a, c, g, or t
  misc_feature (529)..(553): n is a, c, g, or t
  misc_feature (881)..(898): n is a, c, g, or t
gttctgggaggttcgagaaatctaatttgaatggctcatcgagtgacccgctttttatgatcgcgagtgtatattacacgaggtaataaatccattgcgatacgcagtaacgacactcgccttataaaaaatgtgttctgggaaaggcnnnnnnnnnnnnnnntagggcggcctagaaaaaggtggaaagatgctgtcaaagaagatctagagaaaatgggagtgcgacaatgggaattagtggcacaggaccgacaaacatggaaggaaatagtaaacgcggcaaagactcacgaagagttgtagcgccattgatgataatgatgaataaatccattgtttaatacctaaattatattaaacaaaacgtatgaaaacaacttggaaagctttatattttgaatagactacaatataaatagagtgtacaaacatcgggcagtaggcataaatcgccaaacaagaccaatgttgaaattttcggtacgtctaaaataaaagccacaacgtagtctcacgcctctattcnnnnnnnnnnnnnnnnnnnnnnnnngtgttaatactacaagagaaaaatatagaacatccaaaatgattctttacgtgtagaaaaagagtttcttgtaaacttattcaaattgtttcaatgataggatctatgatgcgcattttaaactgtatattaatattacctaaaaattaactttggaagtagaaatttagagatgttagaatagtaagtgtagaatgtacctattccaaaaattgctaattacttcgatatttccatgttcgcaaatatagcaagaccattcaaacttaaagtatattattagatgttagagtattgtaattttatttgaatggtattaaaaagctgnnnnnnnnnnnnnnnnnnggaacatgtaacacatacgaaatgtacatttaaatagaaaagtatagtt

SEQ ID NO: 8194 - DNA, 81 bp, Diabrotica virgifera
  misc_feature (3)..(80): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnna

SEQ ID NO: 8195 - DNA, 801 bp, Diabrotica virgifera
  misc_feature (16)..(16): n is a, c, g, or t
  misc_feature (726)..(745): n is a, c, g, or t
agattggagaaaactnagggttttacaacagtcacaaataaacaaattagagatgcaaaacagggctcttgatgtaactataggatctttaggaaattttgttcaatctttaattgaacaaaaattagaccttgaaattcctgatgatgtacaaagaatattatcacaattatcatttacagaccgaataaaacatgaagtaaaacctcatcaaaacaaccttttaagaatgttccagaggtctccggaaaaaataatgactaaatcacaaagtatgggtttaattaatttaccaaccaatgttaataacaagccccgaccaaactagatctagaactagtagtctaagtaaaagaaaagaagctaatcccaatctgacaaccacccctaataattcagctgaaaggatatccaaattcttttcagggtctcatcacaatatactccaacagaaactaaacgctcaaaacaatattttaagtaatactaaaatagatataacagttcaagagttcaaaaatgaagatttacgtgaaaataatcctgtagagtttccattcgtcaacaataacatctctcctacaaactctgaagacagtggtgtggtatctccagctagtaaccctctaagtcctaaatctgtagattcacaccccttaagcaactgtgatgtttcttttatgtttaacggtacaagggaactaaaaactataaggaacataaatnnnnnnnnnnnnnnnnnnnncgacattactaataaatgattcagaaagtattttaggttaatattaactataggaa

SEQ ID NO: 8196 - DNA, 972 bp, Diabrotica virgifera
  misc_feature (773)..(773): n is a, c, g, or t
  misc_feature (870)..(870): n is a, c, g, or t
atcagccaagagaataggctggttttcgccccaagtacggtacaaatgaccacctacagtgcataaaagttttgattgaaaaatcaattgaatacaatagacctctacttctaacgtttatagactttcagaaagcgtaggtacaccaatattatataaaatgtatacagaaatgctacaacaactataactctgcacggtcctaccaataagatacatatcaggagaggtattcgacagggagatactatgtcgcctaagttgttcattactgtacttaaacatactttgaagtcactgaaatggaaaaataaaggaataaatatcgatgatgagattcgcagatgatattgttctgatttcagatgacctaaaaactgtcaatgatatgttgaatgaattcagcgatgcagcacgtaaagtaggtttaaatattaattaccaaaagacaaatataatgacgaatttagttccgagccatacttaaaggtagaagacgtcgaaattagagttgttgaaagctacatataccttggacatatggtaaaaattagcagacaatccaactgctgagctgctaagaactctgggttgggcagcatatggaagactgcgtgatatttttaaaggtgatatacctatcagcttaaagagaagagcctttaatcaatgtgttctgcctgttcttacatatgacacagagacacttactataacaaagacatctgcacgaaaactacaagtgacgcaacgtagaatagaaaaattgctgngcataacgttaagagatagggtaagaatcgaagaaattcgtagaagaagtggtgtagaagacattataaaacacaaccaaaattacatggaaaaggngaggacacgtagctaaaatgaagatgataggtggaccaaaaaatcttggagaccgagagcgaaagacgaaacccgggaagaccacccacagatggactgacg

SEQ ID NO: 8197 - DNA, 552 bp, Diabrotica virgifera
  misc_feature (5)..(32): n is a, c, g, or t
  misc_feature (47)..(135): n is a, c, g, or t
  misc_feature (147)..(298): n is a, c, g, or t
  misc_feature (307)..(308): n is a, c, g, or t
  misc_feature (312)..(532): n is a, c, g, or t
  misc_feature (546)..(546): n is a, c, g, or t
aaatnnnnnnnnnnnnnnnnnnnnnnnnnnnnataaaattaggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatggnncgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggggtgataanaaaata

SEQ ID NO: 8198 - DNA, 571 bp, Diabrotica virgifera
  misc_feature (6)..(23): n is a, c, g, or t
  misc_feature (48)..(73): n is a, c, g, or t
cgtttnnnnnnnnnnnnnnnnnnccgttgatatataaatatacaaggnnnnnnnnnnnnnnnnnnnnnnnnnnctcttaatatcttcttcttatggtgcctatccgttacggatgttggacactaacatggctattctgactttgttgactgctgccctgaagtccgggagtggttaagttaaaccattttcgcaggttatgcagccaggatattcttcttcgtcctggacctcttttcccatgcactttaccttgaagtatggtccgaagtaggtcatatcgttgttcattgcgcattacaaggcccaggtattccagattgcgacgttttatggttacgatgtagttcgcgctctttacccattctatgtagaacttctgtcgttggtgactgactatgcaggaaatcctcaaaatgcgtctattaacaccccatctaaaatgcttcgagtatcttcagtgctgcttctacttaggtgcatgacatcccgccatataaaagaacggagatatacataccacgttaatataacgaaattttttatataccattttatatcgcggctgtta

SEQ ID NO: 8199 - DNA, 923 bp, Diabrotica virgifera
  misc_feature (12)..(30): n is a, c, g, or t
  misc_feature (143)..(160): n is a, c, g, or t
ggacggaggtannnnnnnnnnnnnnnnnnntaatataagtgctacttaaaacaaatatactgttacattaaaacagtaagaagaacaaatacaagcaaataattagattataatggctggacgagtgcctcgtttgggagatnnnnnnnnnnnnnnnnnnagtatatattacctaaaaaaagctaagcaggcttgtgtaaaaaacgatttcgccgaagcctatgaaaactttgttttgtattttgaaagtttaaatgatcccgctgaatctacttctgcagtgcaaactgtctttacaaaactcgtttgcaaaatgggagcggttttggaagaaacatccaacatagaagagctcttgaaatgttatattcaagctttaaacctatttcctgacaattatgtcatactaaataatttgggcgcatacatgttcaaaatatcggaagtagatatcgctcgaagatatctagaaagagcagtaaacgtcaacaaaaattaccttcccgcagaaatcaacctgatgcgcgtcaaatggcatcagataccaagatggcactttaggatgcttaatgacaaaggtagaaatctggcgtacgacgaagccatcagagaagtcattaaaaatggatacaaaaatgttatagatataggtgcgggatgtggacttttaagtttgatagctgctgagatgcccggtacttctgtcatagccattgaagaaaataagcagctctataatttatgtgtagatattatgaagaaaaatgaagtttccaatgtgaaagttctgcagtgttattcactggataatgaagaagttctagataaatgcaattttctggttacggaggtattcgactgtggatttgtcggggacgagctctagaaaccatttatcacgcatcaaaaatgttacgtaccga

SEQ ID NO: 8200 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8201 - DNA, 269 bp, Diabrotica virgifera
  misc_feature (6)..(47): n is a, c, g, or t
  misc_feature (53)..(75): n is a, c, g, or t
tttagnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 8202 - DNA, 811 bp, Diabrotica virgifera
  misc_feature (153)..(185): n is a, c, g, or t
  misc_feature (499)..(517): n is a, c, g, or t
  misc_feature (761)..(779): n is a, c, g, or t
  misc_feature (785)..(809): n is a, c, g, or t
attattttggtagctcttttgagcttgacagcagctaaatctgttgaagatgcgttgttaaaaaatggtttgcaaagcaaatttaaggatgaaagaaattctctagagggtgataaactgactgcaataaatactgaaataaatgaatttgtnnnnnnnnnnnnnnnnnnnnnnnnnnnnnnnnnagaaaaatctaaattggaaccaatactactggataatataaaacagcaattccttactgcatcaatcgaattaacgcatggaaagctgaacggtttatcacatgtttacagagatggtgatgttacagtaacttacgatcgtaatgccaatattattacgttgaaccttccactacttttcaaaaaattaagttttacgtatgactaccacgtcgtagtttttctagttggaccgacagggggattgacaggatctatcgataatttcagactatcaataaatctgagcttagatcttaataagtatcaggcannnnnnnnnnnnnnnnnnncttcgaatagtggacatatcaccgtaaagttcgacggacacctgtcagatgtcattctaaatatcatgtcacaatttgtcaccacagcgctccatccaattcttcaaggttttattgaagccatagtaaaaaatgcatccaataaagttgtagatggtgtaaacaaagtaatagatgaaattctgaatcccgatgtaataaaaaatttcgacttaacacaatatcaacaatatttgagataagnnnnnnnnnnnnnnnnnnntactannnnnnnnnnnnnnnnnnnnnnnnntt

SEQ ID NO: 8203 - DNA, 780 bp, Diabrotica virgifera
  misc_feature (2)..(760): n is a, c, g, or t
  misc_feature (763)..(779): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnng

SEQ ID NO: 8204 - DNA, 876 bp, Diabrotica virgifera
  misc_feature (643)..(643): n is a, c, g, or t
  misc_feature (679)..(679): n is a, c, g, or t
  misc_feature (707)..(707): n is a, c, g, or t
  misc_feature (717)..(717): n is a, c, g, or t
gattattgtatcaaaaccataagcatcagcattcagaaatcatcctgctggtacaaaaaggccttgaaaatttttctgaattggattttatacgcttgtctactcagttttgtttgcaaatcctttataattcattattatatcaaaactattagcagcagaattcagaaatcatcctgctggtacagaaaggccttgaaaatctttctgaattggattttatacgcttgtctactcagttttgtttgcaaatcctttataattcaatattgtatcaaaaccattatcagcaggattcagaaatcatcctgctgctacataaaggccttgaaaatctttctgaatttagttttataagcttgtctgctcagttttgtttgcaagtgcatacttataattgattattatatcaaaaacattaacagcagtattcagaaatcatcctgctggtacataaaggctttgaaaatcttcctaaattgagttttataagcttgtctactcaggtgtgtctgccaatcttgtataattcaatggtatatttaaatcattaacagaattcacaaatcattctggtggttcataaagggcttggaaatcttccttaattgaggttattagcttggtcacttcatttttgttngcaatacttgttattgattaatgtatcaaaacatangcatcagcattcagaatcatcctgctgntacaaaaggncttgaaatttttctgaattggttttatacgcttgtctactcagttttgtttgcaaatcctttataattcaatattgtatcaaaaccaatatcggcaggattcagaaatcatcctgctgctacataaaggccttgagaatctttctgaattgagttttat

SEQ ID NO: 8205 - DNA, 1182 bp, Diabrotica virgifera
  misc_feature (1058)..(1077): n is a, c, g, or t
  misc_feature (1122)..(1179): n is a, c, g, or t
ggtcgtctcgtgtcgttggtttgaatagttgaataattttgtgactgcattgtgtttctatatttttattcgtctgccagtacgtctgcaagattttgacaagtattttgtggattaggttacatgacaccaaaatgaatctattccagtttgctattttcttaggatactttagtattggatactgttacacaaaatatggaagaacttgcaaagacataggatgtcccagtactcaagaatgtgtcatggccacagatccatgtagttactaccatagacaaggggaatgcggttcctatcccacatgccaaagagtttcaaatgcacccaggacatgctctacgtacgtttgtccgcctaccaaagtatgtagaatggatggagatacaccaaaatgttttgatgatgtgggcaaagttggccatgtaggttacgagactagtggaaacactaatcatttatcacaaagtggacataatggtaatctgtatcctaatctaccaaaaggagaaacaacacctaggccgaatattaacagaccagttagttcaggtggatatcaaggaggtcaagtaggttctggttatccaggaggacaagtaaattcaggttatccaggtggccaagtaggttcaggctatccaggaggtcaagtaggttcaggctatccaggaggtcaagtaggttcaggctatccaggaggtcaggtaggatctggatatcctggatacacacagcaaggaggttatcccagacaaggatatccacaacaaggatatccacaacagggttatccacaacaaggtaatcaaagacaaaccggataccacaatatggatgatatccacaaaccaacaaaccaagctcggggactccatatcagacaaatcactagcggccttaaatcatagggctattctgtgttgtcttggtgataccaggctatttatatatgaaaataaatttggataaatttacccaactaatatacttaaattctaacaaaattcccgggctataaatgggggatttttttataaaactgcgtggccaannnnnnnnnnnnnnnnnnnncctggctagggaattctctttttgaactcccatgccttggttccnnnnnnnnnnnnnnnnnnnnnnnnnnnnnnnnnnnnnnnnnnnnnnnnnnnnnnnnnnccc

SEQ ID NO: 8206 - DNA, 199 bp, Diabrotica virgifera
  misc_feature (20)..(20): n is a, c, g, or t
  misc_feature (71)..(71): n is a, c, g, or t
  misc_feature (79)..(102): n is a, c, g, or t
  misc_feature (104)..(104): n is a, c, g, or t
  misc_feature (110)..(131): n is a, c, g, or t
  misc_feature (161)..(161): n is a, c, g, or t
  misc_feature (169)..(191): n is a, c, g, or t
taacagcgtaattttatttnggagagtcaaatcgataataaagattgcgaccctcgatgtggattaagttnataattgnnnnnnnnnnnnnnnnnnnnnnnntngtcgannnnnnnnnnnnnnnnnnnnnnagtttaaaaccgtgtgagccaggttggttnctatcttnnnnnnnnnnnnnnnnnnnnnnncgaaagga

SEQ ID NO: 8207 - DNA, 672 bp, Diabrotica virgifera
  misc_feature (87)..(112): n is a, c, g, or t
  misc_feature (620)..(647): n is a, c, g, or t
aaacaatactgatccaaagtggatagacgctttcttgatttgctatttctaagtacataacgtttgaaactgagtttctctgtaagnnnnnnnnnnnnnnnnnnnnnnnnnncaaaaacgaccacacagacgaaagtgctcattcgccactattgcacattgtactactatctttaataaaatatctaatatttcaaataaagtcacaataggaaatacctttaacctttacaatactatcagcggtttttctaataattcagaaatcattccaaaatggaaattcagtacttaactaaggaccatttaattgggtttgataattacaagtataactgcatagactctggcatattgagtatatatgttatgcaccccttctggaactgggtagtaaaaagatcccaatcctatacgcgcagcttacgtctattgctatgctgggcgtgctgtacctatgaccaagaagtttctcaaatgataaggaagttacatacatgatgcagaatgtatattgaaacggacttacagaggaaaaccagtaattaaacaatgtatcataaaaaggctgtaaatatttcactcgagataaatgcgttaaatctgtataatcgtattgnnnnnnnnnnnnnnnnnnnnnnnnnnnnttactacataacagcttccgaacag

SEQ ID NO: 8208 - DNA, 853 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (635)..(684): n is a, c, g, or t
  misc_feature (689)..(797): n is a, c, g, or t
  misc_feature (812)..(840): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatggtttttaataaacaggtgaaaaaaatggttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattttatttannnnnnnnnnnnnnnnnnnnnnnnnnnnngctcatccctaaa

SEQ ID NO: 8209 - DNA, 923 bp, Diabrotica virgifera
  misc_feature (840)..(840): n is a, c, g, or t
aaaatacgcagagtgtttagcttcttgtgatatgatagagcaagccatcgattcctactacacagtgaaagaactagctccaggtcacgttgaagtattatatcctctagccatgttgttgctaaaacaaaaccaaagagaagaggctctgaaagtgatgtcgcaagattttagcgctaataaattagatgtagctgttctattggaacagatgaagctattgaaacagatcaacaattgggaatcctactggaaatgcatggaattgttaatgtctcgacattgtccggtactcaaacatcccgaagagttgaagatactgctaaccaaagagaggcctcctgaaaagctagctaaattgagaaagatgagaaatttcaggaatgatagtacgagtgttgaaagtaattttacggttattaaagagcttagtttagaagaagactatgacatttataagaatattttacagttatccatagatagaagagaatattgttatttgcagaaattcacttttatgggcttggcgtcaaagaggtttcaaaaatatttctcggaagtcaacatcatggcggctttctcatgtttattgactaacgactgcttccatgggtacaacttgttaagagaaaccctcatgagatattcaaataacaatctggcttggaactggttcggcattgtaacagctacgcaggaggagctgcgttttgccagattcttggaaagatttggtggcagcttgccaatagacaatcgcagaattatcatagccaatcaccatttgtccatgggaaattacattaacaccatcaatttttacctgaagagatacanagcaaccaactcagtctttgcgggcgtcatggtagctgtagcgatgttgcagcattatcatcataaaagcttggataaagcga

SEQ ID NO: 8210 - DNA, 900 bp, Diabrotica virgifera
  misc_feature (8)..(701): n is a, c, g, or t
  misc_feature (708)..(731): n is a, c, g, or t
  misc_feature (741)..(741): n is a, c, g, or t
  misc_feature (780)..(802): n is a, c, g, or t
  misc_feature (817)..(817): n is a, c, g, or t
  misc_feature (836)..(836): n is a, c, g, or t
  misc_feature (874)..(875): n is a, c, g, or t
  misc_feature (879)..(879): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcgataatanagattgcgacctcgatgttggattaagtttataattggnnnnnnnnnnnnnnnnnnnnnnntgttcgacttttaanattttacatgatctgagtnttaaccggtgtgagccagggtgggttctatctttattnnatantatattttagtacgaaaggac

SEQ ID NO: 8211 - DNA, 698 bp, Diabrotica virgifera
  misc_feature (647)..(664): n is a, c, g, or t
  misc_feature (672)..(672): n is a, c, g, or t
agatatcagaaaagttgtctacaggagggcatgtacttagtccaaaattgacacaagaagaaagtaccttaataaagcagatagcgttgaaggcagaagaggacgcgaataagaaagaaccccatagcgaaagtaaaagaagagaagaaagtacatcgggagagagagatgatagtgaactcaggcaaagaatttctacgcaagtaaatgaatctgttgatgaaagtattttagcacctgcggccgatcctttattagaagattcaattcaaagaagtaatacggataaattatggacagcagcaatctggatattaataaccataatagctctcctgctaatacgacggatttttttcctataagccaatagcagtataaaacattgtatctctttaaatagaaacttttataccaacatgaaagcagtgtaattaggacacagtgcactgtattttataagtaaagactaaagacaaacatttgtatattgtatgtcgtcagatctcggaatttgacattatgctgagtattaggatttcagttaactgtatagtctttaaattctttaataagtaaaaagttcatttttattctcaataatgtttatataggaaggtatttggatggacaggattagaaaggannnnnnnnnnnnnnnnnnggctctancactctgctgggtcttgggctgtttt

SEQ ID NO: 8212 - DNA, 861 bp, Diabrotica virgifera
  misc_feature (291)..(308): n is a, c, g, or t
  misc_feature (399)..(419): n is a, c, g, or t
  misc_feature (585)..(603): n is a, c, g, or t
  misc_feature (794)..(794): n is a, c, g, or t
  misc_feature (808)..(808): n is a, c, g, or t
gtgttgaattctagaaaatggacttttggccgctcagaagtgtacaatacccctatgtgcgtcgcttagatcagctgctgccagcacgtttagtcttgtagttgggaattgaggcggaggactgttatatatatttagtacttaagatataaggctactaatgtctaccttagttactattgtttttttatgtttctagattaatagaatattgtcaatgtcattagctataaatgaataaatactgttaacatgtccatttcttgtacctatataatatacggtaacatnnnnnnnnnnnnnnnnnncctttgtttgctttttagactcaatttgcatataatttttaaacaagttactgcgacttataatcgtctttgtaatatcttctctgttacnnnnnnnnnnnnnnnnnnnnngtcatttattcctattttgtatctacttgtcttttgatagctcccttatatacatttattccttcatttacactttatcctaaatttagtcttggtacatcgaaaatactgcgttcacactgtattttgatttattgcttgttattatgatgtatcaaagttctcnnnnnnnnnnnnnnnnnnngtttttgatttgaattataactgtcgtcttctttgttaccattcttcggctcttatcttgcataattaagtattatgtaatcacatttctttggatatattattgttcagcttctttttatcttttccatcatcaatagaagtagataaccaaacccaaagatgatctactaaaaatacatacgaatactnaaaaactagtaaantgtcgattcgctaatctgagacacaacaactgtctacactacatcacaaataa

SEQ ID NO: 8213 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (111)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacnnnnnnnnnnnnnnnnnnnnnnagtttaaaccggtgtgagccaggttggttnnnnnnnnnnnnnnnnnnnnnnnnnnnnnnnngaaagg

SEQ ID NO: 8214 - DNA, 938 bp, Diabrotica virgifera
  misc_feature (768)..(768): n is a, c, g, or t
  misc_feature (839)..(839): n is a, c, g, or t
  misc_feature (911)..(911): n is a, c, g, or t
ggcaattagtgcccacaaactattcattaatcgtttcatgtttgatgtttgagaacagttagtaagtactcaagttcgagtttagtttcggaagattgtgtgtttgttttctttgttaatataagttctattacgtcgagttcattcaagacatctcgaatggttgtaaaacggacaagacggatctcctcccagaatgatgaaattttacttcaagtacagacgaagatggatgacattcctgatatattttaccttagcggtgattacaatcgtcctaattcatagcctcataaccgaaaaaaacaccatacaatgttaccgcataaagactgaaaaatctcttcctagcatagcaaatttcaacccacaaccgggaaaatctatattttttcatgagacttcttgtctatcgttttacagaggaaagatctggataagctcgaggcaagcttgcgctgtggagagtgtggcaaagttaaatcccaataaagaggtttatctgctctatacgtcacctatggattttaagtttgaaggagatgaatctgataggtttttgaaggtgattttgagttaccccaatgtgaaaattttgcatttagattatgagaattataccagaggatctccagtggaagacctttacagatctggaaaaattgaaagttctcggcatgtggtggcgcatgctagtgatgtattacgatacctaactctttggaaatatgggggattatacatggatttggatgtcattgctcttanaccggtggacgatctagaagataactatgctggcatagaatctagctctgttgtagcatcaggagttttanatttcgacgcggctggagagggacacaaactcgtagagcgatgtttgatggactcaaagaaaatttgatggncatgtgtggtcgaagatggacctggag

SEQ ID NO: 8215 - DNA, 991 bp, Diabrotica virgifera
  misc_feature (650)..(700): n is a, c, g, or t
  misc_feature (865)..(865): n is a, c, g, or t
  misc_feature (889)..(889): n is a, c, g, or t
  misc_feature (898)..(898): n is a, c, g, or t
  misc_feature (911)..(911): n is a, c, g, or t
  misc_feature (923)..(923): n is a, c, g, or t
aatttttagagataggtgtttatggtttttgactgtccttatccaatatggactcgtcaaaaagaaatgccaaagaaacaaatccccgaaccaaagcttccatttttcgccttctaacatttttctataactaccccctgtttaaaaaagcacgcaaaaaaggacttgatgatagtgatatatacgaaatcccaaaatggctggcatcagaacagctgggaaataatctagaagatgcttggatgaggcaaaggaaaaagaaaggagaagatgcctccttggtaagatgcttattcagctgctttggtatgcagtatttaattctgggattaatacaattggttgtgaaaacagttttagtgtttattcaaccaagagcacttagtaaagtggtagcgtactacgctcccaaccaaacagatgtgacaacaaaagatttgtatatatatgcttccctagttgtaggtttaaacgtatttagtgttatttataaccacaattatcaacaatttactacagaagtaggtataagagtgaggacttctgtagctgcactagtttacaggaaagcagtgaagttggggcccaatgcttggaatcacgtaactgttggaaaaattgtaacgttgataacgaaggatgtgtttgcnnnnnnnnnnnnnnnnnnnnnnnnnnnnnnnnnnnnnnnnnnnnnnnnnnnaacaataatcatcacaggagttatatttaatagaatacaatggtctgtgtttggaggaattggcttttacatgttgactatcccattacaattgtttgtaggaaaagtagtaagctcaaaaagggtccaatctgctaagaggactgacgaaagactgcaactgancacagaaactataagaaatataanaactattanaatgtacacttgngaaaacttcttnacgacaaaacttaacgaattaagaaagtagaaactgcaaacttatctccggtcttctatctaaaaatc

SEQ ID NO: 8216 - DNA, 66 bp, Diabrotica virgifera
  misc_feature (2)..(2): n is a, c, g, or t
  misc_feature (21)..(21): n is a, c, g, or t
  misc_feature (29)..(52): n is a, c, g, or t
tnataattttttgatccattntttttgannnnnnnnnnnnnnnnnnnnnnnntaacagcgtaattt

SEQ ID NO: 8217 - DNA, 682 bp, Diabrotica virgifera
atttctattaaaaatttcgacatttctataaaaaaaagtaaagcaacacaatgtacctatgtacctatctataaaaataatattgtagtacttatgttatgaaataagaaatttatgactataaatctgcaatcaatcacaaacaagtctggctaattggctctgccaaagacatttttcagaaaagaaaagacatttctattcctgtttttcaagcaataaattgaaatataaatatacaatgcttgcagtggtgttgattgcaataaaaacttagacaccggaatttggtagatgtcttgtaatttaataggtgccgaaatcaatgagagtttgtagcgtggtggtgtattatgtgtagttatcaaaggctaaccgatttcagcgctctggtgccgtagccgtagtagaggagcatttgtaaatatgcgtccggacacaacatattggactaacttgcgctactagggctgaagtattgcaggaagcaaactggaatgagctcagaataatagactacattactggacatctgcatacagcatacagtggagctgtttgctgtaggaaacttgaaacagtcaaacatatgttgcacgactgtgaagtacaacatcaatgatttacataacgtaatgcaagggcctttaatgaatgctgtcatccataccgactgaagatg

SEQ ID NO: 8218 - DNA, 925 bp, Diabrotica virgifera
  misc_feature (173)..(195): n is a, c, g, or t
  misc_feature (384)..(403): n is a, c, g, or t
  misc_feature (632)..(632): n is a, c, g, or t
  misc_feature (837)..(837): n is a, c, g, or t
  misc_feature (861)..(861): n is a, c, g, or t
  misc_feature (882)..(882): n is a, c, g, or t
cgaaatacgagatttagaggagcttttgggcataaaagaagaagtccgaaatgtagatataacatcactcactgcaccaggagacaattttggcagtttaatgctaaaagtggacgtaacactgaaggacaaaattttacacctagtagctaaaaaaatcccacaaagtgttnnnnnnnnnnnnnnnnnnnnnnnacaggtgacgtatagaaaggaggttgagctgtataaaagtattgttccgattttggaagagtttgctaagaagaggcttgaattttttccacggtattatgcatcccggtataacctaaaagacaacgatgatgtgatcgatgaagatgctgtgttagttttggaaaatttagctgttttgggatacannnnnnnnnnnnnnnnnnnnggattcgatctacaaaatgccttattatttctagaagatctagcgaagtttcatgccgttcccctagcattcaaattgaaacatcccaatgaatttgacgagaaaataaaaaaactgtgtttcaatactgttttcactgacgccaaaagatatggaatactcaatgaagcttctagaaaaatagtatcagagtgtaacagtatttcgcatttagcagacaagattcttntttctcatgtgaacaatatgcaacccgtcagtgatgcttatggaacactaattcatttcgatctatgggtcacaatattatggttaatcttaaagacggaagatcagttggcaataaattagtggattttcaagtgtatagttatggatcaccagcatctgatgttttgtttttctttttaacagtcttcaagatacgtcattanagaacatctagatgaacttattanacactatcatgaccattttgntaaatgcctttcagaatttggtgtgatacggaactttacactt

SEQ ID NO: 8219 - DNA, 357 bp, Diabrotica virgifera
  misc_feature (2)..(219): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagcgtaattttattggagagttcacatcgataataaagattgcgacctcgatgttggattaagtttataatggtgtagcagctatattataagtctgttccactttaaaattttcctgatctga

SEQ ID NO: 8220 - DNA, 281 bp, Diabrotica virgifera
cgcgccccccccccgccggcgaaagttttagagataagggtatattggtgtttgactgtcgttatcatatatgcactcttctaggataattgactaggaagataatactagaacctgcgctagcatgtctccccttcgtgacacctttctatctcgggccccagagtaatcgagtgcgcaaataagggttgcgatgataatggtatgtacaaattccgatgctggctgggatcaaaacagctggaaaaaaacacgagaacaggcttaggatgaagctcagg

SEQ ID NO: 8221 - DNA, 114 bp, Diabrotica virgifera
  misc_feature (5)..(109): n is a, c, g, or t
aagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtga

SEQ ID NO: 8222 - DNA, 449 bp, Diabrotica virgifera
  misc_feature (146)..(163): n is a, c, g, or t
aataagattgtgagagcatattttattttgctcggattaaataggcatgttcaggaaccttgagcatcagggatgattagagacgacatacacatctattattttccacaataaaagagcaaaaaaatacatatttttactgcagnnnnnnnnnnnnnnnnnngactcttgtaacgaaatgttcctcgctagtgtatatatccgatcttttacgacacgagtagctatattgattaacaacataattatcgtgatatacctttacattatctgctttgtatatctgtatgcatgagcttagaaattaaattatattaatgataaattcttaatcaaaaatcaagattagaaatacgcacattttatgatcagcgataatttattttaatgtatgattattttgtgttgtctaaattgttggatagacggtaaacctaacttatttggat

SEQ ID NO: 8223 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8224 - DNA, 573 bp, Diabrotica virgifera
  misc_feature (9)..(33): n is a, c, g, or t
gtaatcacnnnnnnnnnnnnnnnnnnnnnnnnncataatacaaaaactgtgtgtatcacaggtactacgagaattaaaacaaatttacattttttgaactagagtactaatctctccttctactgccacaattgacgtctcgtttatgtctgcatattctgctctggctgtcgaaatatgttccatacgcacatttgaattggtatggtgttccattaaaacattcataaaatgttgagcaggatgttgcatcaggaaggtatactggatatctaccatctacactgggagatgaaatcagtatgtatggatagagtaaatagagcaaaggcgtccgagagaggagtccaaagtgatcggatgaaagcagaaaaaataaaattggatgaaagcagtgcaggagcacatgctctaatcaatataaataacttggtgctaggtttctttgtttatctaaatattcaccttttactataacaaagttgaatagttaaagcgtgtttagctaaataactttaactagttaagaaatatgatcattaacatctgtattaaataaaaattagttttccg

SEQ ID NO: 8225 - DNA, 493 bp, Diabrotica virgifera
gaaagctgaatttaggttaccgaattcgaattgttctagatattcaatcaaacaactttaaatattgaaaccgaaagatacgatgaaaagtaacaatgcttgaagggcacagtttttttgaaaacgacagtgatctagccaaaacaagtttttcggtttttgttactattttgtacataaaagtgctctacattttagttatgattttatatgttctgtcacggttcaacgaaatcgtctcattgagttaaactattcatgatgttgactttctctgagcctgcaaaacaatcttgggtgttatctagaggagaaaaaattgtatctataagtaaaaatgaggctgctaaattaaagaatcaggacattcttgccataaacttcttatttcagaattttaaaaatgaatttcaaggatccattttgaacgaagaaaatggatatgccactctactttaaggtatctgtcatttatgaacgtgatttacaaatc

SEQ ID NO: 8226 - DNA, 877 bp, Diabrotica virgifera
  misc_feature (54)..(85): n is a, c, g, or t
  misc_feature (353)..(373): n is a, c, g, or t
  misc_feature (415)..(438): n is a, c, g, or t
  misc_feature (757)..(757): n is a, c, g, or t
gaggattgggacagttttggtttcgcgccgcagctgagtgagtggaaatggtgnnnnnnnnnnnnnnnnnnnnnnnnnnnnnnnncaagattcttaactgttaccaatggttacaacagcggttatatggacgtttcgccagtgattaatatcacgatgggcatgttatggtttggggtttgaatgaatatatagatggatacagtgtttgccagttcccaactaatgttgaggttatgagttgttattaaagtgtagtggacaaagttttggtgggatgaggtataaatgaactaggagtggatacttacgtgtcagtgtagcatttggcgaattggccctctcccttcagnnnnnnnnnnnnnnnnnnnnngaatttttgtgacattaacgagatagctggaaattgtacacnnnnnnnnnnnnnnnnnnnnnnnncactcatatacttctttttgtgtgtacaatttttagttgtctcgttaacgtcacaaaagttctttaataaaaaatgatgtctgaggggagagtgctagttcgccggtgctatactgatgtgtgagtgttcggtcttggtttatttgtaccttgtcccactggaactttgaccactactacattttgataacagctcataaccttgacgttacatgggagctggtaaacactttatttgtttgtatgtttgtttaagacctaaattgtagcctgcttgtcgtgatattaataattagcattacacccgctaatattgtcnaagtcctttgtactgcacctctaataggatgtctggttattttgtatatttttgaatcgtcatatacactttattctgactaatacaaattgtaactattttagcttcttaaaggcctga

SEQ ID NO: 8227 - DNA, 854 bp, Diabrotica virgifera
ccatctccaattttttagatgtaggaaggttgatgagtgtattttttgttaaattctaaatggcgagtgtagatatttccgtgggtaccaatatcatgtccttaagattgtgggaaaacacatgtgataacgtcagtagaacccctggttttatttttactttaatgtcatacaatgttcttgctcaagatttagtggaactgcatccttatctttacaaggagcatgactcagcagcattgtcctggcctacaaggtggaaaaatctatttgaagaaatttctaagtttaaaccagatattctttgccttcaagaagtacaagaatcccacattgctgattattattcaactctgaagattttgggttacgatggtattttcaaaaagagaacaggtggccaaagcgacggttgtgctatctattacaaatcagacaaagttgaaatgctagactatactttggcgcagttttaccagtctgacatagctgtattgaatagagataatgtaggcattgttgcaaaatttgtaccaaaattgcatcccacgagagaatttgttgtggcaaccactcatcttctatataatcctcgcaggcatgacgtgaggatggcacagatgcatctactcatgaccgatattgagaaaatgagttacaaaaatgatgaagggaacatacattacttacctataatacttaccggtgacttcaactctccaccgcactctgacttatacgaatttattacacacggtaatattaagtatgaacatttagcagagccgcttaaaacacctggtgatcataggagacagcaacttgttacttcttctttggggatcacagacagt

SEQ ID NO: 8228 - DNA, 85 bp, Diabrotica virgifera
  misc_feature (11)..(50): n is a, c, g, or t
  misc_feature (54)..(55): n is a, c, g, or t
  misc_feature (68)..(68): n is a, c, g, or t
  misc_feature (70)..(70): n is a, c, g, or t
  misc_feature (79)..(80): n is a, c, g, or t
tagttttatannnnnnnnnnnnnnnnnnnnnnnnnnnnnnnnnnnnnnnntatnnaattatttaattngnggtgattannaaaat

SEQ ID NO: 8229 - DNA, 927 bp, Diabrotica virgifera
  misc_feature (773)..(773): n is a, c, g, or t
  misc_feature (845)..(845): n is a, c, g, or t
  misc_feature (859)..(859): n is a, c, g, or t
  misc_feature (891)..(891): n is a, c, g, or t
  misc_feature (897)..(898): n is a, c, g, or t
cagcaactttagtcatgtcaaaataaaaggagaaacccctagtgcttttgagttagtatttgctgctaaagatattccaccaatgggcttcaaattatactatatacaaaaaacgagcgcaacgagagatgccaaacaagaagaggaaggcgattccgacgacataacaacatttgtaatgaacgataacgataatacattacaatctgtcatcttaaatgatttaaacatggacattacacaaaatttttactattacgtcagtgacgatggaaattcttctggcgtggcttctggggcatatatattcaggcctgtagcaccaggtactgctaatccagtttcgcccgcacaaataaacaaaatcttccaaaaagcaggtaaagttgttgatgaagtgcaccaagtatggactagcgaggaggctgaaattcttcaaattataaggcactataaaaatgagagctatatagagtttgactggatcattggtaatattaatattactgacaacaaaggaaaggagttcatctcaaaatatacgataaacagcaactttaacaacaacaatgtcttttatactgactctaatggaagagaactcatcaaaagagttaaaaataagcggtccgattatacttacgatcctgaggtcgaaccagtatccagcaactactatccagtaacttccagaattgttattaaggatgaagatcaagatattgaagtcgctgtacttactgaccgatctgaaggtggttcaagtctttctncaaatgaactagagctaatggtacatagaagaatactgcacgatgatcataaaggtgtagatgaaaatctanatgaaatagaattngatacgggagtttatgtgagaagtacacattnattggnntatcgaaaagcgaacaaaagtaatttgga

SEQ ID NO: 8230 - DNA, 760 bp, Diabrotica virgifera
  misc_feature (540)..(554): n is a, c, g, or t
gccccctttgcggccgatcggatgaccgaatatcgaagacgaaagatcctttgcaggcttcttctaccagtgctacattggctgagctgtaccgagagatcagagtatacctctgcaagtgaaggatacaaccaggaccttatgtaacgaagtgcaaagatggaagacagataggaacatctagctgcaggtggaggtgacatcggagaatatggttcttagaagtccttaggtctttgaggtatatgaggcatcctctcatgtggtaacacgcgcacagatagcgaacctcttgatttatctaaaaagccgtatccgttaagattctgttcaatagtagagagtattctatgattattgatgataaatttgctgaagatgttcggaaagggcgaactatacgattgtgcccaaccttcctctgcgaatacagatccggggatgcgcacagtccgacgtgacgaggattgcttagcaatgcatggtgatatgattgtttaggaatttgagaacctctactaaacttggatgatcgtagcnnnnnnnnnnnnnnntgtatacgttgttgatattgacatatcagagtatggacgtagctacagtcatcaaacggatccacacgccgtgttcttcaacagcctccgagaagcatggcctagaatatacagataaaaaggccggactggcctctacgaaacgctcgtgccctttgaggaggcggcaaaaaccttactccatgaagacatacgcatgctttgag

SEQ ID NO: 8231 - DNA, 268 bp, Diabrotica virgifera
  misc_feature (12)..(12): n is a, c, g, or t
  misc_feature (15)..(16): n is a, c, g, or t
  misc_feature (18)..(18): n is a, c, g, or t
  misc_feature (21)..(21): n is a, c, g, or t
  misc_feature (30)..(30): n is a, c, g, or t
  misc_feature (53)..(56): n is a, c, g, or t
  misc_feature (58)..(58): n is a, c, g, or t
  misc_feature (61)..(62): n is a, c, g, or t
  misc_feature (185)..(206): n is a, c, g, or t
  misc_feature (226)..(244): n is a, c, g, or t
caataaaggggnggnnanaantggaagaanaaaggagaagctcttttaaaggnnnngngannagaaaaggagagggaaggaagaaggaaagaggaaagggggaggaggagaaggagttccaatataaaagataaaaatgatgttataaaaataatgaattggaaaataagaatgatgatttaggnnnnnnnnnnnnnnnnnnnnnnttataaaatagatataaggnnnnnnnnnnnnnnnnnnngtgaaaattgatgaatatatggaa

SEQ ID NO: 8232 - DNA, 614 bp, Diabrotica virgifera
  misc_feature (47)..(71): n is a, c, g, or t
  misc_feature (73)..(85): n is a, c, g, or t
  misc_feature (446)..(481): n is a, c, g, or t
gccagaacatatttttattgaatttacgcaataaataaatgtttttnnnnnnnnnnnnnnnnnnnnnnnnncnnnnnnnnnnnnngcaaacgtatggtatttttcatggaattgaagtttaaatgaatgatcgaaataatatttaacaactgtaaaacttaatggtgtcaaatcaaatagtcacatcgaggaccaataattttgtataaagatgcgtatagatatgcgagccgcgcacttcacgccgtgtgttcgccgcgcgtttctggcgccgacagaagttggatcgtggtgcgctgtgtacacgcagtttgtgtgccccttaaaaacgcgtacagcttacaaagtgcgcggcgcgtttatctacatatacatacctttagcagtaaaaatagattcgtgttgatcagcaaacagttttgatattaaagaacacagaaattacnnnnnnnnnnnnnnnnnnnnnnnnnnnnnnnnnnnnggtaagcaataaggaaagtactctcccctataacggaaaaataatccccggacaaataatccccgaccaaaaatcccggtccaacaatcaccacacatttttttggacaaaatgtcccccagaaatggttgct

SEQ ID NO: 8233 - DNA, 784 bp, Diabrotica virgifera
  misc_feature (14)..(514): n is a, c, g, or t
  misc_feature (521)..(558): n is a, c, g, or t
  misc_feature (578)..(591): n is a, c, g, or t
  misc_feature (594)..(616): n is a, c, g, or t
  misc_feature (624)..(646): n is a, c, g, or t
  misc_feature (676)..(707): n is a, c, g, or t
  misc_feature (714)..(750): n is a, c, g, or t
  misc_feature (754)..(783): n is a, c, g, or t
ctaaatttaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattnnnnnnnnnnnnnnnnnnnnnnnnnnnnnna

SEQ ID NO: 8234 - DNA, 645 bp, Diabrotica virgifera
  misc_feature (619)..(641): n is a, c, g, or t
aaactataggttcttacaagttgtgcgtaaacttttttcgcttaccggtgacacaattgtaatatatctgcttgttccaactccgttgcttcaccagaagcgaagttagaaaactatagggtcttccaagttgtgagttacctttttcactttccgttgacacaattataatatatctgcttgttccaactgcgttgcttcaccagaaacaaagttagaaatctataggttctttcaagttgtgcgttacctttttcgctttccggtgacaattataatattatatctgttttttccaactgtgttgcttctccagaaacagagttgaatttttgatttatgaatgttttttttgatattttcaactcaggcgcgccaaaaccaacaaaccactcgcaaacccgtccaaatacatattgcgaaccatcaaagcttttgttgaaaaaccgacagaagttagattgtggtgcgccgtgtgcgtgccgtttgtgcgccacttgaaaacacgtactaaactgacgaacatgctgcgcgcgagcggctcgcacaccgagcagagcgcatatgtatacctgcctttacgatgaattctctaacattttctgcgagttaggaagtnnnnnnnnnnnnnnnnnnnnnnntcta

SEQ ID NO: 8235 - DNA, 103 bp, Diabrotica virgifera
  misc_feature (2)..(49): n is a, c, g, or t
  misc_feature (59)..(94): n is a, c, g, or t
gnnnnnnnnnnnnnnnnnnnnnnnnnnnnnnnnnnnnnnnnnnnnnnnnctattaaacnnnnnnnnnnnnnnnnnnnnnnnnnnnnnnnnnnnnaccactgat

SEQ ID NO: 8236 - DNA, 638 bp, Diabrotica virgifera
ctcttcgcgtccgttcttgtttatttgtaaaaaacgataatatgcgtatctctaaacaagatgatatattaaattctgtccaataatgtgtgttgtgaagtgtaacaaatatgaaaaagactacacttagaatatgagttaaaattggttgaagattcctttgtatttagtttgtagttacacaacagtacagacatggcaagggagcaggtaaccagaaaatgggaaatatttcaaggtagaaataggttttactgcaatggaaggctaatgacagcaccgcattctggggtatttttgttgacactttttttaattactgtaacgagtgtgttattttttgtatttgactgtaaatatttagcagaaaatgtgacaatagccattccgatcatcggagctttgctgttcttatttacagtgtcttcccttttgcgtacaagcttgtctgacccaggtattatacctagggcgtcgtcaaaagaggcagcctacgttgaaaagcaaataaaagtaacaaactctgccaacagtgcctacatatagaaccgccaaccaggacgaaagaagtttttgttaaaggtcaaaccatttaaacttaagaaattggtaccacttgcaaaaatatttaagaccgc

SEQ ID NO: 8237 - DNA, 304 bp, Diabrotica virgifera
  misc_feature (2)..(258): n is a, c, g, or t
  misc_feature (288)..(302): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagctcaannnnnnnnnnnnnnntg

SEQ ID NO: 8238 - DNA, 931 bp, Diabrotica virgifera
  misc_feature (782)..(782): n is a, c, g, or t
  misc_feature (837)..(837): n is a, c, g, or t
  misc_feature (863)..(895): n is a, c, g, or t
agaactagtcctgtgtaatgtggagatcgaggccggtcgtcgaagtgttattgaatgattgtgagtgggtctgtgtttcttcacttcatagtaatattaatttccaacgtaaaatatgtacgttcgttcgtttgttcgtagcagccactgcaatacctggagccgatctaccgatagattcttatgtagttttgtttcctgaaaccaaatctgaaaacggcatttagaaacaacaaaggcaattgtttgtaaccactttattcgaaatttgtttaatactagtatattatcatgatttggagatacttgcatctcatgaggtaagtagcccgatctatcaataaaatgctaaaacttatttcaaacaaatagtattttcatattcatattataagagatatacctactgtctaacctaaaatatctattttgcatataaacatggatacttctagaaaaaagatatatcaccatctatgaagagacagaaaggcaaatgactattaagaacacacagaaactatcttaaaaatataacgtatacgggctcgaatgcataataaatcaaataattcaatgaaaaaaaacttcaactaccaaagtaatgacctaatttggtttatgttttatacgagattatattattttaaccaatacacttggttatttcgttgcaatttacaatttttcataaggtgagtgtcataataccaacattaatattataaattaatgtataatcattacctgaaattaatcataattttataatcactacctgnaagctccaatgtggaccaatacacagaagcctgtgcatagtgcaatcaaaaatanataatggggttgtgaacatcatatannnnnnnnnnnnnnnnnnnnnnnnnnnnnnnnnaagtggcaaatgtttttgatctctgatttagtcttc

SEQ ID NO: 8239 - DNA, 79 bp, Diabrotica virgifera
  misc_feature (8)..(78): n is a, c, g, or t
ttatttannnnnnnnnnnnnnnnnnnnnnnnnnnnnnnnnnnnnnnnnnnnnnnnnnnnnnnnnnnnnnnnnnnnnnnc

SEQ ID NO: 8240 - DNA, 115 bp, Diabrotica virgifera
  misc_feature (10)..(114): n is a, c, g, or t
gttaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8241 - DNA, 1195 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(845): n is a, c, g, or t
  misc_feature (855)..(910): n is a, c, g, or t
  misc_feature (913)..(967): n is a, c, g, or t
  misc_feature (981)..(1104): n is a, c, g, or t
  misc_feature (1123)..(1192): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnncttctccccnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnngaataacattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctggaaacaccacagnnnnnnnnnnnnnnnnnnnnnnnnnnnnnnnnnnnnnnnnnnnnnnnnnnnnnnnnnnnnnnnnnnnnnnctc

SEQ ID NO: 8242 - DNA, 676 bp, Diabrotica virgifera
  misc_feature (129)..(169): n is a, c, g, or t
ctaaaattatctaaaactcattaagaacagatagatttatcttttacacccagtagccatattgacatattgatttaattttgacagcatgttggaacggatttaaatttggtaagtgtagctccgcannnnnnnnnnnnnnnnnnnnnnnnnnnnnnnnnnnnnnnnngtggggcgtggctcgcggtcgtgaaatttacgagacttgctcgacctgtagattcttgtctatgaatacggggctaactctcttgttgatgtaaagtgcactttacactttttttcctacagcatttcaaagaaacgagttgtacgcgttctacgacagaagttgagtgtatcgtgaaaaaaaaaagtgttaacactagaaaaacaaagaaacaagaaagtgtaacacttttcttacacttttcaagaactagtgttacacttaaaacaaaggaacagacctaatatataacctagcctattatttttgtaaattcccgcttttcatcagctgttttatctaggtagggatagatgttacaaccaatttcgcgatgttgccaaatatttaatcaggatcggaatcgaaaacgtggaagatttaaaaacttgtcattacacgttctataacttacatacattcacattcttctttttgcggcaattaattgaattcaaaaatcatttt

SEQ ID NO: 8243 - DNA, 838 bp, Diabrotica virgifera
  misc_feature (824)..(836): n is a, c, g, or t
gttagaatcagtatggctgtatattgcaagcgggtttgccattctgtgaattatcataaataaatcctcctttagtaatctgcagcagttaacagctaatcctctacaagtacctgcctaatattacctgaagagcggcaactttgtcagaaaattctcatttagttcgcatgagtctatccttgtatactgaatagcatgtttgaaatacggtatagttcttagaggtgaaaacacatcagcgtaccttaggtggttcaagcgttgtccacaaaagtttatacctttttcttcctattctaaccttttaaaaatatctgccagagcctgattgaaaagtttcggtgatattatgattgaatgggatactaaaagtagcatttctctctgcttatattcttcgaatgtccagaatcagcattaaaattgtgtaggagaaactattagacttgaagttttcacttgcacttccgagaagacaaaataagattttatatgtttctccttatttactagtctcatcattgctaataggatgtagggagaaaattatacacatattttttatcacccttagcttcttatgtttcatataccttcatcaatcagccaatcgcgtccactgctggacatagacctccctcagttctttccagtgttctttacactgactggaccgctcgtagccagtttcccggtactctttatgtcgtttaatagtttctgggcctccattcaatgattcgtcgtgtccaccgtccatataccttaaaccttcatataaaagtgaatattgtcggcaattaagcttaagtttcgtttcnnnnnnnnnnnnnac

SEQ ID NO: 8244 - DNA, 951 bp, Diabrotica virgifera
  misc_feature (65)..(82): n is a, c, g, or t
  misc_feature (279)..(297): n is a, c, g, or t
  misc_feature (886)..(886): n is a, c, g, or t
  misc_feature (893)..(894): n is a, c, g, or t
atcaaattgaaaggctttctaggtttatattccacatctaaaattgttatggatatttattggcnnnnnnnnnnnnnnnnnngtgagtacagagtacactagtctgtgaatgactgcatggttgtgtattatccaccgtacggaaaggacattctttgcttcgtctttctagcaaagtccgactgaagagctataaatagcgaaacatttgtctcggaatggcgagatagacgaaggtcttaatattcattttcgtatattatttacatattatatatnnnnnnnnnnnnnnnnnnnctcataacttttatttttggtgaccattaacataaacgtggagctaccctaccacccaacgtatcacgtagacgaaatttcaccattaatgagaaaatcaaaaatacatatgaagtggacgacatagtcatatgggggagacaacgactttgtttctggtggccatataaaagaattggttgtacgatattatatttcatgaatattgtactgttgagtagattcatagatagttatatcaaggattataagagagatctaattgaaggaagattatgcattgtctggttgattgtcaacagttcggaacgaaaaaagacggcatatggcaaagaatacataagaaattcaacctcaaaacattattgttactagaaaacgagccatttaatgctacaaaccatcatgccaggaaaaatctttggaaagtaagttccaggaaaaagaagaacatcctggttgaagaacctcagaacctgattcaacacaacatctatgcagctttttcgcgctgctgcaaataagataaggattgccatgatgatcgccaacattcgtcgcggataggcacattaagaagaagaggaantttgatnngatacatcttgatacaaataattcacccctcttaaatatgtttatgaatgacgtatg

SEQ ID NO: 8245 - DNA, 276 bp, Diabrotica virgifera
  misc_feature (2)..(226): n is a, c, g, or t
  misc_feature (228)..(274): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnta

SEQ ID NO: 8246 - DNA, 692 bp, Diabrotica virgifera
  misc_feature (650)..(650): n is a, c, g, or t
ctgattgacattttcttgtttcttgtttttgaaaaatttgttcaataatggaaatatgaagacgtggaaagatatgcagaaagttgagacaagttatgtaaggtctagaacagttcacacaaagaaacaagatgatttatactatgagtatagtttttaatcaatttcatgctatgagtgtaacagaaataacataataatatgcaaggagtatagatgctaggagagtatattatattcattgatgtggatataagcccaactataaaataattaggacagagaaacctgttccattcattgtccctccagactgatttgcaaactgtgagatcaaggacagctttctatcagttatgtattggaaaacacatgctggacatgctgaaccatgcatctgtaaaaactacaagaaaaaatggttgtagagaaattaatgaggtgccacccaataaaatttcatgagattcaagaatgtgaagatacatgagcaatttcaggtagggatcctattaaattacataatgtaactttaacacaggtatatgaaagtgagtgtaaggcagtggtctccaataaacactgtacatggcctaaggcatctattggataccaccagttaagtcggtggctactacaaattactctgntatttgaatttgttttagaattactctttttctgtactcttt

SEQ ID NO: 8247 - DNA, 786 bp, Diabrotica virgifera
aaaggaactgaggaaggcctatgcccaccactggacgcgattggacgattaatgatgaagctaaagatccattacaatcataaattctcctgtattgtgaaatcaccttaattaataattgaggataggacacagataagcagtaaccattacaccatcaaaaagtgaagggctaaaagataatcaatgacaaaaatctggatattctaaatggaagtattcgataaattgtattacacaacagaaatcatcatcgtcaaacttcttcttcttcctcagctttttccttttcaggaatcgctgttcgttaatcttcatcgccactcatatatgtacatcaggtcttctttacctatacctttctctcccaagtttcatgccacacaatcctttcattttctcctcttccaaaatcttcaaacagctcaatccttcgtttcaaatagtttttatttctacatctaacatgacctaaccatggcagactttgatcttgattattttttgagactatcttcaccccggatcttctactaatcaatgcatgcctgcttctgatacttcaagtcttacacattatttggaaaccccccttcactgtaaaaatttctgttaattccacacatcgccttactctgacaaatgattcttaatacgtattcttcacgatccttatgaactactgaagacactcgtttctgtatcctaaatcttcaggatacgaggaatagaaaccctatcctccctcttcacaatatcattaataccaaacgtacctctcttttc

SEQ ID NO: 8248 - DNA, 198 bp, Diabrotica virgifera
  misc_feature (7)..(44): n is a, c, g, or t
  misc_feature (81)..(103): n is a, c, g, or t
  misc_feature (111)..(132): n is a, c, g, or t
  misc_feature (167)..(188): n is a, c, g, or t
taacagnnnnnnnnnnnnnnnnnnnnnnnnnnnnnnnnnnnnnntgcgacctcgatgttggattaaagtttataatttggnnnnnnnnnnnnnnnnnnnnnnntgttcgannnnnnnnnnnnnnnnnnnnnnagtttaaaccgggggagcccaggtggttcctatcnnnnnnnnnnnnnnnnnnnnnnccaaaggccc

SEQ ID NO: 8249 - DNA, 269 bp, Diabrotica virgifera
  misc_feature (222)..(249): n is a, c, g, or t
atcgatatggttgaggcaacatgttagttaaaaagcgtcatatgttttagtaaaccaataataaatcttgcagttcacaaggtttttcgtatcaaaatgttaatgaagacttcttagtttgacagatcgtccaatattccaatattctaaaagtaaaaattcagttcaactcttccaaaatcccaatagaaccatttttttaatacagcgtaattaacagtnnnnnnnnnnnnnnnnnnnnnnnnnnnntatttgtctcatcgatctca

SEQ ID NO: 8250 - DNA, 979 bp, Diabrotica virgifera
  misc_feature (834)..(834): n is a, c, g, or t
  misc_feature (875)..(875): n is a, c, g, or t
  misc_feature (880)..(880): n is a, c, g, or t
  misc_feature (897)..(898): n is a, c, g, or t
caaatggaatggaatcgaagaatgtaaaataattttaatacaagatgcaagtctcagatcccaataacattaaaatatataatttaagtgctggaaaatcattaccagagtggttatctgaaagaaaaagaagggctttactaaagaaaaatgttgatattagaagacggattgaacttattcaagattttgatatgccaggacttagttcggcagtacgagtatctaaagatggacagtatatattggcaactggtatatataaaccaagaataaaatgttttgatgtgaataatttatccttaaaatttgaaagatgttttgatgcagaagctgttacttttcaaattcttagcgatgactatagcaagttaatatttcttcaatgtgatagatatattgaattccatgctgcttatggtcgttactacagattacgaatacccaagtttggaagagatttgcaatacgattttcccagttgtgatgtatttgtggttggtgcttcttcagacatttatagattaaatctggaaaggggtcagttcatgacaccatatacaagtactgcatcatccattaataaatgcaccattaatcctgcacatcatctacttctttgtggtactcaggagggaaaagtggaagcttgggatcagaggactaaaactatggttggcagtttggattgtgctcttacttgtcttagcgaaaataaagaggtcaaaaatgaaatctggaataacatatctgtcgatccatctgtagttaaaagaaagtggctggatattataaacaaacaacatcagaatcagaatgtttcgcaaacaatanattatcctcaaatttggaaacaattccccactaaaaatgtngccanaaattttatttatgggnnctattatcactacatatttagttacatcatgcatagacgaaaatgatgatgtcagtgatattgaaaatagcgatagtaatc

SEQ ID NO: 8251 - DNA, 1117 bp, Diabrotica virgifera
  misc_feature (237)..(260): n is a, c, g, or t
  misc_feature (273)..(290): n is a, c, g, or t
  misc_feature (324)..(346): n is a, c, g, or t
  misc_feature (572)..(592): n is a, c, g, or t
  misc_feature (671)..(690): n is a, c, g, or t
  misc_feature (755)..(803): n is a, c, g, or t
  misc_feature (975)..(1006): n is a, c, g, or t
  misc_feature (1039)..(1064): n is a, c, g, or t
  misc_feature (1094)..(1112): n is a, c, g, or t
agctggtatttcttcaattttaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatatttcagattatcctgatgtatttataattatgaaatattgtatcttctattggatcactaatttcttttaattgggggattattccttaatttttattatttggagaagcnnnnnnnnnnnnnnnnnnnnnnnnnnnnnnnnacttaaaaaaataacttctttcaatttggatgnnnnnnnnnnnnnnnnnnnnnnnnnntggaacacccaaaaatttttttgaattgcnnnnnnnnnnnnnnnnnnnaattt

SEQ ID NO: 8252 - DNA, 160 bp, Diabrotica virgifera
  misc_feature (16)..(39): n is a, c, g, or t
ccgcgatctgaactannnnnnnnnnnnnnnnnnnnnnnnagctgtatgagctggtaactcatgaccatgggtgtgttttagatagagtacataagcgttgcctcatagaagtacgttgttagcattacacggattgaactattactagatattgcaatgg

SEQ ID NO: 8253 - DNA, 935 bp, Diabrotica virgifera
  misc_feature (837)..(837): n is a, c, g, or t
  misc_feature (840)..(840): n is a, c, g, or t
  misc_feature (847)..(847): n is a, c, g, or t
  misc_feature (908)..(908): n is a, c, g, or t
aaaaggttatgtcttgttctgttatgcgccaaagtgaacaaagatataaataaacgattttaaaattataaacacccttaccgggctgttacagccacggttagttttaaatgctagtgatatagtaaacaaataaaaagatggcttcaaaagaaactacaccaaccaccaaaaaagtgaatactgatttaataacaccccatagactaacagtttcaatattgatcaaaagcttttgcctcttcagagatgatgaaaaatttaaggagatggaagatcaagcactcatgtgcaagtacagaagagacttctgtgtcttaactctacgattaatacaaagccctgacctaccattatttgatctgaggaaattattaacatccaaaaaatatgtgatacctgatagtttgatagaatcttttgatcaaacattggccacgttaaatgaagaaggaattggcaatttgctggatattgtggatactttattgaaaattatggacaaatctgacgatcccctaaacagtaatagtgctatagctaaaactagtattgcaggttattatttaagaagatttatagtattttttgagaaactaaccttctcagaagttgcgaaagtgtacgaggacttccaaagatactacaatgaattagaaaaaagtgctaaacatatacaaacggatgaggaacctgcagataattggttaaatactaaagaaaattggtctagaagacaggcagagctattcatagctacccaagctgctttgttgtctaatgatgaagaaaaagctctgcctccacctgaattacagaagagaattgtgaatattntanagtcaantccagatttgtcaggagcgcattttgttccctattgactatctacgtgtggatgaatactngtggatcagtgatagtttattccattt

SEQ ID NO: 8254 - DNA, 763 bp, Diabrotica virgifera
  misc_feature (314)..(339): n is a, c, g, or t
  misc_feature (608)..(673): n is a, c, g, or t
  misc_feature (700)..(727): n is a, c, g, or t
agtttaggttaaatctatttttgttctttaatattaatcttttattaaactatgcagataaaaaggtagtacttaagtaaatatgtctcaaattatgctgataattgcttcggcatatctagtctattgtccatttacgaaagtagaggaaagctttaacttacaggccattcatgatattctatatcatggatttaaccttacacagtacgatcatctcgagtttcctggagtagtgccacgaacttttattgggcctcttttcatatcagctcttgcatcacctgtagtagcagtacttcaactcctaaatnnnnnnnnnnnnnnnnnnnnnnnnnnagtgaggaccattcttgctacttgtgtggtgtacagctttaatatattaagtaaaactctagaaaaacaatttggaacaagatggctgcagtggtttatagcaataactgtgactcaaagccacttcatgttctatctaagccgtccattgcccaatatttttgcgctgcctctagttttactggcattagatggctggctccacaacaacaataagacttttatcctgtgctctggagcagctattattatttttagagcagaattgnnnnnnnnnnnnnnnnnnnnnnnnnnnnnnnnnnnnnnnnnnnnnnnnnnnnnnnnnnnnnnnnnnactgttacaaatagctggtccaggagnnnnnnnnnnnnnnnnnnnnnnnnnnnngataaactccatttttttggaaaagacccttattgg

SEQ ID NO: 8255 - DNA, 197 bp, Diabrotica virgifera
  misc_feature (7)..(44): n is a, c, g, or t
  misc_feature (57)..(57): n is a, c, g, or t
  misc_feature (64)..(77): n is a, c, g, or t
  misc_feature (80)..(102): n is a, c, g, or t
  misc_feature (148)..(148): n is a, c, g, or t
  misc_feature (157)..(157): n is a, c, g, or t
  misc_feature (165)..(165): n is a, c, g, or t
  misc_feature (169)..(190): n is a, c, g, or t
taacagnnnnnnnnnnnnnnnnnnnnnnnnnnnnnnnnnnnnnntgcgacctcgatngtggatnnnnnnnnnnnnnnggnnnnnnnnnnnnnnnnnnnnnnntcgtcgacttttaaattatacatgatctgagtttaaccggtgtgangcaggttgntttctatncttnnnnnnnnnnnnnnnnnnnnnngaaagga

SEQ ID NO: 8256 - DNA, 646 bp, Diabrotica virgifera
  misc_feature (2)..(427): n is a, c, g, or t
  misc_feature (453)..(454): n is a, c, g, or t
  misc_feature (608)..(641): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgatatagaataaattacctanngatacagcgtaatttattggagagtcaatcgatataaagatgcgacctcgatgtggatttaagttataattgtgtagcagctatattataaagcctgtcgactttaaaatttacatgatctgaggttaaaccggggggggcagggtgggtttcnnnnnnnnnnnnnnnnnnnnnnnnnnnnnnnnnngggcc

SEQ ID NO: 8257 - DNA, 475 bp, Diabrotica virgifera
  misc_feature (203)..(269): n is a, c, g, or t
tctatcgactcctatagggaaggtggccgcctgcgggcggggccggattcccgggcccctctggcgcgggcggcttgagacacttggtatgtcttgagagagggtgacaagagtcaaacaagagcgaggggagtcttcctgtggcagaagcctgtgttcctagcacaccgaagtgtgctttacgccgaaggaggtggagagannnnnnnnnnnnnnnnnnnnnnnnnnnnnnnnnnnnnnnnnnnnnnnnnnnnnnnnnnnnnnnnnnnatctctcaataacagagatatagagggggtagatgcaaaaggaactgaagacttatcctgataatagactccttccagtaattaaagctcactgaagtatgtaatacataaaggaggtaaataaagaccaattctgaggaagattgcaaacctggagacactactgtggcgagctatataaaaataacaaagcgtctgcagaaaat

SEQ ID NO: 8258 - DNA, 140 bp, Diabrotica virgifera
  misc_feature (7)..(44): n is a, c, g, or t
  misc_feature (79)..(101): n is a, c, g, or t
  misc_feature (103)..(103): n is a, c, g, or t
  misc_feature (109)..(131): n is a, c, g, or t
taacagnnnnnnnnnnnnnnnnnnnnnnnnnnnnnnnnnnnnnntgcgaccctcgatgtggattaagtttataattggnnnnnnnnnnnnnnnnnnnnnnntngtcgannnnnnnnnnnnnnnnnnnnnnnagtttaaac

SEQ ID NO: 8259 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnganagg

SEQ ID NO: 8260 - DNA, 451 bp, Diabrotica virgifera
  misc_feature (5)..(57): n is a, c, g, or t
  misc_feature (66)..(78): n is a, c, g, or t
  misc_feature (80)..(111): n is a, c, g, or t
  misc_feature (114)..(163): n is a, c, g, or t
  misc_feature (170)..(217): n is a, c, g, or t
  misc_feature (359)..(376): n is a, c, g, or t
gatcnnnnnnnnnnnnnnnnnnnnnnnnnnnnnnnnnnnnnnnnnnnnnnnnnnnnngggatgcgnnnnnnnnnnnnngnnnnnnnnnnnnnnnnnnnnnnnnnnnnnnnntgnnnnnnnnnnnnnnnnnnnnnnnnnnnnnnnnnnnnnnnnnnnnnnnnnnatgatgnnnnnnnnnnnnnnnnnnnnnnnnnnnnnnnnnnnnnnnnnnnnnnnngaatattagtagggatgatgatacttattattacacctgttgtatattatacatgacatatatgaagtatatataaggactcccctgacctctgtttcacctgaatgttacgcacatgtctgtccgtgttaaagatacagannnnnnnnnnnnnnnnnngatttgtgtgatgcgcggtattatgaccgagctactgtacctaatcattaatatttatattgattgctgaaatga

SEQ ID NO: 8261 - DNA, 358 bp, Diabrotica virgifera
  misc_feature (28)..(55): n is a, c, g, or t
  misc_feature (180)..(206): n is a, c, g, or t
  misc_feature (217)..(301): n is a, c, g, or t
acccttagggataacagcgtaaatttannnnnnnnnnnnnnnnnnnnnnnnnnnntgcgacctcgatgttggattaaggtttatattgggtgtagcagctataataataagtctgttcgacttttaaattttacctgatctgaatttaaacgggggggaagccaggttgggtttctttcnnnnnnnnnnnnnnnnnnnnnnnnnnnccaaagggccnnnnnnnnnnnnnnnnnnnnnnnnnnnnnnnnnnnnnnnnnnnnnnnnnnnnnnnnnnnnnnnnnnnnnnnnnnnnnnnnnnnnncccccctaaaaagggaacccccaaaagtgttttttagtaaagacggggggggggggg

SEQ ID NO: 8262 - DNA, 110 bp, Diabrotica virgifera
  misc_feature (10)..(89): n is a, c, g, or t
gttttttagnnnnnnnnnnnnnnnnnnnnnnnnnnnnnnnnnnnnnnnnnnnnnnnnnnnnnnnnnnnnnnnnnnnnnnnnnnnnnnnnatataatttttgatccatttt

SEQ ID NO: 8263 - DNA, 731 bp, Diabrotica virgifera
  misc_feature (253)..(271): n is a, c, g, or t
gctagcggtatgtgtatctagttacggacgtgttagtacttggttcgatttcccataaggaagaagtttttgtttattattaatggttattgacatcttagcagaggcgtgcggtccatggaagcgggggaagcaccgcttctctattatatacttcgatataacaaaatatattattaactaatatttaattatcaaaaattttccccaatcccagtaatctacatattattacctaggcaataggcattgnnnnnnnnnnnnnnnnnnncgcataggaaggaactcaatatgcactatgcacacaattcaactacatattcggtccacccctgacagaagcgcatctcaaaatcgccgcttgtcatgcagttgtctcgtatccaaattggtcagggttcaatgaccgcactcactagtcgcgcgaattttggtaccctgcagaagcgattgttcgatcgccttccaagagtgggatgctctgactgttactgcttctaaggggtgcttagtctgcttaggtacatacattcgcttaaagaatatttcgatttaaattttttgcagagatttttccttttactgatcttttatttgacattttacagatgaagtcaattgacattgtattttgtataagacaaattgatgactttattaatacgataattaaaaaacgagagcagtttaaaaatatttgggataaaactgaaaatatggggtttgaacat

SEQ ID NO: 8264 - DNA, 322 bp, Diabrotica virgifera
aatatatttcctacataatacaaaacaccatctcatactgatacatccaacattaaattatacactcattgcagtacttaaagtatattcaactgattctataacctagaaagtatattaatctactataccacgctcaaacgatactcctactctacaaatcaactttatacaacattttaacttaaaaatatataatcttatcatttattacgatagactataacatcaccatcaccactaactcccacgtatgatcctcctaacacatccatctcactacaactatcatttccctatcattattttatacaactatctc

SEQ ID NO: 8265 - DNA, 165 bp, Diabrotica virgifera
tttatatcttttaggaaagaagaattttattttcagctagggagatattattgtgagtgcagagagtatattgtaggattataaatcaataattccgtgtgtgtagctcgcgaataatgaatgaatatttatctattaattatatatgaatttcgaagggaaaag

SEQ ID NO: 8266 - DNA, 240 bp, Diabrotica virgifera; identical to SEQ ID NO: 7336
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 8267 - DNA, 822 bp, Diabrotica virgifera
  misc_feature (498)..(512): n is a, c, g, or t
  misc_feature (515)..(528): n is a, c, g, or t
  misc_feature (657)..(657): n is a, c, g, or t
  misc_feature (729)..(729): n is a, c, g, or t
  misc_feature (745)..(762): n is a, c, g, or t
gtcaatcttcatacaaaagacaaagttttgtaaatacatattttctctattttttaaagttataaagcgatatttaaccgtggcagcctacaagatgaggagagcccacgcaggtaactattatgaaccattaccacaagcttccaacgaaatcgaagatgaaaacgatagaatgactaatgatctgcaagaaaagattggcgtcttaaaatcgttgactatagacattggaaatgaagttaaataccaggacagaatgctcagagatgtggacgacgatctagataagactggaggcttcttgggcaccacaatgtcgagagtactgagattatcgaaaggatctcataattacctcatcctgtatttatttgtggtttctgtagtggtgttttttattctgtatctagttattaagtttaggtagatggggtatgggttgtattattgtataattatttattggactgtaatgtatgcatagtggggacatatttnnnnnnnnnnnnnnntgnnnnnnnnnnnnnncaaggggtaactataatagaccatttgttgaatgtatttgtctctaatgaccactttgataaaataattatatgatctgtatagttttactttaagtatatttttgggtgcagtttattttgggaattnaaacataattttttactgcataatgtgttaattaaacaaattacatcaaaatattaagtttcattctttagnaaagtgttccaggtcnnnnnnnnnnnnnnnnnntcttgatctgcatgtggttattaacagaggtgtaaggaggatgatctaaggggggggggg

SEQ ID NO: 8268 - DNA, 966 bp, Diabrotica virgifera
  misc_feature (753)..(773): n is a, c, g, or t
  misc_feature (781)..(781): n is a, c, g, or t
  misc_feature (883)..(883): n is a, c, g, or t
  misc_feature (947)..(947): n is a, c, g, or t
cttgaatctttccctgcataattaattttaggagttcatatctatcaccacgtgttatatgacccaagtattgaagtttattttgatggaatccagtatctccctgctgttctgcattctccttagtacttcctcattggttattgtgtctgtccaggagattctcggcattcttcgatacgtccacatctcaaatgcttccaatctattgaggcattgtttattgagagtccatgtgtccacaccatacaaaagaacaaaaaatacataacattttagtactcgttttctaagatttaggctgaggtctctactacataatatttgtttcatattagtgaatgcacttctagccttttctattctaattcggatttctttggtataatcgtttgtttcactaatgttcgtccctaaatagttataattctgaactcgttctatcgtcttattatttacgtgtagattgatgtttctaatatttttctttgatataaccatgaatttcgttttctttatgtttagtgacagaccaaattcttcactcattccaacaaccttatctaaaattctttgtagatctgtaatagtttctgctattagtattgtgtcatcggcgtatctaatttcacatatgggtaggccatttatttttatgcctgctacttcatcttctaatgcttttttgaatattttttctgagtatgcattaaacagtgatggtgacacagacgcagccctgtctaacgcttnnnnnnnnnnnnnnnnnnnnngtgtttanattatttattcttatgacagcttcttgttcataatacagattattgattattcttatatcccgtgtgtcgatgttctttgttctcagtagttttattaacgnattatgtttttcaccgtatcgaatgcctttgtataatctaggaagcaaacatagatgtcctggnttacatctaaacatctctg

SEQ ID NO: 8269 - DNA, 213 bp, Diabrotica virgifera
  misc_feature (22)..(42): n is a, c, g, or t
  misc_feature (65)..(82): n is a, c, g, or t
gccgcgccccccgcccccgccnnnnnnnnnnnnnnnnnnnnnagcattcttcacgatagctaacnnnnnnnnnnnnnnnnnnatagcaaattaggattgtgagagaccagctgattctgttaacacaaaaatctgctcttccgcgcccacggctcccggactagcaagaaaatacttataccattactactttccggattaaaagaggcaaaa

SEQ ID NO: 8270 - DNA, 937 bp, Diabrotica virgifera
  misc_feature (284)..(303): n is a, c, g, or t
  misc_feature (412)..(428): n is a, c, g, or t
  misc_feature (564)..(583): n is a, c, g, or t
  misc_feature (755)..(755): n is a, c, g, or t
  misc_feature (918)..(918): n is a, c, g, or t
attttatcgaactgaattatcttacgggaacatttcaggcaatttgctcaacccacaaaaaattggaaacctatactcatcaggaatttcttaatgaattttcagcttcatatggaaattatacatgggtatttacagatggttctttagatcccgagtcgaggacagtaggttttggggtacacataccttcaatcaattataactatgcatccagattacatgaacacactcaaatatgcactgcagaaattattgcaattaacaaggcagtatctgtttgnnnnnnnnnnnnnnnnnnnnaagcaataattttttcagatgctaaaagtgctatccaaaaattacataacaccacctgggggacaaacaaccatattgtaaacctaactaaaagacttattattgagtnnnnnnnnnnnnnnnnnaatataatcttagcttggattccaggccatactggagtaaaggggaatacagaggctgataaattggcaaatataggcaagactttaaatgttcctgcagacattaaaatagataaatttgactttttgccttttnnnnnnnnnnnnnnnnnnnntgagtttaaagttgaatggacaaagcagtttaaaactaaagggaaatggtatcaacaatgccaaagtgatttttctataaacccttggttccacaaattcacatttgtggcacttaacatcaattattagaatgcgaacgggccactgtcacacaccagaccatttgtttanaattaattgtagtgatacttctttttgtgaatgtggacaaataggaagtataactcatatgttacttgaatgcccaattaacaaaacaaatcaatttgacctgtatcaggaactttgtaatataggaagtccaacccccattttcatacaaaatctcctacantatattaatgaccaaacct

SEQ ID NO: 8271 - DNA, 199 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (134)..(134): n is a, c, g, or t
  misc_feature (161)..(191): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagnttaaaccggtgtgagcccaggtggttnnnnnnnnnnnnnnnnnnnnnnnnnnnnnnngaaaggac

SEQ ID NO: 8272 - DNA, 906 bp, Diabrotica virgifera
  misc_feature (187)..(220): n is a, c, g, or t
  misc_feature (815)..(816): n is a, c, g, or t
  misc_feature (841)..(841): n is a, c, g, or t
cgttaacaagaagtttttgagatggaagcactaagatttacgtcaaaaattaaaaaattagagttggtaaatgtgcccataccgaaaattactcaaccaaaccaagtgctgatcaaagttgcttactctgggatttgtggaacagatcttcatattattgggggcgaatttccgtgtaatgatgcannnnnnnnnnnnnnnnnnnnnnnnnnnnnnnnnnccgttgtagaaacaggagctagtgtcaataccttcaaaaagggggacaaggtttctgtagaccctaatagtggatgtctatgctgcgatcactgccattcaggaaaccctcattattgttcaataggtggaatcagtaataccattggaatctttagaaacggaggatgggccaattattgtgtcgctcctgtggaccaagtccataaactaagtgattccattactctggaacaagctgctttagctgagccactatcgtgcttagcccacggatgggacatcataagtccagttacagtgggacaaaaaattttaatcaccggtgctggaatcattggaaacctatgggtctgtaacctacacttgcagggacataaaaacgttaccgtttctgagccaaatttagctcgattagacatgattaagaaacttaatactggctataatctcattacccccgatcaactgaaaaagaatcaacaagctgatcccaattacttgtttgatctggttatcgattgtagtggatatgcaccagctgtggagcatgcgatatctttactgaggagaggtggtaaactatgtatatttgnngtggcaccacctcatgcagaaatanaataaaaccttttgagatatacatgaaggaattaaaatctacggggtactggttaaccctttcag

SEQ ID NO: 8273 - DNA, 232 bp, Diabrotica virgifera
  misc_feature (2)..(53): n is a, c, g, or t
  misc_feature (55)..(110): n is a, c, g, or t
  misc_feature (112)..(148): n is a, c, g, or t
  misc_feature (157)..(185): n is a, c, g, or t
  misc_feature (190)..(211): n is a, c, g, or t
cnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnagaaagggnnnnnnnnnnnnnnnnnnnnnnnnnnnnnattannnnnnnnnnnnnnnnnnnnnngaaaaaagcttaaaatttttt

SEQ ID NO: 8274 - DNA, 686 bp, Diabrotica virgifera
  misc_feature (228)..(245): n is a, c, g, or t
  misc_feature (310)..(329): n is a, c, g, or t
  misc_feature (440)..(457): n is a, c, g, or t
  misc_feature (464)..(483): n is a, c, g, or t
  misc_feature (498)..(520): n is a, c, g, or t
  misc_feature (524)..(524): n is a, c, g, or t
  misc_feature (583)..(583): n is a, c, g, or t
  misc_feature (594)..(594): n is a, c, g, or t
  misc_feature (647)..(647): n is a, c, g, or t
gttaaggctcacatgtatgccatccacacggaacatgttaaaagcaattttgataatgcatcagattaattgatatcatatttattttattcattgtcatgataactaccagaatgacgatccgcttgtctttcattaacccggcacctgccacgtggctttgcaaggcgccaactgccacgtggggtgctcacagcaccccttaaaaattgtctgtgatctacttgnnnnnnnnnnnnnnnnnngtgttgagtaacacaagaatataaataaacatgttttattaacttattagccactaatatgttannnnnnnnnnnnnnnnnnnngaaaaaggtgttataagcaaattagcaagtatataataaatgaagccaagccataataaatgaagtcaagtaaaatatctagaaaattaagatttagtgagtatagagtcnnnnnnnnnnnnnnnnnncagttannnnnnnnnnnnnnnnnnnnttgacttgttaatcnnnnnnnnnnnnnnnnnnnnnnnttanagtgccagataatgacactccaattcgactttagagctataagttcagaatgacactanataaccacttncaacactaacacatatatgttatataatattatagaaagctactatgacgcanagctcggttaccaaacttgaaataccaaatatttgataa

SEQ ID NO: 8275 - DNA, 900 bp, Diabrotica virgifera
  misc_feature (76)..(100): n is a, c, g, or t
  misc_feature (638)..(672): n is a, c, g, or t
  misc_feature (826)..(826): n is a, c, g, or t
cccgtggaaaaaagttatgggggcaaaaaacaaaatgactatctttcatgttttttcttgcttttcttttggatannnnnnnnnnnnnnnnnnnnnnnnnactttacaatgagatatttcgatagtaaatttaacctggaacaattttcctatagacgtgtttgcactaaatgtgcatagaactcactctaattcgccctgtgcctagggaataattcaccccttactaaagtgcgctactgctccttggatgtgtccctttttttcaagtttatgatcctagtctacggtcaaattgttcgatttcgttgtttgcactgtcacacacgatcaaaatccttgtaaattcgtcaaattcgacaaagttaaacaacaccgcagtactatgagtggccagctttacacttgtgtccaggtttctttacccgtgcgtcatcatttaaagcagacgaaataagtcggaaatttactaaacgcaacagcacgtgacagtaagtagctactgctccgatcacgggttaaaatttgacgttatcaactaaataaaatgtcaaatgtaagttttgctttaaaattttggtgcagaatcacagctacatttgaagtagcttaataaattcttttaatatcattagtgnnnnnnnnnnnnnnnnnnnnnnnnnnnnnnnnnnncaataccatattttctttttgtcatttcattcactttggcggaaacttaacacaaccttatattcttattccttaactgtcacttaacaaaacttccttaacaaaataaaatatacttacttaccataaaatatcaaactccaatataaaattnggttgtgaaaaaaaactgtttgtgtaatataaaaaacttcaaaattcaaaaattcaacaaaaaatcagcgaaaa

SEQ ID NO: 8276 - DNA, 633 bp, Diabrotica virgifera
ctttaaaacaattttatacatttaatttatctttacagtaaagttgaaataaattcaaatgcagtatctgcatcaatatcagtaacaatatcttcttcacaaaaatccgtgttatcaacgatattacaattaaagctgcactttctctagtacggtttggtctagctgtcaactagtgtatgcttaataacatttttcaggtgcttcaatacttgtaacatcactcaatatttcaagttttccattttctcttttattcttagcatcaatgacagtttggatactttgcggttttagaactctcgatgaatcacttcaaatccgtattacaatttgataattgagtttaaactaaaaatcaactttgcaagaatacagtggaaacatttcatgacccccctcccgtacaagtttcaaaacttggcagcagtttcaaaaaaatatcggtatattcaacatagaacccccctcccgtacaagtttcaaaacttaagcagcagtttcaaaaaaatatcggtatattcaacatagaagacttctttttgataaactgtgtttaatgggaaatgggccacgattttaccaaaaaaatgattttgttaacgcttccaaacgttaatggggtcatttttt

SEQ ID NO: 8277 - DNA, 245 bp, Diabrotica virgifera
  misc_feature (2)..(29): n is a, c, g, or t
  misc_feature (95)..(115): n is a, c, g, or t
cnnnnnnnnnnnnnnnnnnnnnnnnnnnngagcaaagaaacatttttttgaaatgaagtgtgaggcgttggtatatcagatatagttatttacgnnnnnnnnnnnnnnnnnnnnngaacgatatatctatacttaaatattttgatattatttatttccactattgcccacggatgattttaatcgtacgcgcttttttaaaatatactcaattaatgaagaattaggattaaaaactttcgtat

SEQ ID NO: 8278 - DNA, 76 bp, Diabrotica virgifera
  misc_feature (22)..(23): n is a, c, g, or t
taacagcgtaaatttattgganngagtcaatcgataataaagattgcgacctcgatgttggattaagtttataatt

SEQ ID NO: 8279 - DNA, 100 bp, Diabrotica virgifera
  misc_feature (11)..(73): n is a, c, g, or t
  misc_feature (76)..(76): n is a, c, g, or t
attattatatnnnnnnnnnnnnnnnnnnnnnnnnnnnnnnnnnnnnnnnnnnnnnnnnnnnnnnnnnnnnnnntanttttttgatccattttttttgata

SEQ ID NO: 8280 - DNA, 57 bp, Diabrotica virgifera
  misc_feature (2)..(41): n is a, c, g, or t
  misc_feature (44)..(44): n is a, c, g, or t
  misc_feature (52)..(52): n is a, c, g, or t
gnnnnnnnnnnnnnnnnnnnnnnnnnnnnnnnnnnnnnnnnggnggtgatanaaaat

SEQ ID NO: 8281 - DNA, 278 bp, Diabrotica virgifera
  misc_feature (7)..(79): n is a, c, g, or t
  misc_feature (84)..(102): n is a, c, g, or t
  misc_feature (104)..(140): n is a, c, g, or t
  misc_feature (150)..(169): n is a, c, g, or t
cgagaannnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnncnnnnnnnnnnnnnnnnnnnnnnnnnnnnnnnnnnnnnccactctttnnnnnnnnnnnnnnnnnnnnccttaggaaccccccgaaatttttattggaagcgtccaaaccccctaataaaaaatggggaccccccagagtggggcttaaaagttaaacaaaacggcggggaccccgc

SEQ ID NO: 8282 - DNA, 651 bp, Diabrotica virgifera
  misc_feature (57)..(76): n is a, c, g, or t
  misc_feature (85)..(111): n is a, c, g, or t
  misc_feature (113)..(132): n is a, c, g, or t
tatttgtccaagtttaatttacagatcaccaataatgcaatgcaagtaataaatccnnnnnnnnnnnnnnnnnnnntgatactcnnnnnnnnnnnnnnnnnnnnnnnnnnncnnnnnnnnnnnnnnnnnnnngagtagaccaaatacactatttcttctgttgcgcttattctgcatcttttgagacttttacttggatgttatctttgaatgtatcaatgatgatatacacctactagatcattgagcgtagagttgaatacactttcacatgaactatcacatgactcctattctcatcatcaccccctgatgtatgacgtcactagggtggtatatacgctaaggaatgataatttaaatgtagagatcgacctgtttcggtaatttcttatagtgatgtttgtttagctaatgatgggattgagcgttactttgtggacgcactctatattttctgtatctctataaatttcagcaggtatttagtttataaatctatcttgtagagtcaatcgtaaactgaatgaaagtcctcaacaaataagcaatttttgattaatacctgtacagtactagcacataagacttcactacatttaatgcatttacgtttattatgtaaatatccagggctttttattttatttt

SEQ ID NO: 8283 - DNA, 498 bp, Diabrotica virgifera
atcttactaacatcgtcaatcacacaggtacagccgttggatggggcagagatcacaaaaacaatccaacaacggatctgttaatgcaagcacacatgccagttgtagataccctaagttgtatttatgcttatcccgaattttactcaatgtttaccgccccaaccaatttttgtgctggatatagaaatggtacttccgtatgcacaggtgactcaggaggcggtcttgccttcccgaaaacaggatcaaatgtctggcaactacgaggaattgtttccaatacagtagctaaacaagacacctgcgatccaaagtactatgtaatatttacagacgtagctaaatatttagaatggataagtcaaaaacttaaagcatagtctgaatcataattatacaaataaatttgatatgcctttttatactttaataaagtaaatttattttgtaaccattttcggggtcgaattattaaaaagttgttaaatacatttg

SEQ ID NO: 8284 - DNA, 287 bp, Diabrotica virgifera
  misc_feature (116)..(133): n is a, c, g, or t
gggatcggcaaggcggccacgcccccctccaaacgatcgtataatagaattaaatatattatattccccccaaagaaaaatgttatgaaatgataataagattttgtagtgagagnnnnnnnnnnnnnnnnnngcacggctatgtcagcttgtatgttgtgtgtcgtgaagtgttatttctttaattcacatcttttgtagtttcgaatttacatataatgcgattttgattttgtattgttgagaaatatggttaattggttttttgactgtggtggtgttcgagt

SEQ ID NO: 8285 - DNA, 854 bp, Diabrotica virgifera
  misc_feature (737)..(737): n is a, c, g, or t
  misc_feature (746)..(746): n is a, c, g, or t
  misc_feature (763)..(763): n is a, c, g, or t
  misc_feature (778)..(778): n is a, c, g, or t
  misc_feature (794)..(794): n is a, c, g, or t
  misc_feature (817)..(817): n is a, c, g, or t
  misc_feature (827)..(827): n is a, c, g, or t
gctccgtgcatgactgacgcaacacctagcgtagtcgcctgacatttttggcgaccacaatttgacgttaaacatatgatacacatatgacgtatttgacgttaatattgtgcgattaagaagctcgctgtagcgaactgggctggttcagtgttcggttttcgcacacaggttttgggaattcttctttttcttttttcgaaggaccagctgggaatccagcacctataatgattactctttaaaagggatagggaatggttggtaggtaataacacacaatgttgtttacagaacaacaaaaaatatgtatattgacgagttaaatgaatagaaggatacgtgagagatagaagatattatatgtttaaattataagtttaattgtatgctgttcaaattataagttttattgtgagacagcttataccgcgtagagtttaacttgttggaacagcaaaccgtttagatgcaatggtaacaccgcgactttgatgaaaggtgattaaataagatgtacgttgtacatattatcttttttctcttaaaatgcggtgtgctcttggcaaaggttggtaacagactctcttagtctcttagtttgtagttgggcaacttttagctttgttgtttggcgggaaagatagttggcgggtatatgggtaacaaactagttttgaagggacaggtacaaggttctaatgtgttgaaatattgaaaatatttgtacgctgtanaaatttatngggaaatttatacaaantatgtaattgtgtanataataataatagtanaattgtggcttatttcccatcanaaatagttanatttaatatttatttaccatttttgat

SEQ ID NO: 8286 - DNA, 947 bp, Diabrotica virgifera
  misc_feature (164)..(185): n is a, c, g, or t
  misc_feature (634)..(652): n is a, c, g, or t
atgtatgtaatttatttaattgaaaataccttttactattgtcaaaaatcagaaaaacatatttaattagcaaatcaatactgttattcgcttatatttcgctataacagtagtaaaatgtatttggaattgagtggattgcatacattcttcgttttgtgtcnnnnnnnnnnnnnnnnnnnnnncttgtacttgtatttttggacaacttgtatgaatgattatattaacgtttatattattgagtggagaattgaataccctttcagatgagctatcacatgacacctattctcatcatcacgcccggatggatgacgtcactagtgtggtatatacgctaaggaatggtaatttaaaagtagagatcgacctgtttcgggaatttcttatagtgttgtttgtttagctaatgatgggtttgtgcgttactttgtggacgcactctatattttctgtagctctataaatttcagcaggtatttagtttataaatctatcttgtagagtcagtcgtaaactgaatgaaagtcctcaacaaataagcaatttttgattaatacctgtacagtactagcacataagacttcactacatttaatgcatttacgtttattatgtaaatatcagggcnnnnnnnnnnnnnnnnnnntttgtaaaatagtttaattgattatttcttggctgctggaaataatgagggaagcatggagaacagaacagataccggaagactatatatagagtgtcgaagcttaaattcattatttcgtgaataaacgattttggaaataaatctcgagacaagccgatttttagtttttaagttatgattttttggcatatgtattatacaagtgacgtcattcttcttggtgtgatgacgtaatcgatgattttttaaattagaacgggggtcatctgcttactcatttgaaatgtttttc

SEQ ID NO: 8287 - DNA, 249 bp, Diabrotica virgifera
  misc_feature (2)..(47): n is a, c, g, or t
  misc_feature (54)..(91): n is a, c, g, or t
  misc_feature (111)..(124): n is a, c, g, or t
  misc_feature (127)..(140): n is a, c, g, or t
  misc_feature (215)..(240): n is a, c, g, or t
cnnnnnnnnnnnnnnnnnnnnnnnnnnnnnnnnnnnnnnnnnnnnnntaacagnnnnnnnnnnnnnnnnnnnnnnnnnnnnnnnnnnnnnntgggacctcgatgttggatnnnnnnnnnnnnnnggnnnnnnnnnnnnnngaattaagtctgttcgacttttagattttacatgatctgagtttaaaccggtgtgaagccaggtgggttctatcnnnnnnnnnnnnnnnnnnnnnnnnnngaaaggacc

SEQ ID NO: 8288 - DNA, 934 bp, Diabrotica virgifera
  misc_feature (705)..(722): n is a, c, g, or t
  misc_feature (853)..(853): n is a, c, g, or t
  misc_feature (896)..(896): n is a, c, g, or t
cacctgcggccattttctagtcccattctggaccttcttcggagccaccctaataggcaaggccatcatcaaaatgcacctccagaaaatgttcgtcatcatcgctttcaacgaaaccctaatagacactgccttagactggttaaaactagtccccgtcgtcggagaaaaactccaagtacccttcaaggcgttcttgaacggccaaaagcagaagcttcacaaaaatgccccagtaaccacggagggtggaaacatcttgggatccattttcgaaaaattcgttatcgccatggtgctgtactttgttatttcaatagttaactcgttcgcacaatcgtaccacaagcgaataaacaagaagaaaaataccaaagctagcaaagattaggcaaatttttgatagacaagttcctagtgtacataatttttctagaagatgcaagatgtattaaaaaatgtttgcgcgaatgaaaaatagtttatattatcagtgataatttttatagtctcaacaacaataatttaatatttgaattttacaacatcaattacataaatatacagttattttcgctgcatattttggtgcttttaatcgctatgtatataaaaaaactgtacaatatatccaatggctgggtttgctacttttgttctctttttatttgccacgtttgcttccacttcgctagtcttcagtcnnnnnnnnnnnnnnnnnncttttttcgccgactttttatcttctttactttttttaatgacgtcactaataagctctcttgttatttcagcaaatatttttgcttcaaaataatttttttgtgaacaatcaaatcgttttaatttattntctacaaaatcttgggattggtttctttttttttttcacgttnttctttgattttttcttttataatttttcccttatcat

SEQ ID NO: 8289 - DNA, 852 bp, Diabrotica virgifera
  misc_feature (824)..(824): n is a, c, g, or t
caagaagaaaaaatgagaagagccgctatgcgtgaagagttttgggccaggagaaatgaagaaggatactgggataataggagatatgacgatgaatatatgggcataggtcccttccacagaggaagaccctatcaaagtggtccattcttcgttggtatgcctcgcagaacagaatctagcgatgataaacacgtgatggctcgccatgctgaaatatatcctaaagaggacgaaattcaatctatcgaatccatagtttccaacactgaacgggctctgaagattgtatcagatcaaatagcagacgccaagaatcccgtcaagaagttggatcctgctgcagcagccgctgcggcagctgcagccaaagctgaagcagaggccaaacagtcagatactccgcagaaggaagacggacgtgataaccaactattcactttccaacaaggcgacaacaccagaattctcaagggcgtgatgcgcgtaggacatctctcaaagggactgattctccgcggcgaaatcaacgtccagctggtcgtcctctgcgccgacaaacctaccttaaccctcttaaagaaggtggtggaactgctgcctcccgctttgaaacagatcgctcctgaagaggcctacagagtggccatcaacgctcccgaagcaggtttgaacgtgaccggcaaggatggcaacgttttggtacagttcacgagtcctgtcatcagagaacagcaaggctaaggctctgggtctacactcctgtgtgatcattataagaatcttgagagacttatgcgaaagagttcccacatgggccccgntaacatcatgggctatggaactactaac

SEQ ID NO: 8290 - DNA, 167 bp, Diabrotica virgifera
  misc_feature (2)..(70): n is a, c, g, or t
  misc_feature (75)..(132): n is a, c, g, or t
  misc_feature (145)..(145): n is a, c, g, or t
  misc_feature (155)..(155): n is a, c, g, or t
annnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnnnnnnnnnnnnnnnnnnnnnnngttaaaagcttanatttttttanaagacgagagac

SEQ ID NO: 8291 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8292 - DNA, 941 bp, Diabrotica virgifera
  misc_feature (171)..(206): n is a, c, g, or t
  misc_feature (854)..(854): n is a, c, g, or t
  misc_feature (860)..(860): n is a, c, g, or t
  misc_feature (868)..(892): n is a, c, g, or t
acttgtgcagttccggcgccagttcagagttgcagaaatatttgtaaaaggggaaacactatccgtcaaagtggagacctcaggattctatgagataccaaaagtaaccatcatgtcttcagaagtagaaacaaaagatgatgttagagaacagcagcaaaagaaaccacnnnnnnnnnnnnnnnnnnnnnnnnnnnnnnnnnnnnttaaattattggaattgttgatttgtgccgcctgcatgggatttatccatgaccccgcgctgacatctggtctgggcaagagccacatggttcacgtcggaattatgtacaccgctttcacgggatacatggttatcaattgtgttttaatcctcggaaggtggatgggtgacagcgttccctacaagacggtggcactgttcgcattggttggagcttcacttttcctcattacgtgcattcttctcactgtcgacagattctacttaatgaagcattacttctatcatcccaacatgcaccttttaacaatgatgacaacatcgatagtttttgcgtttattaatgttgttgtattttctgtggacgctttattcacatatataaggaaagaagacttcgcctaggtttattttagtaagcattgctattaccacttaccattagcagttatattactagtaattgtattttaatagtatttactaaaagagtcattaagtatgtatgtttaaatcttaagccaaaggcgcagtagtatcaatttttattagttatttatcttttacaatggaaaactaggtgcaatggcaaaaagtcctgtttaacgaaattttcctcaactaatcttaacccagataaggccanaccttntttcttannnnnnnnnnnnnnnnnnnnnnnnnggcttggtaacactaagtgaagaagagattttgctaaaaatatgtactt

SEQ ID NO: 8293 - DNA, 660 bp, Diabrotica virgifera
  misc_feature (2)..(636): n is a, c, g, or t
  misc_feature (647)..(647): n is a, c, g, or t
  misc_feature (650)..(650): n is a, c, g, or t
  misc_feature (652)..(653): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattatttanttngnngtgatta

SEQ ID NO: 8294 - DNA, 823 bp, Diabrotica virgifera
  misc_feature (42)..(69): n is a, c, g, or t
taatatttatttttgtgaattggaacgatattatttggaagnnnnnnnnnnnnnnnnnnnnnnnnnnnnaatttaaactgttttgaagtaaaagaacgggtatttcaacctactggcccttgatcaaaaatgttttatacttcttagtttgaaatataaatcgggttatttctgtttttttgattcttattcaatacagtacagttcctcttaactgattacctgggggatacatattattatgggaatagaagtaccatgtatctaaaagactcattcatattcgtgtaaaattacataaacaagggatcatttcataaaagaggtagattcctagtttatggatgttcacacctcgtacaatatataacgatgtagggcattgtttgtccttgatatgggttgaccagcaggaatacctacacttatttacccatcagtactttattggttgttcaatacagtagttgttgaatatgaatagtactcaactgttgacggcactcatcatgtggcaaccccaaatctaactgaataactcgccatctattaataataatccccgtattatttcgcgtgtatctatttattagatcgatatgtttgtatacattttcactttcatttctatgtcaagtttatatgtacatatgatataataatatgtttactgcttactcggcagaagtcaccgtgtcatcaaaatgcgtatcgtagtaaacattgatcgtctggttggtatttaacattctatattaacaatatcgtaataccatattgtattaacaatacaatacaatagtaagtatttcgtattttaaaa

SEQ ID NO: 8295 - DNA, 887 bp, Diabrotica virgifera
  misc_feature (230)..(248): n is a, c, g, or t
  misc_feature (735)..(735): n is a, c, g, or t
  misc_feature (831)..(832): n is a, c, g, or t
  misc_feature (848)..(848): n is a, c, g, or t
tatttgtgttttttgtaggtattatttataaatcttttattgatacttaatataccgtttggtatggactactgttctactaataaccatatatttagctcctagtaaagttcaaactataactttgggtttcatgttgcataattttttaatagaggaaaatacaatacatagttcctaatttggatcaaactgaagataattaatgcaaatattttagcacaaatatnnnnnnnnnnnnnnnnnnncaaagaatcaacagtcgacgtaaaaattctggttaacattaaaatgttatgtttttaaaagtttataaaatccttaaaatcagctgtagacgcagtactaccataccaatgtaacgtgacacagggtgacaaacaaaatttcgaccaatcacgtgccgaatttcatacaatttttgatacaagaacttgcatagtgtcatacagggcacaaatgtacgtacaagaaacgatacaaaaaaatgtatataacttctgatatcagaaacgatattagaaatgatacaggaggatgcatggtgtcatacagccttaagtcagccggcagtttgaaataacatgaccgtcagacaaccttttggttataaaaacacctcagtattttttaaaataatctttgtttgaaaacgatttcagaagtggaaatcgaaacgtcaaacaacaattatttttagaatgtaacttatattgaattcagacgtgtttctanattcaatgtatcgtacttatttatcacagaacagcggaaatcaaaaataagttgattttccaaataatctgaaaattttcagtgtctggaataganngtagtcagcctcattnaattcgaattttcgggattctactgtagtcatactgctg

SEQ ID NO: 8296 - DNA, 876 bp, Diabrotica virgifera
  misc_feature (529)..(548): n is a, c, g, or t
  misc_feature (595)..(614): n is a, c, g, or t
  misc_feature (735)..(735): n is a, c, g, or t
  misc_feature (775)..(775): n is a, c, g, or t
  misc_feature (838)..(838): n is a, c, g, or t
  misc_feature (845)..(845): n is a, c, g, or t
gtctcgcctgcccaatgattatgctaccttagcacggtcaaaataccgccccacgcgtccggacggttaatggagagacggataatcgaggctccactgtatatcacctttaaacaaatcaaagtaataccaaatatccacctttcactcatctgttgtgctcgtccttattgttaatgtacttgaaactgctattaattaacattgttttttaaaataatttaggtgtgatctcaattcagatcttaagggcggtactcgattggcagcggtaaaatgtccgacaggacttgcttttgatcttttccgacaaacttgcgattggaaagtcaatgtcaaaaattgtgatatcgtagaaagtaagtcgatgcagaaggaatagtgacttttattaactcatttaagattataagtattagaataacaaaattaagtaacctaatattgggtaaatgttagttaaaccgaataaacacatgataacattgcatgtttacttcaggttaattagtaagtcttatacaaatgnnnnnnnnnnnnnnnnnnnngttaacaaaaattttacataaccccacaaaaatgctgtcaactttcnnnnnnnnnnnnnnnnnnnncggctatgcaggttagcgcaaccagaggtattgtccctataatattttttttctctttgcatggattctccttcggtcttctacgtagaaaagatgtctcaacgcaagtagcaaagattanatggaagttcggcggacacaccctaaggcagaaggatganagatggactaagacgattatacattggagaccgtggaaccacaaacaagaatagaacaattanacgttanacgtgtatgtatacctaggacattagtcact

SEQ ID NO: 8297 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8298 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttacaccggtgtgagccaggttggttnnnnnnnnnnnnnnnnnnnnnnnnnnnnnnnngaaagg

SEQ ID NO: 8299 - DNA, 827 bp, Diabrotica virgifera
  misc_feature (342)..(370): n is a, c, g, or t
  misc_feature (372)..(400): n is a, c, g, or t
  misc_feature (477)..(501): n is a, c, g, or t
  misc_feature (745)..(745): n is a, c, g, or t
  misc_feature (757)..(757): n is a, c, g, or t
cgatgaagagtttcctcagtattagcttcggacttttcctgtttttaggaatagaatcaaagtctttaaatgacaatattgttaaaaagcgagtatttgcggatctctatggaaaacttaacccaacggtaagaggagatcccggagaacccctcattttaacagacttgattgaagcaggaaaactggatgaagctcaagataaagctcgtgttcaaggattggacacggatattgaaagttactctgggtatttgactgttgataaagaacatgattctaatttgttcttctggttctttccttcacaaggcaatgcaagttttgacccggtagttctgnnnnnnnnnnnnnnnnnnnnnnnnnnnnntnnnnnnnnnnnnnnnnnnnnnnnnnnnnnggttctattaaaagacggcaagcttgatattagagagacaacttggaataagaacaactcacttatatacattgacnnnnnnnnnnnnnnnnnnnnnnnnnttaccactgatggatatgcttccaatcaaactaaagtagctgctgatttatatgaagccttacatcagtttttcaccctattttatcagtaccaacatcaagacttttacgttacaggagaactggtaggattaggggaggcaaagttgatgccaagaaagaggattaggttataggagttaaaagtttttgtacaatttgtatcagtgtatttcttgtggattatatttatacttagatattngtaattcattgngaatatattggtttcacagttggaagctataatggattcttgtaaaaaaaatgggcttggtaacacctgg

SEQ ID NO: 8300 - DNA, 443 bp, Diabrotica virgifera
  misc_feature (5)..(23): n is a, c, g, or t
  misc_feature (347)..(386): n is a, c, g, or t
ttgannnnnnnnnnnnnnnnnnnatgatacctgaagttattgtgtggacctgtgagtagtgtgggacgcatcatagtagtaggtatatgtcaattatttccgaatgtaggatagctatagtattatgagagttgttgtcgcttagggtgttaaataatttctctgtggtgaaagggtattaatttgtaaatatgttgtattttgcgcgatataagttcaagttgtatattagtggtatagttatgattaaatatctttatattattagtattatatattgtgttcgggagagcttaaaaatatagttgtagtaaggtctagttgttgactgagtcttaggtgttatnnnnnnnnnnnnnnnnnnnnnnnnnnnnnnnnnnnnnnnntcttataatttgtatttggtatagttattgtatgaatatgtaaattccgattagtta

SEQ ID NO: 8301 - DNA, 978 bp, Diabrotica virgifera
  misc_feature (761)..(761): n is a, c, g, or t
  misc_feature (804)..(804): n is a, c, g, or t
  misc_feature (837)..(837): n is a, c, g, or t
  misc_feature (844)..(844): n is a, c, g, or t
  misc_feature (867)..(867): n is a, c, g, or t
  misc_feature (880)..(880): n is a, c, g, or t
  misc_feature (883)..(883): n is a, c, g, or t
tataaaacgtctatatttcctagattatataaactcaacactagatatatcgtctaaataattataaacatgatgagaaatacactaaaattatacataaattaaaagttaacaaaaacgataatatgcttaagaattaggatcaaagagaactatctaaaggcatgcgcacttcataaatacttgttcattatttattagtgcttcaatagtacatttttcaaccttataatatataatatgtaacctatatattaaagtttctaaaaattgctaatttggttcggaatactaattggtttaccgttataataagccaaggaaaacgccactacagacatttaatttggcattaacaaagttctagtttaagttgggtgaacaacaatcagaaagttaactacctttacaatagggcttttcattcacagtcatttatttcgagcctctgtcatgtgtcactaaatattaatatatccacgtcatacgttattgatatatccaatgatacaaaccaaagacgtacgacgtagatatattaatattatgtgacacatgacagaagcccgaaacaaatgacaatcgatgaaaagccctatatattaattgttgcttccgtgacaaagtgttattgctccgtggtagactagtaatgacatgtggcatgcagtatgacagttattgtgttgtcaagataacatttgacagctacaaggataatcatgaacctacactacagaatatttttattctgcgtctancagtttcgtaggtgtttgcttgtttcgttaatcaccaaattanagttgtacggaactaatacaacatacaaattanaatcatngaaatgtattattatttactaancagacgaaatganaancaagtaatgggcatatgaagggaagtgatagtaatacatgaaatggttgttttggtaaagtttagagcatgtactgaaaaagtattggtcgaaat

SEQ ID NO: 8302 - DNA, 738 bp, Diabrotica virgifera
  misc_feature (75)..(125): n is a, c, g, or t
  misc_feature (181)..(198): n is a, c, g, or t
gaacaagctgcagaagaaaatccagaagaggaggaagaagttactccggttatagaagcaagagttattgttccnnnnnnnnnnnnnnnnnnnnnnnnnnnnnnnnnnnnnnnnnnnnnnnnnnncgacactttattgaatgctgcaaacaatggaggaaatactgctccctttgaacaannnnnnnnnnnnnnnnnngcaacacctagtacctcagaagcatcagcaacaggtacttccccaagatcttcaactgagaatttggcttctgattccagacccgcgcctagcagccgattaccagaaaacgcctccagaattggagatctcagcgaacttctgactatgttgacacagatacaaattagatttgctccctttttggaaagatatcagcagttcactagggatgacccagatgttacaggagatgacgtaagaacaactcagaacatgctgaatagggtttcagaagtgatgcatttactaggccacgcctatcattcactcagtgatctaattataagagtaaggactcctcctggacttccttcgcgtcccagggctttattgtgtcgtcccattctcataccacattcgggcgtactaccaactggtattcctatacaagttgagggacagattaacttgacagctgaacgcaactcttcgtcaaacgcagacccttcagcacctccagaaccaccgacgtacactcttcacgccacacctgtcagc

SEQ ID NO: 8303 - DNA, 532 bp, Diabrotica virgifera
  misc_feature (2)..(15): n is a, c, g, or t
cnnnnnnnnnnnnnnctatctttacaaatttagacgagaaatctatattagttaattatttgattctaaaaaatcgaaaaaaattattgtgttgttggacttatgatttgcgccgggccataagatcgcatagtttgccggtgtggtacgacacagagttgattcgtgttttagggaatgactgccatgaagtttgcgatgatggcggagactgatggacgccatctctgactcggtatacaacctggccttcctaggggaggaggtcggtacattgtgctacactctgagtctatgttgagctaattggagtattaagcagtgactgagagtaatatcccctgatctagtatctaccgacgtctactgtattcgagttccagtgctgacagcataccgagagtgtgtgcagtgatatctaaatatgtgactattgtggttatccaaacggagatcaacatgaggacatccatgacatcgatggatgcgacgattactaagagcgtgtgcagtagtaactgtttcataatga

SEQ ID NO: 8304 - DNA, 374 bp, Diabrotica virgifera
  misc_feature (9)..(38): n is a, c, g, or t
  misc_feature (40)..(78): n is a, c, g, or t
  misc_feature (83)..(136): n is a, c, g, or t
  misc_feature (139)..(168): n is a, c, g, or t
cgccgctcnnnnnnnnnnnnnnnnnnnnnnnnnnnnnntnnnnnnnnnnnnnnnnnnnnnnnnnnnnnnnnnnnnnnngtgannnnnnnnnnnnnnnnnnnnnnnnnnnnnnnnnnnnnnnnnnnnnnnnnnnnnnccnnnnnnnnnnnnnnnnnnnnnnnnnnnnnnattttcgaatttcacagagcaccaacattaacattgttattgctatatgactatcttaaacaagctctttgttatgaaatgtagtgcgggtcatgattcttctggatcttctggcatatcttaaatacagttataacaagatatctatacttagataattttatataattatcactgactatttttaggcatggtcggacaaggac

SEQ ID NO: 8305 - DNA, 288 bp, Diabrotica virgifera
  misc_feature (172)..(172): n is a, c, g, or t
  misc_feature (191)..(191): n is a, c, g, or t
  misc_feature (201)..(201): n is a, c, g, or t
  misc_feature (240)..(240): n is a, c, g, or t
  misc_feature (254)..(254): n is a, c, g, or t
atactacacaaccagaaaaagccagtcaagaattagaagatttggtttcttctgatgactttttaggggatgaaataaacaattatcatgacgtaaaacttattgaaagacaagatgaacctttagtaaaagaaaaggaaaagagtaaacgatttggaggactgttttccanaaagaagtcttctgacaangaacaggacnggtaacctagtaaggaagaaataaacaaatcaaaagacnaaaaagaaatcaanagaaagagaagggacctgacagctaaaccctgaa

SEQ ID NO: 8306 - DNA, 746 bp, Diabrotica virgifera
atcctactttaaccctatcttatatcaataatatatctttgttcttatatgaaacagcctcttgaaattatttgtccgatcgccgtttaccatcacctttaactcagatagaattaatatattctggctagctattcttgctgtaaaaacgtgtcctaatataatcgctaattattatcatattgttatcaggagtatagttaattcaagaattaacagtctattcaccatgtataagaagcatgacgacagctattttcctctccatcatgttcctcttttgatccatcagatcttattgcatcatactaatcttctgtgaaatatctccaactttttgccttcatactctactgctctactcacttattaacatatatgccttagctcttgccgtcattggcagacctccctactgtgcactagccggtctatcaccactgaatacaaatgattgttgcgacactagccgtggaatcagtgacccaagatgtcaaccatctcaatgcgcagtacgacactggccttctggatatatatcagaattctcaaagatgtatatggttttccctcatgtacagcattcatcaatccaatgtgacattactgatatagagatgatgtgaactccacgaaacattcgctgactaatatgcttctcatgacagataacacctcatgcgatacatggcctatggactatgtgatcccaccacattccatctagtatattagttctcaacata

SEQ ID NO: 8307 - DNA, 805 bp, Diabrotica virgifera
tgcatagtgaggtgttgatagttatatagtggatttgattgacattttctcgtaaatctgtctgtgttatattgacccaataatgaatatgcactcgatgaatgatcccgcatcggttttatccggcatgatgtcttttgactctatcagtttgtatgagcaacctaaacctaggtttatcttcaaaatgccacgggtagtgccagatcagaaagcgaaatttgagtctgatgaattgttcagaagattaagcagagaaagcgaagtccggtataccggttacagagatcgaccgcaggaagaacgcatggtccgttttcaaaatgcctgcagagaaggccacacagaaatagcttttgctgctaccggtaccaatcttcaactggttttcgcaccccccacatcgggatatatggcagataaagaatgcgactttgacaaagaacctggaaaggtccacattaaagccaccttcatcatgaacggcgtttgcgtcaggtggcgcggttggattgacaccgatcgtctggatggcgtcggttgcctggaatataacgaggaaagagctgcacaagaggacgccctcctgcgggaacagatcgaacgttacaaccagcgactgagggaattcgaagacaaacaaaggggttaccgacaagacaggcctgaacaagatctcgagttgagaatgtccaacaatattcatggtcatcatgcccaccatggtgtctcgtcccgttgccatggaccaccaaagggctgagagaaaaaatgattaatatcagaaagtcttaccacaacacat

SEQ ID NO: 8308 - DNA, 852 bp, Diabrotica virgifera
  misc_feature (784)..(802): n is a, c, g, or t
gatttattttcattaaaattgtcacaaattttttattaatatcaaaatacaaaaacaaccaatgaggtgtacataaataatatacgctagccacagtcattattgtaagaatgctacttaaagttaaaattaaatcatttgaatgcaaattattgtctggaattgttgaattctggacattattttcgttctagttgaacacattttttgcaatttttttatgcaatcattatgttactacatgatctcttgctcttgtattggcttttaaattgttaactgtacttagttttttacaaacttaatgtctgtattttacatttctcaatggttcgtttcactatctgctttacttacaacttgctagttgcattgctttttttctatggatgtttgttatttatcaaactcatttgtagatgaactgctaatgttcactaattagtgaacaaaaatgtcttcaataaatagatgaagtagccgaagtctttgtcttttattctccaccttttgaccaataaacctaccactttcgaatgataatattatgatttactatcttttaggacagtcgtcccaggaacgcaactcatcaatattgacaatatcattttaaagtcttcttcattaaaatgtataatccatgtctgaattgctgatataaatgagtcagattaaataaattattagaagaattttttactatgcaataacatttttgtttaatttaatatattgtattttagacacacccgacttgggcgtcgaaacgctaataaaatcnnnnnnnnnnnnnnnnnnngcgttatttcccattgaaaatagttgattaataaaagaactttacaacat

SEQ ID NO: 8309 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8310 - DNA, 983 bp, Diabrotica virgifera
  misc_feature (14)..(42): n is a, c, g, or t
  misc_feature (45)..(783): n is a, c, g, or t
  misc_feature (785)..(817): n is a, c, g, or t
  misc_feature (821)..(846): n is a, c, g, or t
  misc_feature (870)..(870): n is a, c, g, or t
  misc_feature (876)..(924): n is a, c, g, or t
  misc_feature (930)..(982): n is a, c, g, or t
cctcccagcgtccnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnntaannnnnnnnnnnnnnnnnnnnnnnnnnagaagacctatagagtttaataanatattnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnt

SEQ ID NO: 8311 - DNA, 83 bp, Diabrotica virgifera
  misc_feature (4)..(73): n is a, c, g, or t
ttgnnnnnnnnnnnnnnnnnnnnnnnnnnnnnnnnnnnnnnnnnnnnnnnnnnnnnnnnnnnnnnnnnnnnnnattttttttg

SEQ ID NO: 8312 - DNA, 147 bp, Diabrotica virgifera
gcctgcaggaccgggccggactcccgccccctctacgcggccgttttatttattttacaataatcaaaactactcccttcagtgagaaagtataatgaaataacttgttatcttcaatcgatacgcgtaattcagtaatatgtgaga

SEQ ID NO: 8313 - DNA, 560 bp, Diabrotica virgifera
gttaatttgagacaaggtctcgaacacaatcactcgcgcttcaactgattcgtctgttactattccgtttgacagaaccttcagagacttggacaccagcagacctgatggtggaaacaacttggctcaattcaacttctgcggttgtggctggccacaacacatgttaattccaatgggtaataccgacaatccaggattcagatgcgagctctttgttatgatttcaaatatcgatgatgacaggattgaccaagacattactggaatttgcaacgatgccgactcattctgtggtgttaaggaccgtttgtacccagaccgtcgttccatgggttttccatttgacagacaacctagacaaggagttgacactttgcagcaattccttactcccaacatgagagttcaagatgttgttattcgattttccaacaggactttcaggccaagacagaacaattaattcaatattttttctaaatgttaaagattgatactgctataagactaaataaaacgtattaaactaactgcttaaggataattttttaacttct

SEQ ID NO: 8314 - DNA, 673 bp, Diabrotica virgifera
  misc_feature (5)..(22): n is a, c, g, or t
  misc_feature (334)..(352): n is a, c, g, or t
atcgnnnnnnnnnnnnnnnnnnaaaattattagtaacgataataaatacaatcaaagaacatgctgtatatgtccaccaccaacatctctacataacgtaactcttcttctcattaagtctataacattgttaaggactcatggagttttatttaattcttgaatacgattctctagggtttgtccaagatcttccaaatccactacaggagttttaaaaattgaattttttaaatgtgaccacagaaagaaattgtagggagtcaaatcacaggatcgagggggaatataataggcgtatttaaacttatgatcctattatcgaaaaagtccnnnnnnnnnnnnnnnnnnngctgtgttgtatgaattcgagccccgtcttgctgaaaatatccttctattagtgaatcaatcatccatcaattgatttataaattgagttaaaactgtttgacgatatctttcatttattagaatcactttgaaaaatataggccatatatcacgccgcttgcttatagcagcccaaactccaaagtttctgtggatataaaggagtttaaataaaataatgcgggttatctgtgcttcacatcctcatattctgaggatttgtgtacccagacagatgaaaccaacattcgtcaaaatcttaaatcttcaaaagcatatc

SEQ ID NO: 8315 - DNA, 967 bp, Diabrotica virgifera
  misc_feature (763)..(763): n is a, c, g, or t
  misc_feature (774)..(774): n is a, c, g, or t
  misc_feature (778)..(778): n is a, c, g, or t
  misc_feature (805)..(805): n is a, c, g, or t
  misc_feature (842)..(842): n is a, c, g, or t
  misc_feature (891)..(891): n is a, c, g, or t
gaggaaataaacggacgtagtcttctcaaatagtcattacaggggacgtaatagtgacagatggcgttacagagctattttgacccattattttaaattgaatcttatggcaaatgaaatctcgtttgaaagtaattaaaaatacctattcaataatactaattttggagtaccgaaaaagttaatgagctgtaaacacgtagtgtctcggctcttgatattttgtctattatcagtgaaactaccagtttttaattatagttaaagtgatcaaactaactttaaactacaaaggtttatggattataaacaatttaccagttttgttttttgcgggaaacgaaagtaattagtttcggtagtaccgtaaatgaattatcaatatgtcattagatgttactatacagaatgtcccagcgaataaatattattctaccgcagcttcacagcaaaatttcttcccaggaaaagaaaacgcaatactttttagcgctattaataatacaccactgcaagagtaccttatttctttaggtaatttaataaatcctaaaaatatcttattctcgtctcgcctatctaataatcgaatatgcatgtatttaagtagcaagcaagctgttgaggattatgaaaaactatggttctatacaggtaaatggagaagcagtcagggccagaaggctcataacgcctgcagaaagaatagtgctatcaaatgtttgtccaagtatcccacacgaagtaatcatccaagaattanaacatctcggnctanacttagtttctccaatcactttcctanagatcagtgcctctcttccagaatatagccatataanaagttttagaaggcaaagtgttattagtccgcataacacgacgatccanaattcaattctttctaaatatgataatactaattatagaatattcatttcgcaggatagtatgatatgctatatct

SEQ ID NO: 8316 - DNA, 445 bp, Diabrotica virgifera
  misc_feature (180)..(203): n is a, c, g, or t
tcccgatttgttttatgcagtttaatgaagcatgccttttgataatacatgtgagagtgcactctggggagaaaccatacaagtgcgaaatttggttaaaatggattagtataccgaatatcctggatgccgtttgacgaagactcactggagataaacctctcacgagtgatctttgannnnnnnnnnnnnnnnnnnnnnnnttttgacatagcatttgagagtacactctagtggatagaccttactggtgtgaaatgtgattagatcttattagtatatggcttaagacgaaatggcctgtgagacgacacactgaagaaatatctcactactgtgtattctatttttgctattatatgtaatcggcagtgtgctcacacatctaaaaatgttcactgtagattatcaatataaaagcgtaatttgatctcagcatatttta

SEQ ID NO: 8317 - DNA, 911 bp, Diabrotica virgifera
  misc_feature (34)..(52): n is a, c, g, or t
  misc_feature (242)..(264): n is a, c, g, or t
  misc_feature (412)..(433): n is a, c, g, or t
  misc_feature (490)..(520): n is a, c, g, or t
  misc_feature (731)..(731): n is a, c, g, or t
  misc_feature (740)..(767): n is a, c, g, or t
tttgaaatacataaagttaagtgtaatcacacgnnnnnnnnnnnnnnnnnnngcgaggaaacgtgtaaagtagaaatagagtataatgacctggatgatgcatttttggacggcattaaatgtgaagttaaggaggaatccaatgggcaaagtacacatgatacctatgattatttagacttaaaagaacgtcctataaaaactgaaatagagcaagatgcaaataaacttaacctatttgnnnnnnnnnnnnnnnnnnnnnnnggttatcttcaacaaggagaaactaaaatggaaattatggagacactaattggacattcatcttacgatggcaattatatgggtgcacacgatgaaggaaaaacaataaatcaaaatatgaaagttgcgactggacgaagatcttacnnnnnnnnnnnnnnnnnnnnnnggtgtactgatagaagtaatttaacaacacatttgagagtgcacactggagagaaannnnnnnnnnnnnnnnnnnnnnnnnnnnnnngtgagacaggtaatttgaaaagacatttgagagtacacactggggagaaaccttataagtgtgaaatttgtttcaagcagtttagtggagcaggtagtttgaaaacacatttgagagtacatacgggggaaaaaccttataagtgtaaaatttgctttaagcagtttaagcaatcagtaaaattgaaaatacatttgagagtgcattctgnggaaacacnnnnnnnnnnnnnnnnnnnnnnnnnnnngtttagtagagtagataatttgaaaagacatttaagagtgcacactggagacaatccgtacaagtgttccatttgttttaagcagtttactgatagaagtattttaacaacacatttgagagtgcacactggagagaaaccata

SEQ ID NO: 8318 - DNA, 952 bp, Diabrotica virgifera
agactgtgttttaccattattaaaatggaagaacataaaataatacgtaaatgtgttcctggttgtaccgactggacaagcaatcgattacgttttccaaatccccaacatgaaatggacatgttcttggaatggatgaaacttatcaagaggaatcaattaagcattttaaagaagaagacattttaccaaacgtgaaatctggaaggagagggattatcagaagcgcaatcccgagcttatttttaccgccactagcaggtcagggtgaatagatgcctaagctcagaatgggactcatttccatggagtataacgtggatccctgcacaaggatataggcgaagaccagaatagcagcaatcacttacaaattatatctgtgatattatacttctgtaatagggcttttagctttagtaaacaaatgactgaatgaaaagccctattccatgcaaattttgattgctcaaataagtttataaagtaaattacataaataaatacatttttaagaatatctgtttaatttttttgttttcaaaaggacaaaagtgttataatgtatttaatggaaaacagatatagtcgtggagtagcaaatgaaaacttgttctatgccaaggaatgtattctctcggagcgggaatgtacactggggtgcaaaattgatcggacaccttgaagatggttcatttttgatgtctcgaatttactaagcctgttgtccgatttaagtgcttttttaatgttatagccttgttctttggaaatatcgctgtaataatatttttggtaaaagttaaattttcattgtttacagggtgtaccaatgaaactgtattttttctcaaattttgcatcgccctgtggaatgttctagcgtttataataatgcccaaattgggatccaacttgtggcctcatgtttttcttaaccgttctgtttttt

SEQ ID NO: 8319 - DNA, 604 bp, Diabrotica virgifera
gctttctcatcgattgggaccactgctaacagcgaagtacctatctagaaatttgttgaagatgctggcactttgctatatttggtaaatcacaacatatcccctctttgtcacatgataatgtttgtagctgtaaggatatctcaataatttctaattatgctaaggtagatcaagccgtatgtccgaaaccgcggatggttaaacatgatgacttgagtcgatgaggaatagtaatcaacaatgatacacaacgtctatatgtgtgacggacttcaagtatgtggaagagcctcaaatatagatgagcatcaagaatatgaacaagcgtaacgtatgattacaactatcaatggattaatcccagacaattaggggaaacatcaactgaaagggatattctttgatggcatattggattcaatatccgtataaaataacactcgaagatctgacagaacatggttacactagcgtccaaacttatgagagtctattaaccgatcaaaattttgctctggaaattatctatagggtaccatatgatgataaaactatagtattaagggaactatagaactttcatcattattcaaagacgccc

SEQ ID NO: 8320 - DNA, 229 bp, Diabrotica virgifera
  misc_feature (25)..(64): n is a, c, g, or t
aatactaatattatcatcattactnnnnnnnnnnnnnnnnnnnnnnnnnnnnnnnnnnnnnnnntactctagagcatggacatttaattatgttcaaccatctatttattgtctgcgccatgcgattctcggggccagaaagaaaaatattatctatgttttttccccaaattagaaagctaccaaattatgatttttatcgtaagtaataaatatctcctatgtttct

SEQ ID NO: 8321 - DNA, 90 bp, Diabrotica virgifera
  misc_feature (13)..(89): n is a, c, g, or t
aagacgagagacnnnnnnnnnnnnnnnnnnnnnnnnnnnnnnnnnnnnnnnnnnnnnnnnnnnnnnnnnnnnnnnnnnnnnnnnnnnnng

SEQ ID NO: 8322 - DNA, 653 bp, Diabrotica virgifera
ggcaacttttggaacctcacaacacgccgttcagtggtaaaagttcagctgcagcagctaggcacctctggacgtatttagttcgtcaagaatcagtccaagatatatttataagagcagtatttggtaaaagaagatattctggtgcggtagaagaaattttaccccatcctgaaccgactgttttagaacctgtcagaattattcataaagaacaagattctatatctgcgttctccttaaatcaggtaaccagtggtcttatcgcgattgctacaccaagagagcttcaggaaatggatatttctcttctgctagagttacctgcttggttagaagacgaatgtgaactggacattctaaatttccacaaagaggtaccagatcctacgggtcccccattcttggtaattcaaagttccaccgaccaagggaaggaaacacaaccgggaagtccacaggcgggaggaactgctggtcagagcggaaggggaactagtggtgttctgaaacacaaaatcgatggtatcaaaagaatcacagcgcatccattgttacctttatatttgaccggagggcaagatggttcagtacacttatgggaatggggtcatcaacagcccgtagctgtacccagacctcctggaacgtat

SEQ ID NO: 8323 - DNA, 621 bp, Diabrotica virgifera
  misc_feature (17)..(39): n is a, c, g, or t
  misc_feature (69)..(89): n is a, c, g, or t
ccaaatggcttcatacnnnnnnnnnnnnnnnnnnnnnnncccccctaaaatcggttaaaaataaccggnnnnnnnnnnnnnnnnnnnnnggaagggaccgggttggaggggccctggggaaaaaaaccccaaatatggggctggaccagtggaaaaggaagtcagttaaccccccaaaggttacaaagggagtctggcaacttctccgcaaaaaggggggggaaacaaaggaaccccagggaaaaaggccccgggtttggcccacaattcactcgggcccaaaactgggggggggagggaattggactttacaaaggaaaagggcccgggggcccacccaaaatggaccaacccaccttcggccaaaacattccgggggttcccgggggaaaggaaataacggccaactgggggctggaaagggacttttccctgggggtttttttcaaaccagggaacgtcaatttcccaggaaaaaggcccaaggttacccacaagggggcccccccccttatgggggaaaggtcccccccgaaggaattccttacaaccaggggccgggacgaaaattggggttttttggggggtttcttccatcggggggacttcgaaacctcccaa

SEQ ID NO: 8324 - DNA, 488 bp, Diabrotica virgifera
  misc_feature (78)..(95): n is a, c, g, or t
  misc_feature (146)..(167): n is a, c, g, or t
  misc_feature (243)..(260): n is a, c, g, or t
  misc_feature (409)..(426): n is a, c, g, or t
ttacaaacccggggaggggaagccaaaaaccttctaaaagggcccccaaaaacaaatcccggggccccgttttaaaannnnnnnnnnnnnnnnnncccgggggaaccccaataaaaccccttggagaaaaccccccctttcccccnnnnnnnnnnnnnnnnnnnnnncccccccaaccccccccccaaaaattgggcaccccgaaaggggaaagggaacccccccggaacggggcataaaaannnnnnnnnnnnnnnnnnaaccccacggggacccctaaacttgtgagggccccaaagccccccccttttccttttttcccctcctttttccccacgatcgccgggtttcccccccaagatctaaaacgggggggccccttagggagcccaattaaggggttacgggnnnnnnnnnnnnnnnnnnttgattaaggggagggggcacgcaggggggcaccccccccataaaagggttttctccccctg

SEQ ID NO: 8325 - DNA, 59 bp, Diabrotica virgifera
  misc_feature (27)..(46): n is a, c, g, or t
gatcattaatacgttcttttagtattnnnnnnnnnnnnnnnnnnnngattatctaactc

SEQ ID NO: 8326 - DNA, 133 bp, Diabrotica virgifera
  misc_feature (52)..(52): n is a, c, g, or t
  misc_feature (54)..(54): n is a, c, g, or t
  misc_feature (57)..(58): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (66)..(66): n is a, c, g, or t
  misc_feature (68)..(71): n is a, c, g, or t
  misc_feature (73)..(74): n is a, c, g, or t
  misc_feature (76)..(76): n is a, c, g, or t
  misc_feature (78)..(78): n is a, c, g, or t
  misc_feature (80)..(82): n is a, c, g, or t
  misc_feature (84)..(88): n is a, c, g, or t
  misc_feature (92)..(94): n is a, c, g, or t
  misc_feature (96)..(100): n is a, c, g, or t
tcttctagcgtccggtttcttatataattccaatgaacacatacgtaaaggngnacnnanangngnannnnannangnannngnnnnnaagnnnannnnnattcagttgctttaccatctcgcgactcaaaag

SEQ ID NO: 8327 - DNA, 810 bp, Diabrotica virgifera
  misc_feature (10)..(24): n is a, c, g, or t
  misc_feature (27)..(41): n is a, c, g, or t
  misc_feature (43)..(610): n is a, c, g, or t
  misc_feature (617)..(654): n is a, c, g, or t
  misc_feature (674)..(687): n is a, c, g, or t
  misc_feature (690)..(712): n is a, c, g, or t
  misc_feature (720)..(741): n is a, c, g, or t
  misc_feature (775)..(801): n is a, c, g, or t
cctctccttnnnnnnnnnnnnnnntgnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggtttctannnnnnnnnnnnnnnnnnnnnnnnnnngaaaggacc

SEQ ID NO: 8328 - DNA, 575 bp, Diabrotica virgifera
  misc_feature (2)..(31): n is a, c, g, or t
  misc_feature (33)..(62): n is a, c, g, or t
  misc_feature (70)..(231): n is a, c, g, or t
  misc_feature (239)..(360): n is a, c, g, or t
  misc_feature (397)..(433): n is a, c, g, or t
  misc_feature (472)..(505): n is a, c, g, or t
  misc_feature (507)..(525): n is a, c, g, or t
  misc_feature (546)..(566): n is a, c, g, or t
cnnnnnnnnnnnnnnnnnnnnnnnnnnnnnngnnnnnnnnnnnnnnnnnnnnnnnnnnnnnngaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattataaaattgtatatttaatacaaatatatacnnnnnnnnnnnnnnnnnnnnnnnnnnnnnnnnnnnnnattattataaacatgtctttatgtattagatatacaggnnnnnnnnnnnnnnnnnnnnnnnnnnnnnnnnnnannnnnnnnnnnnnnnnnnncatcataatcattaactttannnnnnnnnnnnnnnnnnnnngcttggatg

SEQ ID NO: 8329 - DNA, 351 bp, Diabrotica virgifera
ggacagtaaagtcgttatcgtagataaccattagtttataattgctttttaatttcacaagtttttgttagtgaagtgcaaaacaacacatctattaatcattgggtgatgatagattttgttatcattggatgataacaaatttaaaaaaggactcttgtacctcctgttgacgatatgtctctcacaaacattttcccacggtgtgtcaccattatcagataaatttaagatattgttccaatttaaacaactggacttcgagtatccaactgctgcggcaaggaagtcagatatagatgcaggtctctttattccaggaaaaccagctccgattgataccgatgtcta

SEQ ID NO: 8330 - DNA, 272 bp, Diabrotica virgifera
cagccaagtcagtactgtaccctgctggcctccttaacggaccaaacagatcattggctctgttgatgcttgatgactatttacaaaagcagcaaatatttatttttaagattgtgatttaataatattccatatataggatagaatcacttttctataaatgcatcatctgcgtgtgattattagcgagaaagaatgtttgtacattattcaacaaatgtctataattatgatttttatatagtaaaataaatacatctccgatatctacg

SEQ ID NO: 8331 - DNA, 701 bp, Diabrotica virgifera
  misc_feature (10)..(10): n is a, c, g, or t
  misc_feature (15)..(15): n is a, c, g, or t
  misc_feature (38)..(38): n is a, c, g, or t
  misc_feature (360)..(389): n is a, c, g, or t
  misc_feature (503)..(520): n is a, c, g, or t
tctctcgcgnccggntgcaccacgcccacgatatttgnaatgtttaagagaataccttgggccgatgccatattctgcgttttgaccggatgcggtgaaaacacatctgtttccatcgcaactggaccgacctgtcacactatgtgttttgtctggtgcagtttgtaagcgcgtaccgatgactcaaaacgcatccgtttccaacgcaaccggaccgatctgtcacactatgcgttttcaccggatgcggcggaaacgcatccggtcaaaacgcataatgtgacatcagccttaattgtgttgttgataatgtagatacataccttcatttcagtttttgctcatttctactattcatgnnnnnnnnnnnnnnnnnnnnnnnnnnnnnnattataagtgtgcatagtatccaataccggaagtccaatttatagtaatagtattttaaactgtatgggaataaatagtgctaagataactactcactattgtctgttctggcnnnnnnnnnnnnnnnnnnagatgcaatcctgcttatgaactaaaatcggttgaacttggttttaagcgttttttaatatgctttgattgaacaattctaataaaatctgttctataccaaaaagcagaccaaggatatggttatgacggaagatatggtggtggtggcggaaccggacgcaatgttaacactcgtggaa

SEQ ID NO: 8332 - DNA, 76 bp, Diabrotica virgifera
  misc_feature (2)..(66): n is a, c, g, or t
gnnnnnnnnnnnnnnnnnnnnnnnnnnnnnnnnnnnnnnnnnnnnnnnnnnnnnnnnnnnnnnnnnggggtgatta

SEQ ID NO: 8333 - DNA, 758 bp, Diabrotica virgifera
caatagttagtggattagaaaaaagaagtatagatttaatagcagctcatggcttgatatcgcaggaaaggttacctcacgacacctctccatcgggataccacctattcttacaaccgtttccaaaagatggttatttcgaaggaagggtgaaaatcaatgtgactgtccaacataaaactcacgaaattgtgttgcacgcacatccagatttaatgataatgcactgcaacataacacagttgataccttctgatgaagaactaaaaagggctaatctatcagatccccttgaacgagaatttcctccagtgtcagtggttatagaatcagcagaaaaggttagaagcaagccattgtacaatattgttttacaaagtccaataaactctggggcattgttggaagtataccttcactttactggaaaaattttccacgattcatcagagggacttttccggggcaactatgttgatttgatgactaaagaaactaaatggtttgtagacactcatatgagaccaaatatggcaagaagagtttttccgggctacgatgaaccagcatttaaaatcccatttgtaatttcggtggccagacacaaaaatatgacggctgtatccaatatgcccttggactacacaactccacatgaggctataaaagactggtactgggacactttcagaaggactcccgtcatggccactttttcattgggaattgtgatctccgagctcagcaatattacaagt

SEQ ID NO: 8334 - DNA, 688 bp, Diabrotica virgifera
  misc_feature (209)..(238): n is a, c, g, or t
  misc_feature (311)..(328): n is a, c, g, or t
  misc_feature (338)..(370): n is a, c, g, or t
  misc_feature (465)..(481): n is a, c, g, or t
  misc_feature (484)..(510): n is a, c, g, or t
  misc_feature (513)..(525): n is a, c, g, or t
  misc_feature (528)..(550): n is a, c, g, or t
  misc_feature (570)..(591): n is a, c, g, or t
  misc_feature (593)..(605): n is a, c, g, or t
  misc_feature (647)..(665): n is a, c, g, or t
acgctcaaaaagaatattgtcattagtaaacttgtttatgaatactatttagtgactgataattaggatacgcgagatagtatttcatctatatagaggacaaattcatcttttgaaccttgtgtatcgagcattctcctataccagtagatatctatatatttccgaatataaaagagctaagaaattacaattattatcgtacccgnnnnnnnnnnnnnnnnnnnnnnnnnnnnnncatgtatatgcatatttaagtatatctaattatttaacaagtccattagatttatttattacctatatatccnnnnnnnnnnnnnnnnnnattattaatnnnnnnnnnnnnnnnnnnnnnnnnnnnnnnnnncattgtattaaaatttagtctttaaattctaattacgattaaaaattatcctaccttgacacatgctattattatctttatagattattatttcnnnnnnnnnnnnnnnnnccnnnnnnnnnnnnnnnnnnnnnnnnnnnacnnnnnnnnnnnnnccnnnnnnnnnnnnnnnnnnnnnnncagaaaaagtatatccggannnnnnnnnnnnnnnnnnnnnngnnnnnnnnnnnnncattaaaaacctgcctgtttgtattacatataatgtcgcgannnnnnnnnnnnnnnnnnncctgaacggcggtatcttgaccg

SEQ ID NO: 8335 - DNA, 319 bp, Diabrotica virgifera
  misc_feature (35)..(60): n is a, c, g, or t
cgggcgacccccgcgcccccgcgtgcgcgatgggnnnnnnnnnnnnnnnnnnnnnnnnnngaaatacacagagtagtatagataaaaagatttttatttagtgttcactgaagcagaattcgagagagaatattgtgtctttatgaaacagtactctcgtcccgaaggaccttagagaatcagtgatctaacataatgaataattacctatcctattactatgtcaaaataagcacccgctcttgtatttcaaatattactgcaccataaatactatgaagaattgttattgaccgacttgttgttcgatgtttatcta

SEQ ID NO: 8336 - DNA, 848 bp, Diabrotica virgifera
  misc_feature (741)..(783): n is a, c, g, or t
caattttcattttttgaacactttgagatgcactttggaaaatgcatttccgccttcaacaatgcaattttaatttgtccctcatgccaaatggtcaacaattttcctgaagatctcccgaatcaaatgcaaaaggtttcataatgattcgtcttactttaaaaaagtttgaggtggaatgctttatttcctcgcctaatactgctctactttacctatgataaaaacgaaacaatcatgtgtacataaaatatgcttataatgatgcaattagataggaaacatcagttaggtactcgaaagaattgtctagaggaacaacttccaaaagtaccattcaactttttctatattgatctaaatactagcttcgtgtcttagttggaggtgattggtcgcattcaggagacgaaaaagtgatggagcggtaacagttgtgtttcgtcttgtgaaccgctccctaaattcactttctgttatatgtgaggttatatactcgcctctgcacaataaataattgttttctacttcataatcatggtcaaagaccatggattgtttaccgtctgcgttattttccaattgataattagtacttgacgccatctttcaacaagtctattgacacattcacaaaagtagcatacgttggacggaggtagcggaattaaaatgagctcactgtcatggcgaccgttccgtaacacgtttcgcaagtagcgccacattcagagaacgaannnnnnnnnnnnnnnnnnnnnnnnnnnnnnnnnnnnnnnnnnngaaatcaacaactgttgctctaggtacgtcactgacgagtggtgatttaactggcaacctgaaaa

SEQ ID NO: 8337 - DNA, 880 bp, Diabrotica virgifera
  misc_feature (143)..(180): n is a, c, g, or t
  misc_feature (782)..(782): n is a, c, g, or t
gctatttttgtccatgctctacttctagtttcatttagtttacatcttatcctattaactaatgtttgattaagtctttcatttaaaccattcgaaaatgggcagtccactgctgtaaaaaccagttgaatatttaactgttnnnnnnnnnnnnnnnnnnnnnnnnnnnnnnnnnnnnnntactgatctgttaataatgtttttatggggtgtttatcttgaattttagagattagtttaataaaatcacctgtcatctgatttttggaagtaactgcaaatgcatatctggtaaaatgatctacaagtaagtggaggtatttttttgttgaacgattgccagcaaatcctcctattgtatctagggacattatctcgaagggttcttttgccggacctaattgtgacaagagaccatattttggacctactcttgttttatttttacagcagatctcgcatttctggcagatatcttttgccagtaaatccaaattattaatgtagtaaaaattcctaattttgttaattaatttaccagcacaaatatgaccataaaatttgtgaatttttgttattaacttcactccaaaatctttggataaaattatttttttctggttcttccttaatttatagaatacatcttggttaaaaattgttcctatcattttatctatagcttgtcgattattattctggtcttgttttatctcagttaatgtcactaggttcactgtttttataaatgtttctgcattttctatattttccaaaactgngtttctagaaaggcagtctgcttctacattttccttttcagggtcatatttaatgtcgaaatcaaattgtgaaagaaaatgagtcatatctcctaatc

SEQ ID NO: 8338 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnganaggnnnnnnnnnnnnnnnnnnnnnnnnnnnnnnnnnnnnna

SEQ ID NO: 8339 - DNA, 59 bp, Diabrotica virgifera
cagacgtctgggtggtgcgattttatatccagaaaatatcaaatagctgctcttcaaag

SEQ ID NO: 8340 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8341 - DNA, 791 bp, Diabrotica virgifera
  misc_feature (332)..(377): n is a, c, g, or t
  misc_feature (460)..(483): n is a, c, g, or t
ggaattcaatgaccagttccatgcagctagccgaggaatgcgcaaagcaagattgtggagtgaatacgtcaaatccgatggaagcttatgaaggaattaaactctttgcccaaaccattgactcaattctaagtagagtgaaagtaaaatttattgatacagtatttcaaattgaacatgttccaaaacaaagcacaacaggagtgggcatagtcatcaacattgatttgattgaatactcagacgaagcaggcaacgatccctctacagaagaaaatctcgatcagaccaatcaagactcaaagaaagcttacgtcgtgcactcatacacnnnnnnnnnnnnnnnnnnnnnnnnnnnnnnnnnnnnnnnnnnnnnnttaaattttattgtaaaactaaagaaacagtttacttcctaggttgttgttgctgaactctagcattgtccctaccagggaannnnnnnnnnnnnnnnnnnnnnnntctcctatcctttttgcttctattacgcacaactttgctgtggatagcgcaggatacacagtagtggagcttcgcatagagcttggggagaacgtaagcttgatatactgatgcctcagtaatatctctcacagcggcggcttcaacaatgtttctgatgacgaacttcttgattgccttatccttgggaacgcatctagcacagttggtgcatcgaactggctttacgtgaccacggccgtgcttggagcgccctccattgcgccttttacatgtcatcttgacaccttttcttgactatcaagcgg

SEQ ID NO: 8342 - DNA, 948 bp, Diabrotica virgifera
  misc_feature (705)..(728): n is a, c, g, or t
  misc_feature (799)..(799): n is a, c, g, or t
  misc_feature (863)..(863): n is a, c, g, or t
  misc_feature (906)..(906): n is a, c, g, or t
cgtggttgtgcgtgttttagttgaaatgttcgctaaaattatgatggtaaactatttaacgctcgtggttgtattatttgtagtggcagacggacaattagatgaagaatttaaccagattataaaggaacttgatgatgagaccacgactgtacagccagagaccacgacgacgcctttgtctctagatccgtatcaaaataataaagatccttatgctgtgcctggtaatgtttccgttagttgtgattatcaatgtgtgccgttttatcaatgtaacaatggaacattggtaaccaatggggaaaatattattgatatcagatcgaaagaatcctgtggcaacgctttactttcttgctgtaaagacgagcacgtcacccatgacagatttacaccaacgccacctgaagttcccgtaccacagggatgtgggtatcgccgaacgaaaggtgtagggttcgaaattactggaactaaggacaatgaggctcagtacgccgaatttccatggatggtgtccatatataggctaccgaaagatgcgaattcaaggcctgtttgtggtggtgctctgatacatccacaggcagttattacagcggcgcattgttacaggataaaagacaaagatttgaaataggagcgggagagtgggacatcagtggaaaaatcaaaccatttccagtgcagctatcggaagtnnnnnnnnnnnnnnnnnnnnnnnnattctacgcaggcgcattgttcaacgacattgccttattaaaattaacaactcccattaatctttccgaanacatcgacaccatctgcctgccgtctcaaaacttagtccacaagcccaaaaaaagatgctactncacgggatggggcaaagataaagttggaaggcaaggagtctantagactattttgaaaaagatcgacttgcctgtggtactaaaa

SEQ ID NO: 8343 - DNA, 803 bp, Diabrotica virgifera
  misc_feature (23)..(51): n is a, c, g, or t
  misc_feature (77)..(94): n is a, c, g, or t
  misc_feature (100)..(129): n is a, c, g, or t
  misc_feature (218)..(235): n is a, c, g, or t
  misc_feature (253)..(279): n is a, c, g, or t
  misc_feature (448)..(467): n is a, c, g, or t
  misc_feature (658)..(677): n is a, c, g, or t
cgaaattaatatactttaaacannnnnnnnnnnnnnnnnnnnnnnnnnnnnctaattttactacttactgcttttcnnnnnnnnnnnnnnnnnnagtacnnnnnnnnnnnnnnnnnnnnnnnnnnnnnncacacaaacacattgaaaaatgccacaaatgattctgaacaataattatcggaaaaatttttaactaaatacgtattttctaaaaaacnnnnnnnnnnnnnnnnnncttacaatcataaaatgnnnnnnnnnnnnnnnnnnnnnnnnnnntttgtattggggttcgaacccgcttatgtttgcgctgttagtattggaattcattcatcttacacttctacccacggagacacctgcatcatgtgagaagatcgacgaactaaacggtttaaacttttcacagttctgaatttaaccaaattattttgatttttgcagnnnnnnnnnnnnnnnnnnnncaacaaaacatagagtaagaaaacaatatattaggtgaatattgacagaaattttgatggtaatcaaattatgtaaatgagagcattacatgctattttgatagtttcattttaaattttccaaataggtaggtacctatgtaattttattaggatactgtaacatttacaattattacgtacctgtcgcnnnnnnnnnnnnnnnnnnnngtcactacaattataaacttgcttttttctctgccatcacaacaataaaaactaatatacacaacatttgttgatccataatcttcaacaattattgacagatgattttaacacccaatacgatcc

SEQ ID NO: 8344 - DNA, 968 bp, Diabrotica virgifera
  misc_feature (628)..(643): n is a, c, g, or t
  misc_feature (645)..(657): n is a, c, g, or t
  misc_feature (836)..(836): n is a, c, g, or t
  misc_feature (857)..(857): n is a, c, g, or t
atactttattcactttaggaacggagcgtttggcttatgcacatcagtgttggttgccaaatacttcaggcacgtgttgctactagactgccgctatacaattcattttgtggcatcggcgcgcttctatcgtccataagaaatacgtagccctatctacgcaatgttccattcttaacgtgagacgctctatagttacaaatttgaaattgataatgtagtaaaactctttcacttcaatgtgtatgtacgcagtatcacgctacgcggagatactaactgccaagaataaaataatatttcgaaatcgagtgtgaaaggaaaataactattatttgagatatctgaagacaatcataatagagaacaggtgtaagactgtaaatttaatgaacaaaatctataccacaatgtaataaaaagtgttagaaacgagaggttatatggagaatacttcagaggtaattaaattatagatatgccagattcgaagagttataagtggactaaacacttctaatatcaatatggcggacaacctcaaaacgatcacagaaacagtcacactaataatgtgcgacactattttcatatatcttttgtacagataggaaatcacgtgtctttnnnnnnnnnnnnnnnngnnnnnnnnnnnnnattaagacagttgagatggtatcttagtggaatcaggacaaattaacggtacattcggcttcatcaagtaccccagttcccaattaattgcaccaaacatctttaaactcgttgatatatagagtgtaacaatgtagcaaccaatgtgtaacaataaaagttacctgctagatcagtgngtgccaattatttaacaatanaacgacacgtcggtcgtgtaactataaaactacacttgaggtgtcgtttcattgttcaccaattggtacccagtggtcgaggtggtagttgtactgttatattggttgcta

SEQ ID NO: 8345 - DNA, 114 bp, Diabrotica virgifera
  misc_feature (9)..(34): n is a, c, g, or t
  misc_feature (39)..(94): n is a, c, g, or t
  misc_feature (105)..(105): n is a, c, g, or t
ttttagtannnnnnnnnnnnnnnnnnnnnnnnnnatttnnnnnnnnnnnnnnnnnnnnnnnnnnnnnnnnnnnnnnnnnnnnnnnnnnnnnnnntttttttgatncaatttttt

SEQ ID NO: 8346 - DNA, 798 bp, Diabrotica virgifera
  misc_feature (48)..(48): n is a, c, g, or t
  misc_feature (163)..(184): n is a, c, g, or t
  misc_feature (345)..(402): n is a, c, g, or t
  misc_feature (428)..(447): n is a, c, g, or t
  misc_feature (456)..(485): n is a, c, g, or t
  misc_feature (557)..(571): n is a, c, g, or t
  misc_feature (573)..(591): n is a, c, g, or t
  misc_feature (593)..(608): n is a, c, g, or t
  misc_feature (610)..(623): n is a, c, g, or t
gttatttgtatgcaccttgttgtatcattggattattaagttaatagnttatatatgtgattattatatcaaattcaaaagagcatgaaatcttataattattattgtaaactacatagtttcatttcatttttttgtcatgcatacgtatattccactttgnnnnnnnnnnnnnnnnnnnnnnccaaattaaacttatttattagcaatatatttatccctctgtattgcttatagtattattattgaatatttttatgtatgaacttaataattgaattgtattattctttaatttttagatacaaatgaggattaccaattttcatatttcaaaatatgtcnnnnnnnnnnnnnnnnnnnnnnnnnnnnnnnnnnnnnnnnnnnnnnnnnnnnnnnnnncatttagatcatttaaatttagaagnnnnnnnnnnnnnnnnnnnngaaaagtgnnnnnnnnnnnnnnnnnnnnnnnnnnnnnngaggaattcgacaacatttttttcgcctgcctattaatcacatgtcttcttgtattctgtataaagtctctnnnnnnnnnnnnnnncnnnnnnnnnnnnnnnnnnnannnnnnnnnnnnnnnnannnnnnnnnnnnnnctttctattgaaagctggaatgcaggcttgtatgagcaacaaactgtctctattaaattgataccgaattttatttctatgttcgacagcttacatttttttagaagacgagaacaccctatagagctttataatcttattagtaagcatctttagtatcacatttatttatata

SEQ ID NO: 8347 - DNA, 788 bp, Diabrotica virgifera
  misc_feature (344)..(361): n is a, c, g, or t
  misc_feature (446)..(446): n is a, c, g, or t
  misc_feature (492)..(532): n is a, c, g, or t
  misc_feature (607)..(626): n is a, c, g, or t
  misc_feature (642)..(642): n is a, c, g, or t
  misc_feature (645)..(645): n is a, c, g, or t
aatgatcctatttattactatgaggtcccagctataatcaacaaccaggaatctcaagagccggactattatcaggtaccaatacccaaccaagaactcgcggcacccatagacaccgagtggaatcccaataatgatcctatttattactatgaggtcccagctataatcaacaaccaggaatcgcctacgagagagttccctaagaaatataacgaagatattcacgacaaaaagaagccttttgcgtcccagccaaaggttgagattattttcgaaccgatcagcaagcagcagtacgaagaaaaacaaatagaattaaccaaaaagtttgataaactcgnnnnnnnnnnnnnnnnnnagatcattcaggcacaacagactatttagattcgaagagcgagataaggaaggggtggtaaaaggtcactatggcttttacgacnaagaggggaagctgcaagtagtccactacgatgcccacccgcatannnnnnnnnnnnnnnnnnnnnnnnnnnnnnnnnnnnnnnnnagtagtcaaactttgatcagactgaattttagaatatcgatagataatttttaattgcagaatattacttatagnnnnnnnnnnnnnnnnnnnnggtggtattaatgtanggncgaataaatatacacttttgaggatttttgaagcgaagcttctatattgacgttgtattaattttctctatagttaaatgctgagtgatcgtcacgaaatagttaaaagagtccatttacgcgacgaggcaagtccgtagttt

SEQ ID NO: 8348 - DNA, 910 bp, Diabrotica virgifera
  misc_feature (877)..(877): n is a, c, g, or t
accaattatatgcatttttattatttaaaacatgtgtacataataaatgtttattctgtaaatatatgaacaagaaacatttgaatttagcaaatgtagttattattaaagatatatttcctagataaagaatatttcctagcctattcgtaatcaattcccttagttgaaaagacgattcgttaggttagacgaagtataggttcctgaactggtgcacatttaagaaatacgtcgcaatatccctggaaattatcacaaggagaacccggtcttaaactgatgcctccaggaggaagtcctactctatcggcaaactcactggtacttctgcaaatatcagtgccattttgacaagccaactcacacaactttctcttatcgatattgggatgatcttgtgttgtcaaagaacaagcttctaaattccattctaagcagatcgagccggagcattctcccttgatgcacaattgggttccattgttgcaccgagtcttatctgcgcgaggagtaggcacggggcattctgcgctggaaccgttacatttcgacgatcgggaacaatcggattccattttgcacacttcctgccgatacgaagatataaacttgcattcgccgctgcagcatggaccttggctaggactacattcagtgccagcacgtctcgtacacccaacggctgatctattaagttccttatcccttacactgataactctagggtagcaacattggtcgttgcattctttatcatcatacccgcaatcgcattcctctccggcttcacaattttattaccacagaaggcaccagcggaagcagtgaaacaatttcttttcttcttctcttcgatcgcgcccacgcgtccggncagggatcatgaagactttcattgtactatctt

SEQ ID NO: 8349 - DNA, 544 bp, Diabrotica virgifera
aaaagatttaagtataattgcacaatggtatttactacagcaattaactttataagatctcgtggaccggacgaaatatggagaaaacgtagaatttttaaacttgctgctcactttattggacgaagaaggaattgttatagcattgcaatcagaaatgtccacagagctctagtttatgctacaaaagggagaaaattaagaaaagaagacatggccagtttatgggaaatgaggataagagctggttgtgatcaacataatgtaagttacgaaactttcagagagggtctagtaagatctgatatattattgaatagaagaaccttggcagatctagcttgttgggaaccatactcatttaaagcgctgacagacattgctaaaagaagagctgtggatgatggtttagctggaataagtgcagatagctccctcgataggataattactagaggatgtatggtcaaacaaaagtagcttataaaagcgtgtgtagttaacaatatctttaagtttgtattttataataaataagttcaat

SEQ ID NO: 8350 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8351 - DNA, 124 bp, Diabrotica virgifera
ttatgacccaatgtcactggatgttagattaagatggccacagtgggaacatagaatatgatttttttagagatttagcatagtaattgacgacctatggttatttttgtgagattactgatag

SEQ ID NO: 8352 - DNA, 62 bp, Diabrotica virgifera
  misc_feature (6)..(59): n is a, c, g, or t
aaagcnnnnnnnnnnnnnnnnnnnnnnnnnnnnnnnnnnnnnnnnnnnnnnnnnnnnnntag

SEQ ID NO: 8353 - DNA, 237 bp, Diabrotica virgifera
  misc_feature (2)..(167): n is a, c, g, or t
  misc_feature (172)..(232): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnatttt

SEQ ID NO: 8354 - DNA, 493 bp, Diabrotica virgifera
  misc_feature (395)..(487): n is a, c, g, or t
cacgactcatcgaacagaacatttttatttgtgatgagagatgatcgcagagtgcgagtgatcagtatattaaatataattgccgtatacacttgtatttctctttgtgtcatttctattcgatagagatagagctataaatgatgagtaaaatacattagccgcttaattatatactcactaaaaaaagctccgtgccactgttattgttgtatatttggtgtttttggtcaatctattgtatgcacttgctatctaatctttaatacacctaagaattttactcacaacttaccgttatagaagatacatatgttttaaaaaaagaattctttacattctccaaatctcacagatctaatcgtgtccatagtcgtccatcagatcgtaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttt

SEQ ID NO: 8355 - DNA, 150 bp, Diabrotica virgifera
  misc_feature (7)..(37): n is a, c, g, or t
  misc_feature (39)..(79): n is a, c, g, or t
atagcgnnnnnnnnnnnnnnnnnnnnnnnnnnnnnnntnnnnnnnnnnnnnnnnnnnnnnnnnnnnnnnnnnnnnnnnngaataataaaggaattctaccagagttttttcgactgtgtgagtataacagggcttttggtatttccctct

SEQ ID NO: 8356 - DNA, 788 bp, Diabrotica virgifera
  misc_feature (191)..(217): n is a, c, g, or t
  misc_feature (579)..(579): n is a, c, g, or t
cagaccttctctcgcactactcttctttattggcgtcccaaggcgaattatcaacggcaatagcttacttaggaaactctaccaatgaaaaagtatcaacattacgcgatcgactgcaagtagcccttggagtaaagcaagttctcgcccaagatcctagacaaccgaatcgcagaggaagtcatcgcacnnnnnnnnnnnnnnnnnnnnnnnnnnnttttgcaaatacgaatccgtttcaaccaccacaaagtagttttggagcacctgctcagcctgcacctgtacccgcacctgttccaagttacaaccagttcaacacaggattgcctaatccatcaataaacaatcagccatggcaaccacaacccacgcagtgtttccctcaaccaccaaaggcgttttctccagcccctcaagcgccaccttctcatccgcctagacctaccagtgttgggtccaaccaaggtggctcaggtttaccatcgagaaaatacgtactggatccatcggtatcttcaaatccctacggctctcccccaaaccaatacgttccacctccaattcattccttccagncaaataacgccttccagtctaacccctacgcaccgccatccgtaaattcgtcgcagcttccaccactaaacaactcgtcgatgctaaatccagtcgaagttccctctaattccagtttcaatctaacaccgttggtgcctgcccaaacaagctacggaggatctaatctatcacttccacctacagacattgccccagaagcgactact

SEQ ID NO: 8357 - DNA, 620 bp, Diabrotica virgifera
  misc_feature (489)..(546): n is a, c, g, or t
  misc_feature (566)..(582): n is a, c, g, or t
tccttgggggccgcatacgcggcacatagcgataacagacaaaccccttttgaaacgcaaaggagaagagaaaagaagacaaaaagcagacaaacgaagaacgcgagaaaacaaaaggaacacaaaaagcgagaaaacacggaaagacgacggaaccacaaacggacggggacacgcaagaacgaccaaacccacaccaaggacaaaagagagaggcaaagcgaaaaaggaaccagaggaggcgcacaggagcaagcgaaaagggagaaaagggagaggcggcacaaagacaaagaggagaaaaaagagctacagaaggagaaaacaggggagaaagaggaaacaaacaaagagacagaaacgcccgaaggggcgaaagaaagtcagtatttgttatgactaccatgtctaatacgaataaagtacttagaagatgagaaagtgagagtatttatacatgaaatatattatgattgagtaaatagtgcnnnnnnnnnnnnnnnnnnnnnnnnnnnnnnnnnnnnnnnnnnnnnnnnnnnnnnnnnnagaacaaaaatatccacaannnnnnnnnnnnnnnnnatctaggacaatggattatgagaagagaaggaatattt

SEQ ID NO: 8358 - DNA, 492 bp, Diabrotica virgifera
tgtaaactgtaattttgcaagcgatactgctccagactgtcaaatagaattctatattgataccaatgttcttaaagtgaaaagaaataaaactcttgatcgtgataagggaagaaaaacatatccttgtctatttgagtgcttggataatcctttaaatgttcgatcccaaggacaaaataaagccaataaaagctttactataatattggatgatataaatgatcatgcacctgtgcttatgacgaaggacctacaatgttctgaaaatttgaataaggacggcgaagtaggagagggcataataggagaagatattcatgatggtgataatgctaaaatagatttttctgtgttaagtatcgttgataaggaaaccaaaaatgacattcaagaatcttttaatatttctaaaattgatagtgattatgtattgaacgatacattgaagaaagtgcatcttataaccttcgaaggtctcaaagggaaaat

SEQ ID NO: 8359 - DNA, 349 bp, Diabrotica virgifera
  misc_feature (24)..(24): n is a, c, g, or t
  misc_feature (27)..(28): n is a, c, g, or t
  misc_feature (66)..(66): n is a, c, g, or t
  misc_feature (71)..(71): n is a, c, g, or t
  misc_feature (77)..(77): n is a, c, g, or t
catcaggggccggaaaatataganggnnggaaagaataccctttgatttgaatgacgagaagaagnatttntttagnaatttatggtatagtaaaatagaagaaagaataggtactccctacctacaacgagttctcaaccaacaactcaccaaccacatcagagacaccctacccagtttgagagataaactacaaaagcaactgttacaattggagaaagatgtggaccagttcatacacttccgacctgacgatccctctatcaagactaaggggatgttacatatgatccagcaattgaaagtggtcttcgacagacctattgtaggatccgactttttttcttc

SEQ ID NO: 8360 - DNA, 451 bp, Diabrotica virgifera
  misc_feature (2)..(27): n is a, c, g, or t
  misc_feature (32)..(63): n is a, c, g, or t
  misc_feature (65)..(83): n is a, c, g, or t
  misc_feature (188)..(209): n is a, c, g, or t
  misc_feature (227)..(245): n is a, c, g, or t
  misc_feature (248)..(285): n is a, c, g, or t
  misc_feature (295)..(331): n is a, c, g, or t
gnnnnnnnnnnnnnnnnnnnnnnnnnnattgnnnnnnnnnnnnnnnnnnnnnnnnnnnnnnnngnnnnnnnnnnnnnnnnnnnccctgtttataaaaacatggcctttttgatttaaattaaaagcccgcctgccccctgattaatttaatgggccggggattttgaacggggttaaggagcattacnnnnnnnnnnnnnnnnnnnnnngtgggatggagggggtgnnnnnnnnnnnnnnnnnnngcnnnnnnnnnnnnnnnnnnnnnnnnnnnnnnnnnnnnnnataaaaaggnnnnnnnnnnnnnnnnnnnnnnnnnnnnnnnnnnnnnataaaaggttttataaaactaaattaaaacagtcttttttagcatataaacttatttttatacgaaaaaatttattttaatgggggggggatataaaaattaaattatacattttttttt

SEQ ID NO: 8361 - DNA, 497 bp, Diabrotica virgifera
  misc_feature (8)..(8): n is a, c, g, or t
  misc_feature (15)..(86): n is a, c, g, or t
  misc_feature (103)..(140): n is a, c, g, or t
  misc_feature (276)..(309): n is a, c, g, or t
  misc_feature (323)..(493): n is a, c, g, or t
gtgattanaaataannnnnnnnnnnnnnnnnnnnnnnnnnnnnnnnnnnnnnnnnnnnnnnnnnnnnnnnnnnnnnnnnnnnnnnnaccttagggataacagnnnnnnnnnnnnnnnnnnnnnnnnnnnnnnnnnnnnnnggcgacctccaatgttggataaagtttaataatgggggtagcagcaatattatttaagtctggttcaactttttaaaatttttccttgattcggagtttaaacccggggggggagcccgggggggggtttctattnnnnnnnnnnnnnnnnnnnnnnnnnnnnnnnnnncaaaagggggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 8362 - DNA, 129 bp, Diabrotica virgifera
  misc_feature (2)..(15): n is a, c, g, or t
  misc_feature (20)..(98): n is a, c, g, or t
  misc_feature (103)..(125): n is a, c, g, or t
gnnnnnnnnnnnnnnctggnnnnnnnnnnnnnnnnnnnnnnnnnnnnnnnnnnnnnnnnnnnnnnnnnnnnnnnnnnnnnnnnnnnnnnnnnnnnnnnaaagnnnnnnnnnnnnnnnnnnnnnnngttt

SEQ ID NO: 8363 - DNA, 216 bp, Diabrotica virgifera
  misc_feature (24)..(61): n is a, c, g, or t
  misc_feature (81)..(94): n is a, c, g, or t
  misc_feature (97)..(119): n is a, c, g, or t
  misc_feature (127)..(149): n is a, c, g, or t
  misc_feature (179)..(210): n is a, c, g, or t
ataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8364 - DNA, 78 bp, Diabrotica virgifera
  misc_feature (6)..(59): n is a, c, g, or t
aactcnnnnnnnnnnnnnnnnnnnnnnnnnnnnnnnnnnnnnnnnnnnnnnnnnnnnnntaagaaaaaattaccttta

SEQ ID NO: 8365 - DNA, 995 bp, Diabrotica virgifera
  misc_feature (2)..(993): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnca

SEQ ID NO: 8366 - DNA, 896 bp, Diabrotica virgifera
aataaacgtgactgactaatcgataatgctcgatgttgttttaatttttagtaaacctactaaaaacttgcggtctgccgcactgcttttacctggtttgatataatattttagttgaactggcaacgttgcctagaaataagaatgacatatgtgacaagaccaatttacacaactagaaaaacacgattttcggttataagacttgtaccagttttttttacgcgaagtgtaccaactcgatgttcgacgcttgagcgtacatttaccatcgtattaacctccctttaggtttactctaattctgaatcgtttcaggctacttgtcctgtcatatccatggacgagagtaacactactgctttgtttttctttagcaaataagagcatacggtagcatcatgattgtatgccagatttgtggaaaaacagccctttcctagattgctttcatattggtaagcaaaaatctcttattttttttttctaaatgagcccacgaacgtcatgtgacacgaattctagactttagcgagttcaaaactggtcaaaagttatctgtggtaacctttcgcccagaacctttataagacgtgaccagatccaaaactgttcgttttccaacgttaacttgtcgggaaccatattctgtttttcaaatataaagatgaatttgtatgggataaggtgtttgatgcattacaaatccaaaatacgatgtttagtgtgtttggaataatatattgtgtacattttgtaggtatggcctctaaacggaaacaattgttcatctatggttatgcattgggatggtttgtaagttttgttgcacattttctattcaacattgccccagatatctcgaatgagtgcagcccttatcagctttttttgcg

SEQ ID NO: 8367 - DNA, 156 bp, Diabrotica virgifera
  misc_feature (14)..(43): n is a, c, g, or t
  misc_feature (48)..(85): n is a, c, g, or t
  misc_feature (90)..(152): n is a, c, g, or t
aaccctatagaggnnnnnnnnnnnnnnnnnnnnnnnnnnnnnnagcannnnnnnnnnnnnnnnnnnnnnnnnnnnnnnnnnnnnntgggnnnnnnnnnnnnnnnnnnnnnnnnnnnnnnnnnnnnnnnnnnnnnnnnnnnnnnnnnnnnnnncccc

SEQ ID NO: 8368 - DNA, 1055 bp, Diabrotica virgifera
  misc_feature (854)..(867): n is a, c, g, or t
  misc_feature (869)..(881): n is a, c, g, or t
gttaagtccgttattggagcattctctagtgactcgatctataaggaattaaagatcttcgatattttcagccatgatcgcggtgtcgtctgcgtatctgatgttgttaatagtttctccccgattcgaactccacattgtccttccaaggcttcattaaaaattatttctgagtatacgttaaacaaagttgaggataacacacaaccctgtctgacacctctttgaatgcaaattttgtctgtttcttctccgtctaccagaatagaagcttcttgattccaatattgatgttgtaaaagtctcagatctttatcatctattccaatcatttctagatattcaaacaatccttctctgaaaccgaattgtttgtttcccattgtctcttcacatgtgtgattgattctattaagaattatcttaagaagtagcttgagagagtggctcatgagactaattagtctttacatgatgatgtattaggtttttttgggagtggaataaatgtagactctaatcatatctgtggcatcatttcagtctcgtatatatggttataaatgtttgttagttgtgagacattgtcgtcatccagaagtttgagccagtctgatggtatttggtcggggcctggagatttcccatttttgctgtttgatggctttctctacttccgcttttaaaatactaggaccagtattcgtatactttgtggtgttgcctcgtatccaggaagaacccttttatatagttagtccattcttccttttttttcatccaggtcgagaattttttttaccttttagagtttcttctacagtgagggagtccttttcctctgagtggaaggnnnnnnnnnnnnnncnnnnnnnnnnnnntaaacctcgccctggtttcctttggtaattcttccatttacacaaacatctttggttctctcccgtctcccttttttgctcccctataacctctcgaactctaattttggcgaaaaaaatcctccccctaatcccgaaacttcccgtcttttgtcttttccccactttcctctc

SEQ ID NO: 8369 - DNA, 259 bp, Diabrotica virgifera
  misc_feature (2)..(17): n is a, c, g, or t
  misc_feature (148)..(171): n is a, c, g, or t
  misc_feature (198)..(248): n is a, c, g, or t
cnnnnnnnnnnnnnnnngaaataatttaccttagggataacggcggaatttttatgggaaaagttcaatcgaaaaaaaaagatggcgacctccatggtggattaaagtttataatggggggaacggctttttttttaattcggtcccnnnnnnnnnnnnnnnnnnnnnnnngtttaaaaccggggggggggccagggnnnnnnnnnnnnnnnnnnnnnnnnnnnnnnnnnnnnnnnnnnnnnnnnnnnaggggacacac

SEQ ID NO: 8370 - DNA, 221 bp, Diabrotica virgifera
  misc_feature (14)..(81): n is a, c, g, or t
  misc_feature (87)..(150): n is a, c, g, or t
  misc_feature (166)..(189): n is a, c, g, or t
gaccctataaaggnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnngccccaattctttttnnnnnnnnnnnnnnnnnnnnnnnnccttcgggggaaaacccgcggaaatttttttt

SEQ ID NO: 8371 - DNA, 761 bp, Diabrotica virgifera
  misc_feature (667)..(667): n is a, c, g, or t
gtacttttatttaccctcggtaccttgacagtttttggtgcgtagattcgatttttcgagggtaacaggctaaaaacatgaagagttcatcgttcatagtgaccaatagaaagctacagaaataaaaattacagcgataatttttgataatatcccgtcgtcaagcattactacagatgcccttcgttaccacgcaaaaattaacattcagtgatattaatgacaattaaagttttacaacttagattattcgttgaatgtttaaacaatgtttttgcaattttaatgaatgtgccaagcactcaattttcccattttttcaggaattttaagtgaaaaacgttgactggctcgagaagtatcgtttttaataacaaaaatgtgattatataggacttttgtgcaagtttcctttaacgttctaatcccaacgtatacctatcttgctgcaaaaacacgcttacgtcattcaagatttctgacgtcggagcgttgccaaaacattagaatgtgacttttcatcatggccatgtttattgtgcagtgagaaggtaggcatcattacttgtcagagatatttttcttcagatataaacaatctcgtgctatagaccttttcattcacagtcatttgtttcgagcttctgtcatgtgtcacataatattnaatatattgcgacatacgttattggtatatatactccatctaatttacttaccgttgcacgtcatccgcgtcatagccccgagacgtcacatga

SEQ ID NO: 8372 - DNA, 729 bp, Diabrotica virgifera
  misc_feature (31)..(52): n is a, c, g, or t
gaacgaatctctttgttttttataatctacnnnnnnnnnnnnnnnnnnnnnntgttagatgcatggtttttaaggtagtcgcagggatccgtccgaaagggtgtcgtttttcagtgaaaatggccaattttcaaccacgaatggctcaggaagtgttgagttttcaaaaaatagttatagaacaggttttgcttagggataggatctctagtctcttccgtggctattttgaccaaaacatttttcaccccgagaaggggtgggaaccgcccccaagatggaagcgcacgtcggcatggggtagactttgtttcttgagctattccctacttactgtgaaaatatcaagtaaatcgatgtagtaggatggaattcggagccaaataccctcattgactgccctaatagtatcggtgcaatttatgagttatagtgagctaggctgctactttttggccttattgtatttattgttggtaacaagcttcagctcactatgatttctttagcagcatctctttaacaagcagattatttttttgagatcagtgtatttcagattgagtgttttctttattcagttttattgtacttaattttaagattacattttttgtttccaattgttagttgtccaggtttttccttattaattatttacgagatacaagtaaaatacaaatgagaaagacattacagtcgcaagaaagaagttatagtataaatata

SEQ ID NO: 8373 - DNA, 460 bp, Diabrotica virgifera
  misc_feature (2)..(168): n is a, c, g, or t
  misc_feature (170)..(230): n is a, c, g, or t
  misc_feature (232)..(249): n is a, c, g, or t
  misc_feature (387)..(405): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnncnnnnnnnnnnnnnnnnnntaaaattaccttagggataacaggggaatttttattggagaggtcaaatccataaataaaaattggcgacccccatggttggaattaaaggtttaaattttgggggaacagacttaatttatttaaattctggttccnnnnnnnnnnnnnnnnnnnctttggattttggaggtttaaaacccggggggggggagcccaggggtgggggttt

SEQ ID NO: 8374 - DNA, 139 bp, Diabrotica virgifera
  misc_feature (5)..(48): n is a, c, g, or t
  misc_feature (54)..(54): n is a, c, g, or t
  misc_feature (64)..(137): n is a, c, g, or t
cgtannnnnnnnnnnnnnnnnnnnnnnnnnnnnnnnnnnnnnnnnnnngctggnaatgaggggnnnnnnnnnnnnnnnnnnnnnnnnnnnnnnnnnnnnnnnnnnnnnnnnnnnnnnnnnnnnnnnnnnnnnnnnnncg

SEQ ID NO: 8375 - DNA, 738 bp, Diabrotica virgifera
  misc_feature (209)..(209): n is a, c, g, or t
tgaaaattgtgataaatgcgaaaacagcagagaactcaaaatgaataaactaggctgtaaatggcaaacgttgtctgggaaattctttatggttactggtgctaatataagctgtgcatgcagccgaagtccaaagggcatagctccgtttagtcatttaggggatgggatggtacacttggtgttggttaagcatacttccgtattanataatgtcagattactattgaggttgtccagcaacgatccttctatcgaagatttgccccttcgtggagactttatgcgcgcgagaatttgttttagggctattgaagggaatagcaaatggaactgtgatggagaagtacagcaccaaattaatatacgtgcaaaggtacgatgtcaattgctcaccatattcagcaggggaaggccaagagattgttctgttgacccaacttgctgtggattctaagcgttttatattttttaccgtgaccatacatctcgtaacgcgacagttcgtaacagcacaaatggtaacggcggcagttcgaaccgcgacagttcgtaactatacaaattcgtaacgtcaacatttcatttttttttagcaatttagtattatggaatttttacaaaaattcttttgcatacattcctacactaaaagtaatggtacttatttaagaccacttctttttaaacattatatttcccacatatttttgcatatattcttgttaatatgacaac

SEQ ID NO: 8376 - DNA, 1234 bp, Diabrotica virgifera
  misc_feature (42)..(59): n is a, c, g, or t
  misc_feature (84)..(104): n is a, c, g, or t
  misc_feature (164)..(182): n is a, c, g, or t
  misc_feature (300)..(319): n is a, c, g, or t
  misc_feature (342)..(373): n is a, c, g, or t
  misc_feature (401)..(417): n is a, c, g, or t
  misc_feature (419)..(445): n is a, c, g, or t
  misc_feature (447)..(474): n is a, c, g, or t
  misc_feature (549)..(566): n is a, c, g, or t
  misc_feature (605)..(618): n is a, c, g, or t
  misc_feature (621)..(637): n is a, c, g, or t
  misc_feature (652)..(738): n is a, c, g, or t
  misc_feature (996)..(1014): n is a, c, g, or t
  misc_feature (1044)..(1065): n is a, c, g, or t
tttattcattttaacataatacgaccttttttcagtgaaagnnnnnnnnnnnnnnnnnncactgatagctaattagtattcgcnnnnnnnnnnnnnnnnnnnnncgtagaaaaatttattcttacgtacctcgtgcatcagggattattacctaagaagcaccnnnnnnnnnnnnnnnnnnncaaaagagctaaacaattaccatctttatcgtacaatacatatcttaactaatcccttctgtaatgaaatggtattcgcttttccatatatctaattttttccgagataaatcaaacnnnnnnnnnnnnnnnnnnnncataactaaacattcttatgtcnnnnnnnnnnnnnnnnnnnnnnnnnnnnnnnncaaacaacattttattagaatttaatcnnnnnnnnnnnnnnnnncnnnnnnnnnnnnnnnnnnnnnnnnnnncnnnnnnnnnnnnnnnnnnnnnnnnnnnngtttattttctataaattttctattcaaatataaatccaaattatttaaattccgcaatgacgatactatcaggnnnnnnnnnnnnnnnnnncagtaaaaatacataggcttagtaaaggaattccggcgnnnnnnnnnnnnnnccnnnnnnnnnnnnnnnnncctttttcgcttacnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttcaccggcacgaccgggtgccccccctccaccccccccccctgctttcctacccctccctcccccaacccaacccccccacgcctcttcatccccctcccccccccctacagctcctcagatctattctctcccttctgcggctccccccccccctcttcacccgcttcatttgacccccccggccccccctcccccccccacctcctccacccctcccctctcacacccccgcccccgcgcccccctctccannnnnnnnnnnnnnnnnnnggtccccccccccgccaccccccctcgccnnnnnnnnnnnnnnnnnnnnnngcctctccccccacctccccccccccaactccagccccctccccccctcagtcctccctcttctccccccccttccactcctctccccctcccccctcctcccctccctcccatcccccccccccttcccccaaccccctcccctgctcatgctcccctcctcctccct

SEQ ID NO: 8377 - DNA, 377 bp, Diabrotica virgifera
  misc_feature (3)..(94): n is a, c, g, or t
  misc_feature (137)..(156): n is a, c, g, or t
  misc_feature (233)..(252): n is a, c, g, or t
  misc_feature (305)..(354): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaggggataacagcggaatttttatttggagaggtccaaannnnnnnnnnnnnnnnnnnnaacccccgatgtgtgggatttaaaggttttttaattgggggggaaacagcttaatttatttataactctggttccgnnnnnnnnnnnnnnnnnnnnttgaattttgtgagttttaaaaacccgggggggggagcccccggggtgggtgnnnnnnnnnnnnnnnnnnnnnnnnnnnnnnnnnnnnnnnnnnnnnnnnnntatacaaaaaaggggcgaccccc

SEQ ID NO: 8378 - DNA, 1047 bp, Diabrotica virgifera
  misc_feature (84)..(101): n is a, c, g, or t
cgtaaaacttatctatattacgtatatacaacagtcaatgcaaaaatcatcccacgcgtccgctcaacttatttattagatgtnnnnnnnnnnnnnnnnnngtaagatattaatttatatgatgccaatcttgttggcaacatctagagcatcataatctctagctaaccttacatatgccttctttttgccatcgggcctaattaaggtgttgaccttggctacattgatatcatacaatttcttaactgcagctttaatgtggtgcttgtttgccctagtgtgtactaaaaataccaacgtgttgttatcttcaatcttcttcatggctgcttcggtggtcaatgggaatttgatgatattgtaagcatccatgcgggatctgtggggaacactcctcttggggtatttgggactcctgggtggtctgagggtcttaggacgacggaagtggactgagttacggattttccttgagtgtgttccattggggcctttaattactttcttttggattttaagtgctctcgctacttgcactgcactggcagctggctttttgccaacacctttctggtgttgtttaacaggaacattcttcttgggcttagcaataagagttgcgggagccttggcctttccagcagcagctgggttctttcctgcagccttggctgcggggttggcagcaccttttgctgcagcctttccagctttaacagcagcggcttttggttggggggagcagcttggctttcccggagcttttggtgaggcagttttaggggcgggggagggggtttttgagaaaaaagcttctttgcacttggttgcttggagtttggctgctgttttggagctgggcgggggggtttttaaattgagaaaaaactcccgggggctcccgctgttgggggggccggtccaaaagaacccagtttaacgaccccgggatggaacgccataattcttcataaggggcccctaaaatcattccctgggccggcgttttaaaagaccgggacgggaaaaacccggggggtaccc

SEQ ID NO: 8379 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8380 - DNA, 940 bp, Diabrotica virgifera
  misc_feature (454)..(477): n is a, c, g, or t
  misc_feature (777)..(777): n is a, c, g, or t
  misc_feature (782)..(799): n is a, c, g, or t
cttttcctgagccctctctacaggccatacttcaccaccatacaccaacgcaggcatcaccacactattgtatatctgtcttttcagtcctttatggatatatcctgctcattcgcttccaattaaaccaaccagcctgtatccggtaggtaatttctcgatatagtgtcccatgatccgtcctgtaggagccaaggtgtacgataacttgtacataggtgggattgtgaataaaatcttgggattggactgtatgagggattgctagtttactggtttaagtgggagtatacaggttttatacagacaatattgatatgtagataagagccttaccaagttgtgaagccttgttgacacaccagatcgactagagccgatcacacacgaattgactgttctctctaaagaaaagatctttacttgattgtaaagaagatcgtaaaggtcacannnnnnnnnnnnnnnnnnnnnnnngacatgtgaaaattgaacacaaggtatttaaattttcctactcctcctaggtttccccaaagaaattagatgttcaaatcaatttctgttgctctaaaccaccacttcaatagtccttctcctatatctcctaggatctgtactactattatactcctcgaatttaagtacgtgttaaccccccctccccaacttctccaatatttctttcctttctgcctctcctcctttatccgggcttggtactccactgagctcaatcaacctagtaactaccagaagaggagattttataatttnctggnnnnnnnnnnnnnnnnnnctcttcttctatttatgtaaacattactctattagtttcttcatgtgctttcagtaaagtgtcgttccatcggtttttgtggtcttcccactaatcgtcttctattgaggaaccgtctctcgctgtcattgctactctatt

SEQ ID NO: 8381 - DNA, 536 bp, Diabrotica virgifera
  misc_feature (43)..(61): n is a, c, g, or t
  misc_feature (68)..(105): n is a, c, g, or t
  misc_feature (122)..(165): n is a, c, g, or t
  misc_feature (167)..(248): n is a, c, g, or t
  misc_feature (259)..(330): n is a, c, g, or t
  misc_feature (337)..(362): n is a, c, g, or t
  misc_feature (370)..(415): n is a, c, g, or t
  misc_feature (417)..(450): n is a, c, g, or t
  misc_feature (455)..(486): n is a, c, g, or t
  misc_feature (492)..(531): n is a, c, g, or t
ggggggggccgcccccccccacccccaaaaaatggggggagannnnnnnnnnnnnnnnnnnctccctnnnnnnnnnnnnnnnnnnnnnnnnnnnnnnnnnnnnnngcggcgggggggggtannnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnngggggggggannnnnnnnnnnnnnnnnnnnnnnnnnnnnnnnnnnnnnnnnnnnnnnnnnnnnnnnnnnnnnnnnnnnnnnngggtgannnnnnnnnnnnnnnnnnnnnnnnnnaccccccnnnnnnnnnnnnnnnnnnnnnnnnnnnnnnnnnnnnnnnnnnnnnncnnnnnnnnnnnnnnnnnnnnnnnnnnnnnnnnnnacttnnnnnnnnnnnnnnnnnnnnnnnnnnnnnnnntccccnnnnnnnnnnnnnnnnnnnnnnnnnnnnnnnnnnnnnnnnccccc

SEQ ID NO: 8382 - DNA, 645 bp, Diabrotica virgifera
  misc_feature (586)..(607): n is a, c, g, or t
  misc_feature (625)..(643): n is a, c, g, or t
ataaaagacaactaggccttgactccttcttttctaaaaaacctaaggtaagttcgataaacatattcatttagttaacactgtcttcattgcattggcttactgttaaaacttactcctgaaattcctagatcatgttgttttacgctgtttaggtctactataggttcaagcgagagcttaagtaatagatttcttgtattttatttctggatttataactgatcatattgaggatttcgaacttattactgctaatgcatttacatactaaaaagcgtaatgaagtgtttttatagcaagtttattcgaaattaatgagcctagttttattaaagatattcctgtgtacctatgtctctgattctttttaggcaagtttctggcaattttccacaatcacaatagataactagattctcctaaatattggaccctgtggcagtaggcctagttattaaagtttaatagtttgctgaataaatatatgtacaccgaattacagaatatacatttctgaaggttttatcaattaggataaataaaacacagttcagagaggtaaaattattagttaggcgtaaannnnnnnnnnnnnnnnnnnnnngtttgcactaaaagctgnnnnnnnnnnnnnnnnnnncg

SEQ ID NO: 8383 - DNA, 131 bp, Diabrotica virgifera
  misc_feature (11)..(39): n is a, c, g, or t
  misc_feature (46)..(88): n is a, c, g, or t
cattatttagnnnnnnnnnnnnnnnnnnnnnnnnnnnnncaaaagnnnnnnnnnnnnnnnnnnnnnnnnnnnnnnnnnnnnnnnnnnngaaccttgtttgcacctggttattaaaaacatggctcttttta

SEQ ID NO: 8384 - DNA, 845 bp, Diabrotica virgifera
  misc_feature (467)..(498): n is a, c, g, or t
cgaaatgttggaactgataaacatcactgcctttttgtaatagttaagaattagatttttaagtgtttaaacataatgaaagatattgctttggctgctctctcggttgtcgcaagttttattcttgttatactgtttgttttatttggatggtttattgtctggaagctcattctaagtagattccgttttattaaagaactgttgaagggagcaagtgactctacaattacggaattgaaaaacactaggagtaaactcaagaggacaagaaaggactgatttatcttctcaaaatgaatattcgatgtgcaaaaccagaagatcttatgaacatgcagcactgcaatctgttatgtctaccagaaaactatcagatgaaatattacttttatcatggccttagttggccccaactaagttatgtagctgaagacgaaaaaggtaacatagttggttatgtcctnnnnnnnnnnnnnnnnnnnnnnnnnnnnnnnnagcatggtcacataacctccctggcagtgaagcgatcccacaggcgattagggctagcccagaaactgatggatcaagcttcagaagccatggtcgaatgttttgacgcaaaatatgtttcgctgcatgttcgtaaaagcaatcgcgccgctttaaatctatacaaaaactctttgaaatttgaaactgtcgaaattgagccaatattatgcagatggtgaagatgcatattccatgagacgagacttatctgaattcgctaagaaagttaaacctaagtctgagactaaaaacgaagaatagtgtaattatttgtaatttttgtatttatagcgaatataatatac

SEQ ID NO: 8385 - DNA, 1361 bp, Diabrotica virgifera
  misc_feature (2)..(38): n is a, c, g, or t
  misc_feature (42)..(73): n is a, c, g, or t
  misc_feature (82)..(82): n is a, c, g, or t
  misc_feature (88)..(88): n is a, c, g, or t
  misc_feature (95)..(144): n is a, c, g, or t
  misc_feature (168)..(202): n is a, c, g, or t
  misc_feature (223)..(287): n is a, c, g, or t
  misc_feature (304)..(448): n is a, c, g, or t
  misc_feature (450)..(678): n is a, c, g, or t
  misc_feature (686)..(707): n is a, c, g, or t
  misc_feature (716)..(736): n is a, c, g, or t
  misc_feature (762)..(788): n is a, c, g, or t
  misc_feature (797)..(818): n is a, c, g, or t
  misc_feature (821)..(877): n is a, c, g, or t
  misc_feature (916)..(954): n is a, c, g, or t
  misc_feature (958)..(1053): n is a, c, g, or t
  misc_feature (1066)..(1092): n is a, c, g, or t
  misc_feature (1102)..(1119): n is a, c, g, or t
  misc_feature (1134)..(1152): n is a, c, g, or t
  misc_feature (1154)..(1190): n is a, c, g, or t
  misc_feature (1192)..(1334): n is a, c, g, or t
cnnnnnnnnnnnnnnnnnnnnnnnnnnnnnnnnnnnnnggtnnnnnnnnnnnnnnnnnnnnnnnnnnnnnnnnataagtaantttagnattgggnnnnnnnnnnnnnnnnnnnnnnnnnnnnnnnnnnnnnnnnnnnnnnnnnnaactttgggggtttccgggggatnnnnnnnnnnnnnnnnnnnnnnnnnnnnnnnnnnncccgaaatttaaaaaagaccnnnnnnnnnnnnnnnnnnnnnnnnnnnnnnnnnnnnnnnnnnnnnnnnnnnnnnnnnnnnnnnnnggaaaggggttttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttgnnnnnnnnnnnnnnnnnnnnnntgtttttgnnnnnnnnnnnnnnnnnnnnngggggtgggaaagaggagggggggcnnnnnnnnnnnnnnnnnnnnnnnnnnncccgcgcgnnnnnnnnnnnnnnnnnnnnnncgnnnnnnnnnnnnnnnnnnnnnnnnnnnnnnnnnnnnnnnnnnnnnnnnnnnnnnnnntatataggggggggggcgggtttttttttccgccgcccnnnnnnnnnnnnnnnnnnnnnnnnnnnnnnnnnnnnnnnggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaaagggtnnnnnnnnnnnnnnnnnnnnnnnnnnnggcagcaagnnnnnnnnnnnnnnnnnngccgcggtgtttaannnnnnnnnnnnnnnnnnngnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcctccgccgtcgccccccccccc

SEQ ID NO: 8386 - DNA, 89 bp, Diabrotica virgifera
  misc_feature (87)..(87): n is a, c, g, or t
tgacaaaacatcacaacaggaattttcactcctgacaactagtgataccgagtgagactgtgaagtgactttgtactttctggtcgntc

SEQ ID NO: 8387 - DNA, 379 bp, Diabrotica virgifera
  misc_feature (20)..(20): n is a, c, g, or t
  misc_feature (28)..(29): n is a, c, g, or t
  misc_feature (36)..(36): n is a, c, g, or t
  misc_feature (39)..(39): n is a, c, g, or t
tccttacgcggccgggaagnctttttgnngtgaccnggncaacttcttatcacgttttgaacatattcagtaacatttaatttctagaatcggttgtttgtgtgaatcaactcttactcaatggcattgggaagagtatactttttctagttggagtctacttttactagtaataggtctggttcccgcatatgaaaaaaagttgattaatagcaagctgaaaatttgttaatagcttaagggtgtctagtcggacaaactttgatatatgggaactctgagacaggggaagttttaattgtggagcaagaaagaaatatggagcggatatagcatcaagatgtttcgtgacttttgttccactgaacttctcattgat

SEQ ID NO: 8388 - DNA, 218 bp, Diabrotica virgifera
  misc_feature (2)..(87): n is a, c, g, or t
  misc_feature (95)..(152): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnggggtggnnnnnnnnnnnnnnnnnnnnnnnnnnnnnnnnnnnnnnnnnnnnnnnnnnnnnnnnnngaccccaattctttttaattattacaaacaaatctcacctcaggcaaaacgggggaattttttttc

SEQ ID NO: 8389 - DNA, 942 bp, Diabrotica virgifera
  misc_feature (121)..(157): n is a, c, g, or t
  misc_feature (207)..(240): n is a, c, g, or t
  misc_feature (504)..(516): n is a, c, g, or t
  misc_feature (519)..(531): n is a, c, g, or t
  misc_feature (623)..(650): n is a, c, g, or t
  misc_feature (908)..(908): n is a, c, g, or t
cggacgcgtggggtaattttttcagttgtaattgtagtttctaacataattattgttagaacaacactaactaatgtcctctcttaatttgattacttctggtaagtacctacacctaccnnnnnnnnnnnnnnnnnnnnnnnnnnnnnnnnnnnnnttattaccattctatatttatctttatactggtaatagtcagtataatgnnnnnnnnnnnnnnnnnnnnnnnnnnnnnnnnnnttaatagtgaaaaaagattgaacactttaataaaataactttatgaaatgcatccacaggataatagccatttcttaattattaccacttattaggcagactatgcaactatgcactatatcaggcaatgatactattgtccttttcatgatcatttttcagtgcataacaaatgataggaaaaagggtaagtccgtgataatgcacatttatgacatttattctaacatgacattttagttaaatctgacagttgtcacattnnnnnnnnnnnnnggnnnnnnnnnnnnncaaatgtgtttcttgcatttataaaatggtattttctttgatttgtatagtcttataaattatacagcttatattcgtaatattattatctnnnnnnnnnnnnnnnnnnnnnnnnnnnnggcgccttctatcgacaactagaataaatagaataaatgctataaaaatgtcaccgacgaaatgtaatcaccgacgtgcctttttttctgtcacatacaatttaatgcgttagaaagaaatcgaaaaactgtgacgcactgaaagatgatcatgagaaatactgtacacatcaatgtacgtttcacttttatgtttgaataactaataataattacctaataagaattactaactttaaatttaataatgatgtatgngcaaagataaaatggaaacactatatagaccatt

SEQ ID NO: 8390 - DNA, 676 bp, Diabrotica virgifera
tgatcagttggaccatctaatcagcgatccattcgaagttcctttttactgtgtcgagatccttgtctgttactgtaaaaaggaacttcgaatggatcgctgatcagttggaccatctaatccctcccaacaaccatctggtggtcattatcatgggcagccctgcagataaagatcattgcaacaaaatcaagcagcagtgcgaagatctaggtcttaatgtagaaataagagtagcttcagctcacaaaactactgattttgctcttgaactagtgagttattatgaaggtatgaacattcctcttattttcatcgctgtagctggacgatcaaacggtttgggtccagtgatctctggaaacacagattatcccgttattaactgcccacctggatcaagagatgatttgtcgagggatatttggtctagtgttaatgtaccttcaggtttgggatgtagtacagtcatctacccagaaactgcagctctttgtgcagccactaacatcgccatgactaactatattgtctggagcagactgtgtcttagaaggctgggatatttcgagtcgttgccaaaagccgataaggcaatgagaagttaattttaaggtttttgttttgatatctttattacgttaaatttttacttttgaatatattcttttgtagt

SEQ ID NO: 8391 - DNA, 239 bp, Diabrotica virgifera
  misc_feature (28)..(46): n is a, c, g, or t
gtttgaaatatacttatttagaagcatnnnnnnnnnnnnnnnnnnnaaaacacaaaactataaaacacaagaaaagagaaaaacatcctatgtgtaaaagtaaatcaaaatggcctaataattggtcatgaaaataccgaacaagctaatggaatatcacattaaacacgagagaatatattgataggatgaaaaaaggagaaagcatcaaacatcgatcacggaaaagccgtatcaag

SEQ ID NO: 8392 - DNA, 334 bp, Diabrotica virgifera
  misc_feature (134)..(134): n is a, c, g, or t
gccagggcccctttacgcgctccggagattactacaagcaagcgagaggccccctttcgagcacaggacgcacagtacttagtgaaaaagtcctcgaagaaactacgagggaacggcggtaggatcttctccanacccagaatagaaagatatatgggcgggtgaagaaaaaaaatcatttccttgacacgcccgccacaaatagtcgcaggccaagggaggacaacagaaaatgagcatgttggcccgccctccacaaagcggccccagaccgccctaaagacagagcgctctgcccccctattttgggaagatatcacactctcgggggggg

SEQ ID NO: 8393 - DNA, 685 bp, Diabrotica virgifera
cccccctaaaggggccggatgagctaaaaaacaaaactctatgacacttttcgttggaatacaacaccagagattgatacctgtgagatcgtggaatgtgccagtcttcataatagatatatgcctcagaaccagtccacatgagaggctccttaggtaacagagtatgccatgacccactagaggagagaaccggacagaactggatcaacgaacacctcatcacagctatgcagcaggctggaacatatctccgaaaagccgcccctgtgactcggcagctgaagtcattgatatctggagctcgacacggtcgtaatagctgtagccacagatgggattgaacatctctcctgatgattgcatcatcggcgaccccagaaaaccgatcccacaacaagaacacgtgacctacgccaatcttacgaataaacggagacggaaactatgggtcgcttctgtcctgaagatagactacaagacattgttcgcctcctgaaagagggccaatactgggatcatcctcttattccaccggtcaggacgaccacaccatggagctcatattttagacttacataagattcgacaggactttgattaactcagtgtgcgcgctctggatgaatatgtgacacatccttctccttcctactaacatacagagaaaatggggttactttca

SEQ ID NO: 8394 - DNA, 323 bp, Diabrotica virgifera
  misc_feature (2)..(68): n is a, c, g, or t
  misc_feature (71)..(163): n is a, c, g, or t
gnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttaggggaaaacagcggaaattttatttgggaaaggttccaaaccggaataataaaaaaatgggcgaccccctcaagggtgggatttaaaaggtttaataaattgggggggaaaccaagcttaaattaaattaaaggcccgggtttcccactttttt

SEQ ID NO: 8395 - DNA, 947 bp, Diabrotica virgifera
  misc_feature (857)..(857): n is a, c, g, or t
  misc_feature (889)..(889): n is a, c, g, or t
gttttcgctacctgttgatcgctactgtttcctcttatggatattttcttaaatgtgacagttgtcaaaactaggaaactggttgcaattaaacagaaataatctacttaaaattatccccactgtaataatgtacagtagaaaatcaccgctgtaataataatctgattggacaaaattaaacacgtgatgaaaaatattactacacgattggaagttaaaaccgttaaaaaataatcgctgtaatttttatccttgtaggtttctattggtcagaatctctatgaatgaaataatcaaggctatttatcatcacgctgctacagtgccattctgttctgttccttgtttggattttaaaagttggcaaccccaacttctcagcatcctgttttattccgtctattcacatcagctctggtataccccgtcttctcattcccacaggttgcgttgaaagaaacttttttatcatgttcgattccggggcccgggatacatgtcatgtccactgcagatggtttcacttaataaaagtggtattatcttttccaacaaacttatgcttgtggatattatgcagtttctaagttacagattccgtttccacagaccgttctgaaatcttgcgtagtacatttttttttagaatcaatagagaggattcgtctgttttggttagggtccatgcctctgatctatatgtgaaagcgggtgccatcagtgttctatacagtcttatacgaagttttttggcacagacatttgttagctaagtactttagaccaccgtaacacctacatattaagtaattatgatttgcctttttatttcccctgatgtgtaaataattggnggttaaccaatgtctctagatatataaactcngtgacccactttcgaagtttttggttcttgacaattagatatgcatcaacatttccag

SEQ ID NO: 8396 - DNA, 711 bp, Diabrotica virgifera
  misc_feature (176)..(192): n is a, c, g, or t
  misc_feature (194)..(206): n is a, c, g, or t
  misc_feature (662)..(676): n is a, c, g, or t
ccttacgcgtccgttgagagtaagaactggatggtccaaggctcggggtctgtatgacgccgaggggcgcttttgccatgggggtggttgccgccccatcttgggggtggaaattttttattgtgttttgaccgcaaaagttggtaaggacattcattttgagcagaaaatgttcnnnnnnnnnnnnnnnnngnnnnnnnnnnnnncgatttgttcactgtcgagagtgttagttttgtatcgagggaatcaatggttttcgatattatactcatttacgattctctcaattgtggtcgtaaaaggattttgtttaaagatctattcttgtaaattatatatcctgtctttactgattaaaacagtttctcgtatcactatttgcacgtcaatctatttagatccacgcggagtgttgttaaagatgaaaggaaaaccattatcgggtcttcaagatagactctataaacttattgatgcaagatgaactaatgtcaatgaaggagtgaccagaagtaccggagcattttctgagtttatgggtagacctgattttacctatggaatattcaaactacactatgatgatgatttattttttgaagccagaaaactagaaacaatttatccatctattgatcttatcgctaaacgatggtgannnnnnnnnnnnnnncatattcgtctattgctgagtcccttctggatatc

SEQ ID NO: 8397 - DNA, 281 bp, Diabrotica virgifera
  misc_feature (2)..(137): n is a, c, g, or t
  misc_feature (139)..(158): n is a, c, g, or t
  misc_feature (160)..(278): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaa

SEQ ID NO: 8398 - DNA, 957 bp, Diabrotica virgifera
  misc_feature (902)..(902): n is a, c, g, or t
cactagaagactataacgatgaacttcctattttcgagaaagaatcatacacaacagaaataaatgagactgttgcgaacggcactcaaatactatacacccatgcaacagacagagatgcagaagatttcgaactgaaaatgaatatagttggaacttatgctgagaataggctaagtattgataaagatggaaatattaaagtaaaggtagtcaatgccttcgattacgatgtcttaaattctgtgtatttccaagtaaccgcaacagataaggttaatcatgtgactagagtaccagtaacgattaacattttggatgttaataataaagctcccgtaataaatcaagtggaccatatacaaatcgaagaaaaccaacaaaacggtgtagtgctaaatgtaacaataacagctacggatgtagataccacggctaatctgactgctactataaattgggaagattccaaagttaccaaaactaatggtgctgtagtaaaaactgacgctgtaataaaagctatgcaatttttagagatagaaaatacacaaacagatgacggtctggaaatgaaactaaaggtaataaataataatgacgataatccagacaaaccagattttgaaactttcgatacattgtatttaagtatagttgttgaagaccgtaatactgatcctgattttgaacagaatcgatatacagaaggtcaaattgtcatcaatatccttgatgttaacgataatccaccatattttccaccttctaatgatgacactcgacaggtccaggaaatgtctctgaaaggagtatcggttggctccataaaggctgtcgatgttgatttgaattcagaaattacctaccattgcacgcccgaatatgaaaagtttgactgngtcgatgtaaatcttacaactggcgccataactggaaagaacgataaacaagttg

SEQ ID NO: 8399 - DNA, 462 bp, Diabrotica virgifera
  misc_feature (15)..(15): n is a, c, g, or t
  misc_feature (22)..(44): n is a, c, g, or t
  misc_feature (49)..(258): n is a, c, g, or t
  misc_feature (264)..(296): n is a, c, g, or t
  misc_feature (298)..(337): n is a, c, g, or t
  misc_feature (339)..(354): n is a, c, g, or t
  misc_feature (364)..(385): n is a, c, g, or t
  misc_feature (387)..(402): n is a, c, g, or t
cccttacgcgcccgnttattcnnnnnnnnnnnnnnnnnnnnnnnttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtnnnnnnnnnnnnnnnnnnnnnnnnnnnnnnnnncnnnnnnnnnnnnnnnnnnnnnnnnnnnnnnnnnnnnnnnncnnnnnnnnnnnnnnnnctattcactnnnnnnnnnnnnnnnnnnnnnncnnnnnnnnnnnnnnnnctttagtttctaaataataattaggcgtataacatattcatattctacaatatgcactta

SEQ ID NO: 8400 - DNA, 84 bp, Diabrotica virgifera
  misc_feature (4)..(41): n is a, c, g, or t
cagnnnnnnnnnnnnnnnnnnnnnnnnnnnnnnnnnnnnnntgcgacctcgatgttggattaaaggtaatttattcttataatc

SEQ ID NO: 8401 - DNA, 792 bp, Diabrotica virgifera
  misc_feature (358)..(384): n is a, c, g, or t
  misc_feature (492)..(517): n is a, c, g, or t
  misc_feature (609)..(626): n is a, c, g, or t
  misc_feature (719)..(719): n is a, c, g, or t
cttggaatacaaaaagcagcgaattggaaagggataatgccaatacaaaaaactggacaaattaactgcaaggaaaagaaagtgcaaggaccataaggaaacgacaaggcaagaaataggtaatgacaatggcaaacaggataagaaaaatatttggagactagcaacgtggaatatcagaggactaaatggtaaagaaacagaattgagctacgagttcgataaaaacaaaatagaaatattaggtattacagaaacaaaaaagaaaggaattggtgaaatatacctagaaggcggtcatttgcttatatatagcggggttccaccggaaaagagagcagctgcaggagtaggtacnnnnnnnnnnnnnnnnnnnnnnnnnnntatacaggactggaaaggctggtcagaaagaatagtcgctcttgagatgaaagatgaacagggagagccacagacaataattacggcatatggacccgatgaaaatgnnnnnnnnnnnnnnnnnnnnnnnnnntggacagacctaaatatagcaatagaaaacagtaaagggcggatttacgtcattggagacttcaacggaagagtaggaatcaaagatgagannnnnnnnnnnnnnnnnngaaggtacggtgaagaagtgagaaatgataatggaaaacggttaatagaattctgcgtactaaataatttaatagtaacaaatacacactacncacacaaagacatacataaatttactaggcaaggaccaagagaatcagaaaagtcaataattgattacatact

SEQ ID NO: 8402 - DNA, 958 bp, Diabrotica virgifera
  misc_feature (35)..(49): n is a, c, g, or t
  misc_feature (62)..(79): n is a, c, g, or t
  misc_feature (81)..(97): n is a, c, g, or t
  misc_feature (152)..(169): n is a, c, g, or t
  misc_feature (171)..(196): n is a, c, g, or t
  misc_feature (236)..(253): n is a, c, g, or t
  misc_feature (293)..(307): n is a, c, g, or t
  misc_feature (320)..(337): n is a, c, g, or t
  misc_feature (339)..(364): n is a, c, g, or t
  misc_feature (404)..(421): n is a, c, g, or t
  misc_feature (461)..(475): n is a, c, g, or t
  misc_feature (496)..(521): n is a, c, g, or t
  misc_feature (561)..(578): n is a, c, g, or t
  misc_feature (580)..(605): n is a, c, g, or t
  misc_feature (645)..(662): n is a, c, g, or t
  misc_feature (729)..(746): n is a, c, g, or t
  misc_feature (796)..(813): n is a, c, g, or t
  misc_feature (919)..(919): n is a, c, g, or t
agaatgtatatagttgtaagcagtttagtggagcnnnnnnnnnnnnnnnacatttgagagtnnnnnnnnnnnnnnnnnngnnnnnnnnnnnnnnnnngtttaagcagttttctcaaaatggtgatttgaaaacacatttgagagtgcacacnnnnnnnnnnnnnnnnnngnnnnnnnnnnnnnnnnnnnnnnnnnngtttagtgaagcatgttctttgaaaacacatttgagaatnnnnnnnnnnnnnnnnnngtacaaatgtgaaatttgttgtaagcagtttagggaagcnnnnnnnnnnnnnnnacattttagagtnnnnnnnnnnnnnnnnnngnnnnnnnnnnnnnnnnnnnnnnnnnngtttagtgaaacatgttctttgaaaacacatttgagagtnnnnnnnnnnnnnnnnnngtacaagtgtgtaatttgttttaagcagtttagtggagcnnnnnnnnnnnnnnnacatttgagaatgcacaccgnnnnnnnnnnnnnnnnnnnnnnnnnngttttctcaaaatggtgatttgaaaacacatttgagagtnnnnnnnnnnnnnnnnnngnnnnnnnnnnnnnnnnnnnnnnnnnngtttagtgaagcatgttctttgaaaacacatttgagagtnnnnnnnnnnnnnnnnnngtacaaatatgaaatttgtttcaagtcttttattacaacaagtaatttaaaaacacatttgagatcnnnnnnnnnnnnnnnnnntcacaggtgtgaaatttgtttgacgcagtttacccagaaaattcatttgnnnnnnnnnnnnnnnnnncacactgataaaagaacttataagtgtgatgtttgtttttaagatacactggaacagatagtctgaatagccacaccaattgcacactggggaagtgcacatgtgncaaatttgttctaagcattttagtactgcgagtaattta

SEQ ID NO: 8403 - DNA, 468 bp, Diabrotica virgifera
ccttacgcggccgggaacacccgcaggaacaccgccgaggcttttacaagccgcaagccacaacggaagcagagacaaaggaaaacgagggaaaacgacaaaacacaaagcacgacccaacggcgcagcgcggaaaagccccaacgagaacggagccccacgcacaccacgcagagcaaacatgcaaaacacaaaggaggagccatcgccaacgacgcagcaaaacgaacaaacaggcgcaccaaaagcgagaccaggccgagagagcaggcgagaccactacacggaagcaaaactgagaaagaacgaagaagacaaaagataaggctggtcgataagccgaaacgtgaactaccatcgaacgctaattgatgcccctgaactgacagatatcgttataaacatgcacaacgagacctcgcaagctgactgcgatgtactcactgtgaacgctggtaatgatgaatc

SEQ ID NO: 8404 - DNA, 493 bp, Diabrotica virgifera
gatagatactggttcctccagcaccaccatcgtgtggaccaacatgttgaaggtctctcctaccaccaccagttagagtgtggatagaatcatttactggctcactatctgaaagtaggaccaagtatgtggcatctacaggacattcccgcgataagacctgcatagagagccgctttaaagcgacacctctaagagtagataaggagactttagtttattcactgtttatctttaatactctcatttaaaggattatttactgatgatacatgacttaacgcgacaaatacttatttaaactacgaccatagtagaggatagaatagtgatctatttacatgtatgatctagacgactgcgtcgaatgatatataagattatttattgaaaaatatcatactacgaacaagagagagatcaatattgaactctgacataaatgtggtaatagtgagagaattataccgatatgcttgtcgagtagtgtttt

SEQ ID NO: 8405 - DNA, 897 bp, Diabrotica virgifera
  misc_feature (586)..(604): n is a, c, g, or t
  misc_feature (768)..(805): n is a, c, g, or t
  misc_feature (810)..(839): n is a, c, g, or t
  misc_feature (854)..(892): n is a, c, g, or t
gtttttttcttcattctaaattatctgtgattagtaatgtaattgagtttactctactacatacagtattgtaagtgtgaactataatcttccattaatgtagcattccacaccaagtgacctagacaggagacaagaggtgatatatctactttttatgcaattatatcaaggtcgttctgaagtcctagatagagataggcaacaaacgactatcacctatctgtgtctctcttcaagagtacatagtagtgaagttcgtcacttcaccatttctgttttagcactgatttgtacttaaatggtttcttattaaccctccgttactcgcacacggtgtatgagaccgggcctctaaataactgcctgtaactctgattgtagtgcatatttttcattgctgctgcatataccctcttcagtcatcagtcaactgtgtgtgaagtcccagtgcagtggtaaaaaagagtattgtacttttattattaggcaagacctattaattagtcaggtaattaaaagtagtaagttttaattagtcaggtaatttaagggctttttcttatttttaaatgttatatatttnnnnnnnnnnnnnnnnnnntgggattacgagaagaagaagtagaggttgacgaaaaaaggaagatgatgaggaaaagaagaagaataaatggccaagaaatggataagatcttgtatatactgaatgaatggaacctcagaatctccataaaaaataaaaaccaagtattaccaataatctcnnnnnnnnnnnnnnnnnnnnnnnnnnnnnnnnnnnnnntttcnnnnnnnnnnnnnnnnnnnnnnnnnnnnnntgactggaatattgnnnnnnnnnnnnnnnnnnnnnnnnnnnnnnnnnnnnnnnaggtt

SEQ ID NO: 8406 - DNA, 634 bp, Diabrotica virgifera
gacctcggggttgattggggtcgtagcctgtagatcaacgtatagcctggagtggagcaggaaggtcttggaaggttaggtactggtagaggtacaggatcaatagaaactggcggttgtggttgcattcgcgtgcaaggttgttgtatatattgatagtattcccaaatatttctgtattgaggccaattaggtatgtatataggtctttgaggatttgcagagcacggtcgtggtggtatgattataactggtcttggattcggtggaggtggcggttccggatatggaaaataagacaaaacccgtgatgatatttcaattgaaagtgataaaaactgttcttggattcggtggtggcggtattggtcggtgcgtaggttctggtggatatataattacagttggtccttttgtagtcggttctggattctgtggtggcgttggtggtgtatatactataacaattggtctttctgtagacggtgctggataaggttttggttcaactggaagtattccccaccaaatattcctagaccgagagacgaagggaggactattctggttctatttccgcagcctcatctaattccctcaggtggtgataataccatcattaacaccatgattt

SEQ ID NO: 8407 - DNA, 994 bp, Diabrotica virgifera
  misc_feature (194)..(211): n is a, c, g, or t
  misc_feature (258)..(275): n is a, c, g, or t
  misc_feature (438)..(451): n is a, c, g, or t
  misc_feature (453)..(496): n is a, c, g, or t
  misc_feature (498)..(519): n is a, c, g, or t
  misc_feature (761)..(808): n is a, c, g, or t
  misc_feature (817)..(837): n is a, c, g, or t
  misc_feature (847)..(868): n is a, c, g, or t
  misc_feature (870)..(887): n is a, c, g, or t
  misc_feature (897)..(918): n is a, c, g, or t
  misc_feature (936)..(952): n is a, c, g, or t
  misc_feature (954)..(983): n is a, c, g, or t
atcatggtggagcaagaggttatggtggttttggagaaggaggaccctgttcacttggagcatggttattaatgacgagagagagattaatttatttctatgagaaaacaatttattgtatcgtggcgtgtgcgtcaggctaattaaaaaagaaacatggtttctattatttccgaacaaatctgacatatagnnnnnnnnnnnnnnnnnnagaaataaatatgataaataattttttggtaatgaaatcttattcgnnnnnnnnnnnnnnnnnntgttaaagatgaaaattatttatatgtatttaccatatatttacaattataaatttgtatattataaatattagaaattattaggtatgagcttaaataattactatatatcaggtttaaatttttagtaagatattatgtttacatattttcatatatgacnnnnnnnnnnnnnncnnnnnnnnnnnnnnnnnnnnnnnnnnnnnnnnnnnnnnnnnnnngnnnnnnnnnnnnnnnnnnnnnngtttacaaatgcagataatattagtattatataatactgtatatatattagtattatataggtttaacacaggtattccgacccagttttttcacctgtgtattatatccgtgtctttttgtactagacagcccgtctcgcctgcccactgtctaattagaatgaccgcgctattctgatcgtgctaaagtatcattatccattactatttttattgaaagctgtaatgaaggctggtgtgnnnnnnnnnnnnnnnnnnnnnnnnnnnnnnnnnnnnnnnnnnnnnnnnaaaaaagcnnnnnnnnnnnnnnnnnnnnnaaagaccccnnnnnnnnnnnnnnnnnnnnnncnnnnnnnnnnnnnnnnnnaatttacttnnnnnnnnnnnnnnnnnnnnnngggtgaaaaacacacaannnnnnnnnnnnnnnnngnnnnnnnnnnnnnnnnnnnnnnnnnnnnnnccaattttttt

SEQ ID NO: 8408 - DNA, 167 bp, Diabrotica virgifera
  misc_feature (3)..(53): n is a, c, g, or t
  misc_feature (59)..(125): n is a, c, g, or t
  misc_feature (127)..(148): n is a, c, g, or t
ggnnnnnnnnnnnnnnnnnnnnnnnnnnnnnnnnnnnnnnnnnnnnnnnnnnnggggtnnnnnnnnnnnnnnnnnnnnnnnnnnnnnnnnnnnnnnnnnnnnnnnnnnnnnnnnnnnnnnnnnnntnnnnnnnnnnnnnnnnnnnnnnagaataatattacccttaa

SEQ ID NO: 8409 - DNA, 845 bp, Diabrotica virgifera
  misc_feature (636)..(653): n is a, c, g, or t
ctgtactactgtaaactgtaacgttgaataactgttcgcgtgtggttggtgatttttggtaaccagaaaattgcataagttgagtaaatacaggaaatatttaatccactaccaacgcgcttaatcgcttaatccagtaaagagcatttaagagacttctgtctccaagcaagcagacagaaaacacgaagtataaggtagttcgtgaatgaattaggtatgctgcaattagttctcatagccgtagtaatagtactcttctattactgtgcaatcagaccaatgaagtactggaaagagcgaggagtgatacaaggtagaccaatatggctcttcggtgataattggagagccttttttaggttagaaacatttggacaaccataccatacagcatataaactagacccagatgctagatatgttggattttatcagttcactgttccaactctgatgataagagacccagaactgttaaaacaaatcactgtaaaagacagcgactacttcaccaatcaccgagcaattgtaccagacgaaggagatccattatggacaaataatttactcggcttaaaagaccaaaaatggaaggatatgagacacatattgactccgtctttcaccagcagnnnnnnnnnnnnnnnnnncactttgatggtagaatgtgccgaaaatttcgttacgcatttcctcaaaaaaaaccaggatgttttttgatgtctccataaaagatgtgaccactcgtttgccaaatgacgtcgttgcttcaactgcgtttggtatccgaacggattcacttgaggaacaaataacgagttttatttgatgggtaagacatg

SEQ ID NO: 8410 - DNA, 101 bp, Diabrotica virgifera
  misc_feature (89)..(89): n is a, c, g, or t
gtgtattgtatatttttgggcatcaatatctccttgtcttttcatctttcagtttcattggtcgtgttgaagttaaatcacgactgcancaaaaacagact

SEQ ID NO: 8411 - DNA, 849 bp, Diabrotica virgifera
  misc_feature (709)..(709): n is a, c, g, or t
aataaaaaacagatgcgacacattttttattaatgcacaaatacggtaggtaacatttaaattgtatacatgtgtattaacattattttaaatggtaacttgctacaaaaaatatggcctatgttttgttgaaacttttgatcctggagcgattttaacaaataaacatatatgcaaccaacaatgttgacaaaatggaactccatatttcagaacgagataataatcaattaccttgatgaagagatcagcagtatgatagatagtttagtctacagtatgtctcaactaaatcacattaggtatatcaccgcaacaaagttagctccgtgatactagagtcattcgtgaaaaaaggaaccctataccgttgagaaagattgcgacttctaggaaaaatctggcaacactgccctacacatcaactattcctctctcgtaccacataaccttcgcctcattccattactcagtgtcggcctagcagcctttgaagatggagttcacggtcacaaatgcaaaatggatttcacctgttggcaatcatcttaaacataaacctctagaaacctaacaaaacgccctggtttcgactccaacaagaaatcaaaacaaagtgtaatgaaaaacaagaagccaacttaaagaacagatcacaacaagcaccagaagcttacaataactacaaaagaataagaaacgagactanagcattagtaaagaagaccaaagacgaaatactggcgggttttctcatcaaaaatggaagccgactactagggactgcaaagcaaatatggagatttattttgacacagaagaaagaaataagcgattaacagaaaccac

SEQ ID NO: 8412 - DNA, 680 bp, Diabrotica virgifera
ctgcatacggtatagatattgcaccatttatccacgcacttctattcctgaactagaaggaccgtgccccctaaacaatacagctgcaatcagcctacctctgccaaactttcctacgcattgaagcgccctgcaacggctgtattgcctcctacaaagacgattccagacctacgttagtagacctaggtgaccccgaccacgggctgcctgcttgtgtatctcgtctccacgattgggctgttctctctcaaacacttctcagaaccgaatgccgacaaaattgaagattcgatgtagttgaacaactgattcgcttgtggatgaacaacctcttcaatgccacgaacgatcagatgaatcgtacgcaacgacgatgatgacgatggctctttctgcatgtacgtcttagatatcgtctaaaaaattcttgactgcatcgtgaacttacctcgagacaaatatgactaccttcttccatgattggacattgtcacagaacatgaaaacctcgacgactagggaactcacttatagtgcgcttctatgcgcaacagtatgccagctgtcagaaatgttagtgcagatcataagcattctcttagcctctcctgtggaaccttccaaatatataatgcatgctgtgtacactggagctcatgcatatgacattcgactgt

SEQ ID NO: 8413 - DNA, 99 bp, Diabrotica virgifera
aaaaaccaacgatatgttcagatgggcaatattttcccgggacctgccactttaccattcatagcaaatgctaacttaacaatgggaaaatctagatcg

SEQ ID NO: 8414 - DNA, 885 bp, Diabrotica virgifera
  misc_feature (156)..(173): n is a, c, g, or t
  misc_feature (509)..(524): n is a, c, g, or t
  misc_feature (818)..(818): n is a, c, g, or t
gattattaaagtttatgtatgaattaaaattaagaaggaattaagggaataattttatcaggttatctaagtttactttcagatttgaagttgcgtattttcataggaatatattatttgttcaatgtctactgagtgcatatgctcagtataatnnnnnnnnnnnnnnnnnnttgattattacattaatatcctttgattcattctaaatatattacaagaatctaaaatggacgatgtctcaaaaattgttatccaacctttacgggaatctatttatttgaaaccctatactatgcattttgtccagaatggcactaaaagaacctgggacttactaacagtacatgacagtgtagccataattttattcaacgtttcaagaaacgttttaatccttgtgaaacaatttaggcctgctgtttattatggaagcattccagaaaaagatagaattatgggagaggagctcgacactaagaaatacccaccagagttaggtattacgnnnnnnnnnnnnnnnngaattatagacaagaacaaatccgaagcagagatagccaaggaggaggttttagaggaatgtgggtatgatgtccctgtttctagcatgcaaaaaataggatcttatagatctggcgtaggcacttctgccagtctacaaactgccttctactgtgaagttactgacgatatgaaagtttcatctggggggaggagttgatgacgagatcattgacgttgtggaaatgactgttgaagaaatgaagaagtatgttactcagaattatataaaaagtcctcctagttttatgttntgtatggaattggtttttatataacaaacaaagtgatgttaccatgatattagataatttatgaatt

SEQ ID NO: 8415 - DNA, 101 bp, Diabrotica virgifera
  misc_feature (4)..(100): n is a, c, g, or t
ccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8416 - DNA, 106 bp, Diabrotica virgifera
  misc_feature (3)..(47): n is a, c, g, or t
  misc_feature (54)..(105): n is a, c, g, or t
gcnnnnnnnnnnnnnnnnnnnnnnnnnnnnnnnnnnnnnnnnnnnnnattattnnnnnnnnnnnnnnnnnnnnnnnnnnnnnnnnnnnnnnnnnnnnnnnnnnnng

SEQ ID NO: 8417 - DNA, 112 bp, Diabrotica virgifera
  misc_feature (6)..(7): n is a, c, g, or t
  misc_feature (12)..(89): n is a, c, g, or t
  misc_feature (98)..(98): n is a, c, g, or t
  misc_feature (106)..(107): n is a, c, g, or t
taattnnttttnnnnnnnnnnnnnnnnnnnnnnnnnnnnnnnnnnnnnnnnnnnnnnnnnnnnnnnnnnnnnnnnnnnnnnnnnnnnnntaattattnaatttggnngtgat

SEQ ID NO: 8418 - DNA, 1212 bp, Diabrotica virgifera
  misc_feature (108)..(122): n is a, c, g, or t
  misc_feature (124)..(144): n is a, c, g, or t
  misc_feature (678)..(678): n is a, c, g, or t
  misc_feature (729)..(729): n is a, c, g, or t
  misc_feature (742)..(742): n is a, c, g, or t
  misc_feature (808)..(808): n is a, c, g, or t
  misc_feature (1112)..(1134): n is a, c, g, or t
  misc_feature (1144)..(1206): n is a, c, g, or t
agttaaacatagaattaaaggtgaagcagggagccgaaaatatgatacaaagcatcacaggaagagataaaaaattattattagaagctcaacaaatgctacaagacnnnnnnnnnnnnnnngnnnnnnnnnnnnnnnnnnnnncaaagttaaaacatgacatcgattcgaaatcgcggggttccattcaggatttgacggacaatggagacctgtcgcacggagaattggatccacttttagatgatagaatagaagatttaaaacacagacttagagtcgaagcagctgtggttgaaggtgccaaaaatgttattaaacttttacaaaataataataaggacaagagtgagaaaaaagccctcatagaggcacaggaaagtttgagagccagtagtatgaaacttgatcttttaaagaaatctttggaaattaggaaatcggaattgcctgaggattctccggtcgcaatacatttaaaagaagaactagcaaatgctcaagcatttagtccaacgacgatgcattataccagtctacagccattcagggaaggatcggagaacagcaggcatttgacttctttttctatgctcagcaggtgtgcagctgttaccggtactttagaggtacgattaatgggatgtcaagaccttctggaggaagtacctgggcggnctaagaaagaatccgacgttccttcgagcccgatggaatttagctttttcnaaaaaacgaaaangtacagcgtcaaagaagaagtcagcgacgatatcatgggcggtggttaaacttgacaataccaccngtaggtcagacgagctggaggccgtgttcgcaacaggcgtggggatcagaagttttcgatcgaactagaacaatccaggggaactgggaatcgatatttattgggagggataacggatccctctggggcagccaagtttttaaaggtcgaggatttcctaaacgacgaaggggatgggatgggattggcatttggaacccaaaaggattattttttggcaaaaataaaatttttgaacccctatgaatttcaaaaaagggccccaaaagcccaaaaagggcaaaaaaagggtttcttggccccnnnnnnnnnnnnnnnnnnnnnnngggttttgtnnnnnnnnnnnnnnnnnnnnnnnnnnnnnnnnnnnnnnnnnnnnnnnnnnnnnnnnnnnnnnncaaaag

SEQ ID NO: 8419 - DNA, 885 bp, Diabrotica virgifera
  misc_feature (120)..(156): n is a, c, g, or t
  misc_feature (402)..(423): n is a, c, g, or t
  misc_feature (461)..(480): n is a, c, g, or t
  misc_feature (762)..(792): n is a, c, g, or t
  misc_feature (808)..(808): n is a, c, g, or t
  misc_feature (849)..(849): n is a, c, g, or t
ggcctagaaatcaaaaatgtttttgtagatagtatgttttcagattaatttggttaaacacgactcttgtgaccagctagatattttcctgcactagtctatggccaagttcgactagannnnnnnnnnnnnnnnnnnnnnnnnnnnnnnnnnnnnccatgacatttcgtaacccgacagtttgtaacccgacaaatggtaacggactattcgtaacgccatcatatcgtaacggcgagagtttgtaactatacaattcgtaacggtataattcgtaacgacaacctttaatttttttagaaagtttagtattactgaatttatacaaagatgcattttgcatacattcctaaactagaagtaatggtactttatttgagaccacttgataatatgacaacnnnnnnnnnnnnnnnnnnnnnnatcttgaattatcactttaaaatagtaaaactaagtgnnnnnnnnnnnnnnnnnnnncagtttaatagtaatgtatttactataataagtaatacaatttacattactatactaaatttacaatcaagattcagtagaatttaacaaaccatgacacactagatgctactgggagcgctcccgagtcataatttacagtgtatatacattgtaaatcccaaatcatggtttccaaagtttatacattgtaaattattattcgggagtgctcctagtatcatttggtgtttcttggtttgtttacttatactgcatcttgagtgtaaatttagtatagcnnnnnnnnnnnnnnnnnnnnnnnnnnnnnnntttatttatccacganatacgaaatgtgtcaaaaattttgatcctgatgctggtttngtaatttataaacgtatggtcgcgttggaaggggag

SEQ ID NO: 8420 - DNA, 682 bp, Diabrotica virgifera
  misc_feature (38)..(61): n is a, c, g, or t
  misc_feature (99)..(120): n is a, c, g, or t
  misc_feature (130)..(144): n is a, c, g, or t
  misc_feature (146)..(162): n is a, c, g, or t
  misc_feature (405)..(511): n is a, c, g, or t
cccaggcgtccgtgtttagttaattgccaggatggtcnnnnnnnnnnnnnnnnnnnnnnnnggaaggaaggtatctgcatgtcctcttgtgatctaggnnnnnnnnnnnnnnnnnnnnnntaacccactnnnnnnnnnnnnnnntnnnnnnnnnnnnnnnnntcatgatattccaactccccgtgttttatcgtcgatttgtaaaatcgccaaaatactttctaatgtgatgacatgaggctgtacttccatcgtatcttgtgagatacacacacatctaaacaaatcacaaatacctctgcaaaaaattaattacccattatttatattacacatagcaagacaagaattagatatgcaagtaactaacataattggattttgacttagacagtagatttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgatgtattacaatgaaatgtcgctctgataataatatagatctgaggataaataagtaattcgaaaatatttgttgaagatgcttattaaaaattagacctagtgtacatataagaaggacaacatgcccccctatttacttttagcttgtgtacttggaactgag

SEQ ID NO: 8421 - DNA, 466 bp, Diabrotica virgifera
  misc_feature (186)..(206): n is a, c, g, or t
cactgatgtagactattagtatgtaactttccgatctatttatagtctacatcagtggttctcaacttgtggtatatgtaccaccggtggtacatatgataattttgtggtacattactcaaaatggttgagaaccactgatgtagactattagttagtaatactttagttaccatatccagttcnnnnnnnnnnnnnnnnnnnnncggaaagttacatattaatagtttacatcagaggttctgagcgcgtggtatcggcaccgctgataggtcatatgataagtgcatatgttatccatacaattataactcagtctgcttagattattaatatatacctatattttctagttctgctaaagataatttacaatagttagtaatacttagaaaatataaaagaatgtgaattttcatgatatactaagatgatagtatctattgcagatattatagataatatc

SEQ ID NO: 8422 - DNA, 996 bp, Diabrotica virgifera
  misc_feature (210)..(225): n is a, c, g, or t
  misc_feature (227)..(243): n is a, c, g, or t
  misc_feature (410)..(438): n is a, c, g, or t
  misc_feature (449)..(478): n is a, c, g, or t
  misc_feature (480)..(500): n is a, c, g, or t
  misc_feature (514)..(554): n is a, c, g, or t
  misc_feature (556)..(610): n is a, c, g, or t
  misc_feature (612)..(627): n is a, c, g, or t
  misc_feature (629)..(646): n is a, c, g, or t
  misc_feature (665)..(725): n is a, c, g, or t
  misc_feature (734)..(803): n is a, c, g, or t
  misc_feature (805)..(840): n is a, c, g, or t
  misc_feature (846)..(923): n is a, c, g, or t
  misc_feature (925)..(942): n is a, c, g, or t
caaaaaatgttattatcataatgcaaaaaacttactattatgaaccttgcgtatctcggataatgaaatactagataactatgaattaatgtcaaatatcataaagattttcaatgaacaatcttatcgtatgataaatatcttagataatctattatgtaatgaaatgatattcggttaccatatatcatacctctgtatgaaataaannnnnnnnnnnnnnnngnnnnnnnnnnnnnnnnngaatatctttgatattattactatatactatatttttacgtatgacctcataactacaaatttattaagaatcaactcctagataccaattatgactaataattttcatattttacaatatgctattatttattcctagatatgactatctttattgtttataaatnnnnnnnnnnnnnnnnnnnnnnnnnnnnncaaatttagcnnnnnnnnnnnnnnnnnnnnnnnnnnnnnncnnnnnnnnnnnnnnnnnnnnngtttaataaaggtnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnncnnnnnnnnnnnnnnnnannnnnnnnnnnnnnnnnnattttatttgaagctgggnnnnnnnnnnnnnnnnnnnnnnnnnnnnnnnnnnnnnnnnnnnnnnnnnnnnnnnnnnnnngcaaaaaannnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnncctaaggggataacaagccgaaatttttattgggaaaaggtcaaaaaacaataa

SEQ ID NO: 8423 - DNA, 252 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(249): n is a, c, g, or t
  misc_feature (251)..(251): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannnnnnnnngna

SEQ ID NO: 8424 - DNA, 1185 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(844): n is a, c, g, or t
  misc_feature (853)..(933): n is a, c, g, or t
  misc_feature (935)..(963): n is a, c, g, or t
  misc_feature (978)..(1100): n is a, c, g, or t
  misc_feature (1114)..(1178): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnctcatcccnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnncgaataacattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggaaaacccnnnnnnnnnnnnnnnnnnnnnnnnnnnnnnnnnnnnnnnnnnnnnnnnnnnnnnnnnnnnnnnnnctccccc

SEQ ID NO: 8425 - DNA, 199 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8426 - DNA, 205 bp, Diabrotica virgifera
  misc_feature (7)..(39): n is a, c, g, or t
  misc_feature (42)..(120): n is a, c, g, or t
  misc_feature (125)..(199): n is a, c, g, or t
taatcannnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnntgataa

SEQ ID NO: 8427 - DNA, 691 bp, Diabrotica virgifera
  misc_feature (11)..(30): n is a, c, g, or t
  misc_feature (130)..(143): n is a, c, g, or t
  misc_feature (145)..(165): n is a, c, g, or t
  misc_feature (625)..(657): n is a, c, g, or t
  misc_feature (659)..(675): n is a, c, g, or t
cccctctccgnnnnnnnnnnnnnnnnnnnnttgttaggttaagaaacttaggatcttatttactgataggtaataaacattgagatgagaatatgttatttttatggacaaaatgtatgttttgtccccnnnnnnnnnnnnnngnnnnnnnnnnnnnnnnnnnnncatcattttcgacttcaaaagagctacaaatctcaaaatctatattgcccccacatactttcgttcacttctacgtgacgtcatgtcttgcttacttaaatatatctaactttgtacgaattaaattaaatatattcattatccatatatgtattattaaatattcttatattactaatattaagaattcgtagggatgagctaaaagatcgaatttattaccacctagtttttcaagagaaattaggattcataattttcatattctaaaatatggtattatgtagtgtcatatattagtattttgatgtcctacaaagtttttatcaacatattaaattatgttatgtaaatatagcaatgatcgataatatgaatgttaaaaaattcgcatatctagcacagatatataggtgtaatattggaattcggcaaccttttcttcacctgttaatatacnnnnnnnnnnnnnnnnnnnnnnnnnnnnnnnnngnnnnnnnnnnnnnnnnncgagtggccgcggtag

SEQ ID NO: 8428 - DNA, 175 bp, Diabrotica virgifera
  misc_feature (11)..(12): n is a, c, g, or t
  misc_feature (25)..(25): n is a, c, g, or t
  misc_feature (35)..(35): n is a, c, g, or t
  misc_feature (48)..(122): n is a, c, g, or t
  misc_feature (127)..(127): n is a, c, g, or t
  misc_feature (134)..(174): n is a, c, g, or t
ttatttttaanngttaaaagcttanatttttttanaagacgagagacnnnnnnnnnnnnnnnnnnnnnnnnnnnnnnnnnnnnnnnnnnnnnnnnnnnnnnnnnnnnnnnnnnnnnnnnnnnttggnggtgatnnnnnnnnnnnnnnnnnnnnnnnnnnnnnnnnnnnnnnnnna

SEQ ID NO: 8429 - DNA, 1045 bp, Diabrotica virgifera
  misc_feature (742)..(742): n is a, c, g, or t
  misc_feature (815)..(815): n is a, c, g, or t
  misc_feature (909)..(909): n is a, c, g, or t
  misc_feature (912)..(912): n is a, c, g, or t
  misc_feature (922)..(922): n is a, c, g, or t
  misc_feature (925)..(926): n is a, c, g, or t
aaataacgcaagttggcatcaaaccattttggataattataagttctaaatcttttcaccggtacaaacaatgatagtgacatattaagtatgttgtaaaatactgttaaagcatcatcaacatttgacaaattcaaatggtcttcccaaggtatcattgaaagatagttattgagaccttcatagtctgcgtttacaaaatcatgataaaattcagtatattctaatgacttactttgacgttcacactaactaatattgtgagtgtaacttatgtgatgataactatttttaaaaatcggatctgaagcttttgctacttgtaaatcacaagtacaatttcattgtaatgtaccacacttatagctcaggatttttagattttagaaacaaaatccttcataaccagctaaaaacttgcatacgtatttagaataacgtctcgaataatatgcctaaactccccgcgcctccgccgcttgcgtctcgacatacagccctccaccccctcttcaccccggaacctccgcgcgctgtgctcgtttgcgagcgaatgcattcagtcggccgatggcattgttttagttattatatatagttagtatatgacgcgtgactgtataccacggccctacccctccacgcgaccgttacgtgcatataccgacagcgtgataccttgtgaactggatctttcgtttgctcgcttgtgttccgatatcctaagcaacaatgaatgaantgtttgttgtgtaatctttctcttgatagtggcaaggtagtaacagtgaatcggggcattgatacactaatanaggctagtatagcccttggagaccacttagaaaagagcgttgaaaacaacccgtccacttcgtgtacacgagcaatgcagaaaaaactatactncgncttcgactantannatcagcacaaaatgcagtacggataattttgagttgatactgtattcacgcgatcgagtctacctacttttgactttaaaaaatcctgcataatttgtggaaatgaaagctgaatggcc

SEQ ID NO: 8430 - DNA, 569 bp, Diabrotica virgifera
  misc_feature (110)..(126): n is a, c, g, or t
  misc_feature (128)..(142): n is a, c, g, or t
  misc_feature (242)..(272): n is a, c, g, or t
cagcatataatgatggattttttgcacaagacagttttttcttattacacgcagtctctcctttttgaatcattcataacagggttttacaagtaaatcatacattgctnnnnnnnnnnnnnnnnngnnnnnnnnnnnnnnntatatgtttcaccagagtcactaaaaagtgttttaatgaataagttctcaaaatttatcataaagcgaacagtttagtctaaatgaattatcttaaattnnnnnnnnnnnnnnnnnnnnnnnnnnnnnnntgagtgttacaagagatcaataaaagattgtactgtacaaaaactaaaaataatagatagaaagacaacctaaaagtctagattttagatctatcgtctagatatagaatgaagaaaagacaggctatgtaaaaacacctcatggaatctgaattaaaaatacactattttaaacggcatagctaaagtaaatgtcaatgctaaagttaattttttgttgttctcagatgattaatcgagagaggaatgtagggaaacgcttctttagatcattataacttgatgaatgaaaacaat

SEQ ID NO: 8431 - DNA, 211 bp, Diabrotica virgifera
  misc_feature (6)..(180): n is a, c, g, or t
  misc_feature (182)..(205): n is a, c, g, or t
gatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnncttttt

SEQ ID NO: 8432 - DNA, 202 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggacc

SEQ ID NO: 8433 - DNA, 904 bp, Diabrotica virgifera
  misc_feature (22)..(44): n is a, c, g, or t
  misc_feature (629)..(684): n is a, c, g, or t
  misc_feature (687)..(687): n is a, c, g, or t
  misc_feature (741)..(741): n is a, c, g, or t
  misc_feature (803)..(803): n is a, c, g, or t
  misc_feature (854)..(855): n is a, c, g, or t
  misc_feature (891)..(891): n is a, c, g, or t
acatatacatatcatcattatnnnnnnnnnnnnnnnnnnnnnnnctgccgtagaagtagtattacttaaaaatttaaccgagtttctaaacatggtcaaaggtaagaggttcgtgttaaacaaggtcttcgaaggatttccaaaagaagatgacttcaaaatggaggaatatgagttgccatcaataaaagatggagagtttttaacagaagctgtctacctcagcgtcgacccatacatgagagcctacatatctgaaatgtctgtggtggggaaaactatgatgggaactcaagttgctcaaataatagagagcaaaaatgcaaagtatcctccaggtaaatacgttgttggtacctttggatggcaaactcatacagtttccaatgacgaacgacttcgcttagttccagatcttgaagggttgcctccttcactttctcttggagtactaggaatgccaggaaacacggcatattttggatttcttgagatatgtcaaccaaaaccaggtgaaactgttgtagtttctggagctgctggagctgttggtagccttgttggtcaaattgcaaaaattaaaggatgctcagttataggcattgcaggatcggacgaaaaaggaaaannnnnnnnnnnnnnnnnnnnnnnnnnnnnnnnnnnnnnnnnnnnnnnnnnnnnnnnagncgggggaacttaaaaaagctgctcctaagggcattgactgttactttgataatngttggaggagtactaaggttccgcagttatacaacaaatgaacctctacggtagaatatcangtatgtggatcaatttctagttacaacgatactgaaacaccacttgctccnnatgctcaacgaggatttacaggtaacaactaaaaantggaaggattcac

SEQ ID NO: 8434 - DNA, 907 bp, Diabrotica virgifera
  misc_feature (807)..(824): n is a, c, g, or t
gccatttcgaaaatatcgctatagatatcatatattgttccaagtttggttatagtattggattgtggtggtgaagagtatattagtgtgagctatttgcattcacaaactaaaccatggctcacctacaccacaacttcgacatgatcgaagttgagtctgacagggggaaaccaagaaagaagcagtcatgtctgcgacaaaacgccctcaccatagccacaatgttaggagtcattctcggcgcagtcgtcggcatcattctccgatactccagggaaaagtggacagaacgagaagttgtatatatcggacttgcaggacagatctttctacggatgttgaaggcgctgatcctgccgttgattgtttcgtcgttagtgtctgcgatagcaagcttggacttgtccctttcggggaaaattgcctttagggcgatagcttattatatgactactacgttcgctgctgtggtgttaggtatggttggtggtggttaccatgaggccgggtgtgggtcataaaagtgaagactcggatggcaaggaagaaaaacgggaggttttaactgtagataccttattagatttaatcaggaatatgttcccaccaaatgtagtagaagccacaattttccaaactcgtaccaaattacatccaaccaacaccagtggcacagatctttacaagtacagtatcgacaacgaaattatccaaagtaccaatatcctcggtctagtcgtagtagctgctgctttgggtatagctatagctcaactaggaaaggaagccaaagtgatagccgannnnnnnnnnnnnnnnnnggccgtcagtatgaagattacttcctgggtgatattcctctctccagtgggtatcgtgtttctggtatcgtctaagataatgg

SEQ ID NO: 8435 - DNA, 70 bp, Diabrotica virgifera
  misc_feature (2)..(69): n is a, c, g, or t
tnnnnnnnnnnnnnnnnnnnnnnnnnnnnnnnnnnnnnnnnnnnnnnnnnnnnnnnnnnnnnnnnnnnng

SEQ ID NO: 8436 - DNA, 912 bp, Diabrotica virgifera
  misc_feature (497)..(514): n is a, c, g, or t
  misc_feature (777)..(777): n is a, c, g, or t
  misc_feature (863)..(863): n is a, c, g, or t
  misc_feature (896)..(896): n is a, c, g, or t
tctaaacatcgaggccatttttggaagaatcaccgggtcacacatattttcgaaaattgacttaaaacacagtttttggttgataccgttagctgaaaagtgtagaaactacaccgctttttctattgatggtattgtctaccggtttaaggtagtgccatttggattgcagagtgcttgtgctgcactcgtccgagctctacataccattttgaatcgccatgaagatttcatagttcattatatcgatgatttattaattttttcacaagatactcagagtcatctggaacacatagaaataattctggaagaattggacacagcgggattgaaattaaacattgaaaaatgtcaattttttcaaaaagaagtcatttatttgggttttcaattggacatcaaaacagtaagattagccgaagacagagtcaagctcatagatgaatacccaagaccaacgaatttgaaaacattgagaggttttcttggcacgnnnnnnnnnnnnnnnnnnctgattcccgatttgagccaaaaggaaatccctccgataaaattgcttaaaaaaggaataaaatggaattggaaagaagaacaggaggaagctttcgaaacattaaaacgagaattcgcaaaaggaacgaaaatataccaccctatttacaatttaccttttatactccgaactgatgcgtccatacaaaaatttgcaggagttctgtctcaaatacaaaacgaccaagaagtgccgatatgttttatatctcgagtgactanaaaacatgagagaaaatatagtgttacagaattggagtttgccagtgtactatactgcgtaaccaaattgaggttttacttattgngagcaaaatcacaatcgaacagaccatgcagcngtagtacatatcatga

SEQ ID NO: 8437 - DNA, 765 bp, Diabrotica virgifera
  misc_feature (515)..(535): n is a, c, g, or t
caaaaaaattagaatatctaggacatgtaaagagaaatcaagaacgttacggccttctccaactgattctccaagggaaggtaaatggtaaaaggggaccgggaagaaggcgcatttcctagcttcaaaatttacgaaagtggtataacacgacaaacaaagtcaagatagccatgatgatcgccaacatccggaacggataggcactttaaaaagaagaagaataatattagtaaatagtgtaaattatcatgctatgaaaattttaaacatgaagaacaaccggcccttaatgtaatattttaatatacttaattatgatcattatcaagtattaataatactctgtgttaaaacttgatcttgtaatatgtgggatgctacatacgtttcgtattactctacggactggagaaatgcacaaggcgaaaaaaggcacttatcatgcaaacatgggacaataagcacagagtataatggcaagatacgccaatagccatgagagaaacatatgnnnnnnnnnnnnnnnnnnnnngcagcacagttttagtcagaagtgtttttttttaacgcagaagaaaaaaacaagccagaaaagataagaaactacataaaaacgatgctaaatatatcagaaaaagcagcgcaataaaacgacctacgaaactcatataccataatatgaaacctaacagggaaagtacaaaaaaataaatacaatatagaaaggatactataaaaagaaatatatataaagatagtaag

SEQ ID NO: 8438 - DNA, 108 bp, Diabrotica virgifera
agcagctatattattaactttaatccaacatcgaggtcgcaatctttattatcgatttgaactctccaataaaattacgctgttatccctaaggtaatttattcttat

SEQ ID NO: 8439 - DNA, 665 bp, Diabrotica virgifera
atcaaggcggagcaggaggttatggaggaggtggcggtggtggaccctggtctcaaggaccatgggataatagccaaggtgggcaagatggtggccaaggagtatccggaggatggaatcaaggtggatacaacaatcaaggagcagcaggaccatggggacaaggaggacaagacaactttggtaacaactatcagcagggttatggaggtggggctatgagaaacaattttcagcaaccaagacccggaccatacaataatacaggaggtggctatggtggtggtggtttcaatgccggcaaccaaggcggtccaggaggcaacaggagatattaagacgtaagtgcaccgatacactgcagaagttgtttcatgctaaaagtatatcgatgcagtgcaagtgtacctcatatcgcataagcaaaaattcatccactcattttataaatccacaaattactagggaatttagagtttcgtcagtcagtgttaggaaatcttaaaaagtgacagcatagactttcgtttagtgttttcggttaatttttaaagaactttttgataatgcagattttattttagaatgtcgtataacttacttaagggagtagttttgtattgggtgacctattaaattttgattctacctctatctaaataggt

SEQ ID NO: 8440 - DNA, 1022 bp, Diabrotica virgifera
  misc_feature (79)..(98): n is a, c, g, or t
  misc_feature (566)..(584): n is a, c, g, or t
  misc_feature (897)..(897): n is a, c, g, or t
tgaactgtacttttttgaaccagggcacacatttatgtcggccgattcttttcaccatcaagtagagttgtctctcagnnnnnnnnnnnnnnnnnnnnacttttcagactttgtgaatgctgttggagctacttgttctgggaaaacagtggtcaaatcaatgcagcatgaagattttgcagtatggccttcttgtgtctctaactacaagctgaataaatttgtgaatcgaccctacctgaatgatttagtgtacatcaaagccgaacgtggcaaagatacattgttgtacagattttgctacgatgaatattgcccccttcaggaactagactttatgaccaaaaagggagctgaaaaggcgaagagccccctattttccgaactgcacctcgaggcatctgcttggcgaagaaacaagatattattacaaaactgcttcccttgatgcctgaaaataggaaacgtttttggttggacttgcctgaaagtgatgttccagacttgtgtgtttcagacgacatccctagttgagaaaagggtgtgtgtgttcctaactgtaaaannnnnnnnnnnnnnnnnnngcttaaacttttttatgaacgcattgttatattatatagatacaggtctcaaaattttattcatttttaatgttgacacaaatccttgctaaagtttttttattctaatatataatcctgtatttttaatgtagcataccttgaattttataggcctaattacaatagtttcactctaactcaagctaaatattatggatttttttgttgaaatacgtttgtgtatatttcaattagcaaataagcactatttaactttttaagaaagcattatattataacaaacattttcaaacaagactatttaaatgtnagttttagatttcaattaataatagtaaaatgttttctttcttaaatagtccgtctctaagtatattttgagtaacattctatgaataaatttttgcaaaaacacctttttaaaacccctaaatg

SEQ ID NO: 8441 - DNA, 908 bp, Diabrotica virgifera
  misc_feature (890)..(906): n is a, c, g, or t
atttgtatatgagtgtatggccaactagattatcaggcaataccaatctcacccgtctctaaagtcaacaaaaaacgcgaaactcggtaaataatcacgtttaaaaatataaaataggattcgttagacttaataaacttctgttttgtgactgctttccacagtgttgtgtgtttgtcatattattgaggaattcttacatggtttccataatataggatcttctttggtacgtcttgctgacaactgaaaaagccaccacacgtctccggagagaccctccactaaaaacgtcctcttgacctaccacttaaatacataagtaattcgacttcaaacagcgcaaaagatagcgtcattgtcatcgtggtgcacagtggcgtgctgcagggatgtggaaagagatcagcttactgaagggaagtccaaggacagcggaagacgacagggcgaccatttggacggcaggcggcaatgcggtctgtgttcattggtcgcccgcgcctttcgcagggctgtttgtggagcagtcagtcgtagaagtagtgacgattcctatcgcatactaacaggacaaccacaagatgaggaaaatgcaatatacagagaatcgcaagtcacacttgacgtcgttgaaggcaatgttatatatatgcgagctttatcggaaactcccacaatgcagcacgttttttccaaagaagactgggctcttctggacgccatgacaacagtgccggtccctgtttgtcacggcaaatttttaacgatgcacaaacgacgacgtaaaaagcttactaccagatctttatcacaagatcatgcaatacttgatgatattcatcacggacaggtcccagaaaatctcgaccgttgtactaagtggggannnnnnnnnnnnnnnnntg

SEQ ID NO: 8442 - DNA, 370 bp, Diabrotica virgifera
  misc_feature (17)..(29): n is a, c, g, or t
  misc_feature (32)..(53): n is a, c, g, or t
catttcaataaataacnnnnnnnnnnnnncgnnnnnnnnnnnnnnnnnnnnnnaaacagttttcataatcagtaaactattttgggattctctaaatacttcaaaaggatactcttaatgtgattgtatctccttggatttgaatatgttctaaaccttttatttatgctaacgtaattggtgctacttggttttacagatggccatttaagatgtaataatttacgatccctcgatggagtcggatcctgataagtaataaaattagaccaaagagaacacattcgctcttttaactggaatttgttgcgaggagatgatgtatttttcaccgcgagccttgaaaaacattgatttttatctgccgcac

SEQ ID NO: 8443 - DNA, 857 bp, Diabrotica virgifera
  misc_feature (135)..(164): n is a, c, g, or t
  misc_feature (327)..(347): n is a, c, g, or t
  misc_feature (425)..(448): n is a, c, g, or t
  misc_feature (460)..(489): n is a, c, g, or t
  misc_feature (651)..(669): n is a, c, g, or t
  misc_feature (792)..(832): n is a, c, g, or t
  misc_feature (835)..(855): n is a, c, g, or t
aaggcatttttgttggtggtgaggtcattttctacttgagagagttgcttttaggacagcgtcaacctccggtcgtcctcaggcactgaggaccttgactttatgatctatatcagtactaaaagaacagtgccnnnnnnnnnnnnnnnnnnnnnnnnnnnnnntgcatagtagttagatatggataagtttctgatttacacgatctaaagaactagttattattattgtaaaatcgatagtatagatatatttctacgaatgaaatgtcatctcggtagaaatatatctaattagtcgacacatagaataaattcattaattatnnnnnnnnnnnnnnnnnnnnntttagatattattagtactaattatttcgaagtatatatcttaagaataatagtcattaaaatataatttttgcaaannnnnnnnnnnnnnnnnnnnnnnnttatagaatatnnnnnnnnnnnnnnnnnnnnnnnnnnnnnngtatttattcagaaatttattataagcatagaaatttatatagatttaaattgattaatgatgatgatattgagaattaaatattgcatattaagtcaaactatgtaggtgtaacagatgaattctacaacgttttttatcgcgaggtattatcagaatgannnnnnnnnnnnnnnnnnncgtctcatctgtccactgattaattagaatgcccccgcattatgaccgtgctaacgtaacgttattcttagtgattttattgagaactggaaggaagaatttgtatcgaacaataacttgtcnnnnnnnnnnnnnnnnnnnnnnnnnnnnnnnnnnnnnnnnntgnnnnnnnnnnnnnnnnnnnnncc

SEQ ID NO: 8444 - DNA, 729 bp, Diabrotica virgifera
  misc_feature (99)..(122): n is a, c, g, or t
  misc_feature (620)..(728): n is a, c, g, or t
gtaaaaaggttgcttaggtcagacaacgggtttgggaagttcgagacatctaacatgtcccatttttgaggtgttccgttaattttgtcgctgtgtgtnnnnnnnnnnnnnnnnnnnnnnnntctaatattctttttcctctagcgctacaacccgctgtgtcataatccttaagattagatcattctcgccactctctagccaacgttttccaggtcgacctcgtggtctattttcggcctgtctccattcgttgatatcttttgtgtttctttcattgatcattcgaagcaaatggccaagccaacaaataaaatttaagaaactttatcgagctcaaatctcttgcggattttgtagcccccatactgctcccagacaggtccaaaaatttttctgatcactttcctttcatagtctattagcttataaattatcatatgtaattaaactaatatagaaaggcttatactaataagagtagcttcatattttgttttacgtagaatacatttttgggttttagttttagtgctattagttgttttgtaaatgcttaagaatggtagatgtagataatacatggtggtagttatatacatacagtagaaaatatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 8445 - DNA, 733 bp, Diabrotica virgifera
ctctatcatccgctctattaattctataattattttatcaaccccctcacctatcccctctataatatcttctgtatgattattaggattatgattaggactatgaataataactcgactatttacaggtctattttactgtccacatgactgaccaaaagtaaaaatagcagttcatatatgcggtcatgtttgtcatgatggataacaaggaagattacttgcaacagtacctgcatttgtattaatttgtttatacatccgtatagacctccgtatagatcatggaacatataatatatctgatactagaatagttgcttgaacaattgtttttcttactttatttcctacattactaggatatgtactacgatgaggattaccatgatgttgaggatcatcttgaggtactaccttaatatctaatattccatattttataccaaaattaggacatagattatgacgatgatttgcaggagataatgcagcatatactgcaacctttactctacactttatattaccttttattatacctgcaattataattgcacatctaataattctacatctatcaggacctcgaaatcgattgagaactcctttgagtactgatagaattacttttcatccttattttcctccttatgatattcttggagatcatacttgtattattattattatcatcattatcttcaacataaccttatttataaccatatcc

SEQ ID NO: 8446 - DNA, 689 bp, Diabrotica virgifera
  misc_feature (4)..(553): n is a, c, g, or t
  misc_feature (557)..(627): n is a, c, g, or t
  misc_feature (641)..(679): n is a, c, g, or t
tttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnncaaacatgtcttannnnnnnnnnnnnnnnnnnnnnnnnnnnnnnnnnnnnnnctttgaatgt

SEQ ID NO: 8447 - DNA, 233 bp, Diabrotica virgifera
  misc_feature (7)..(44): n is a, c, g, or t
  misc_feature (79)..(101): n is a, c, g, or t
  misc_feature (109)..(130): n is a, c, g, or t
  misc_feature (170)..(188): n is a, c, g, or t
  misc_feature (195)..(229): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntggtcgannnnnnnnnnnnnnnnnnnnnnagttaaaccggtggaagccaggttggttctatctttattnnnnnnnnnnnnnnnnnnngaaaggnnnnnnnnnnnnnnnnnnnnnnnnnnnnnnnnnnntatt

SEQ ID NO: 8448 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8449 - DNA, 853 bp, Diabrotica virgifera
  misc_feature (637)..(712): n is a, c, g, or t
caagaccacaagtacctgtacaaacattcaccatcatggcccaatcgtgcactcttctgcgtctagcttaccagggcatgtactgcttggagctgcgaattagaggatccggtttggtttccctgcgtgatggggcctacagtagatttgatagaagcaacgttgtcgatgtgttctctcctactcagggtttgaaaacatttttatcgaaatatgtcgacgaaacggctgtgtttagaagaagatctcaatctgaggatgataatcctccatcgccgatggaagtggaaggcagtgggttcttaggtcaccatcgaggtcctcagtctccagccggtcaaagagaaccaggcctccgtttccacccacctttaacgccaccatcaggctccaatcctcacacacccgctagtccccacacgtctatgaatcaaccaaccacccacaccagttttggttccagtccagctacctcatttaacttagcatctcccacatcgctacagccgaatataaacccaagccccatgcctcacccccgcccaggtggtttagtcgccaactctcctttaaatcctcagttggccagtcctggaggactgttgagtaattcttcacctggaccacagagtactannnnnnnnnnnnnnnnnnnnnnnnnnnnnnnnnnnnnnnnnnnnnnnnnnnnnnnnnnnnnnnnnnnnnnnnnnnntctatcgtcgcctgcagcttcgacgaattggcctggttctcctggtatgccacggccttcccccggccgacctggccaatctcctggtggaccctcgtttatgcacagtccacaacagtcattcggatctcaaacctggta

SEQ ID NO: 8450 - DNA, 906 bp, Diabrotica virgifera
  misc_feature (171)..(189): n is a, c, g, or t
  misc_feature (346)..(366): n is a, c, g, or t
  misc_feature (760)..(760): n is a, c, g, or t
  misc_feature (819)..(819): n is a, c, g, or t
  misc_feature (838)..(838): n is a, c, g, or t
  misc_feature (854)..(854): n is a, c, g, or t
  misc_feature (858)..(858): n is a, c, g, or t
caattatctgatgaaaattcaagtgatgaagatgtctctgattaaaatgactgatgtttctaatattccattaagctaatttaagtaaaaaatctttattagttttaatttcttagctattatttgtatgcagtggccctagaccaaatgtcccataaaattattgtcatnnnnnnnnnnnnnnnnnnngccccacattttaaattaaattacatatttatagctaaattgaaaaatgttcatgtctcaaattagctaaagagcgtttcaattattacgccttgatggagacccctgaagagtattgtgcccaaaccctctttgtatgtgtcccgttttttcatgnnnnnnnnnnnnnnnnnnnnntaaaattagtgagacatagttaacgatgctctacactctacaccttcggtaaagaattaaggatttgcatgaaattttagtatgttatagtttacttaaaaaaaactaagacttgattttttaaaaattgttttgccgtgccctttaattactattaagggtcaaagttaagttttaacatgggctcttatgggaatttttaaatagttcataactttttaaccaaatttacgatttttaattatttgtgcttaaattaaaggtttttttgtaaggaatgacatattaaaaaatgaggattgcataccattattaaataaaagtgaaaatactgtttcgaaatttaacaaagttggtagtgattccactggttgtcaatgcgcagacgcactanatacgtgtcagcaatttaaactgtataattcaaagtcatttttaatgaatcataaatanactgaaataattattttanatattaatttgagctnattnggaaaagtaaaaatatgtagaatagaaataaacgggttatgaaagtta

SEQ ID NO: 8451 - DNA, 360 bp, Diabrotica virgifera
  misc_feature (10)..(10): n is a, c, g, or t
  misc_feature (170)..(190): n is a, c, g, or t
cattaagcgnccgcgcttttaactccagttttataaaaactcctcattataagccagtcaaacttctagaatatattaataatacataaacaaggaagaataaatcaagtatcattccgctatcatacgctaaaaccttaggggtgggggccaccccatctcggggtggnnnnnnnnnnnnnnnnnnnnnccccggaagttggagggaaaaaggatgcttataagaaaagaatgttttttaccttttcttcgaaaaaataatattttcgaggtattcgcgcttgaaaataacagtttttcgaagaaaaaatcgacttttgtagagggttttttgagaatacctccaaaaatatgtattta

SEQ ID NO: 8452 - DNA, 167 bp, Diabrotica virgifera
  misc_feature (13)..(36): n is a, c, g, or t
  misc_feature (44)..(73): n is a, c, g, or t
  misc_feature (77)..(77): n is a, c, g, or t
  misc_feature (103)..(157): n is a, c, g, or t
aagacgagaaacnnnnnnnnnnnnnnnnnnnnnnnnaattaggnnnnnnnnnnnnnnnnnnnnnnnnnnnnnntaantttatttaaatttgggggtgattaannnnnnnnnnnnnnnnnnnnnnnnnnnnnnnnnnnnnnnnnnnnnnnnnnnnnnncccatttttt

SEQ ID NO: 8453 - DNA, 354 bp, Diabrotica virgifera
acgagaggagaaacgagaggagcaaaacccttttgtacttcgagtattcgagtctaatagatagaaaagattggaaactccggttgtatttaactatttatatttctaagatcgtggaagcaagcgaacggccaagaaaagaaataattatacaccaataaatatgaagcaataaggagatcaagaatatacaagtgataggaaggtaaaagggagaaaaagcatattggcaaagatctggcagtggaatccaaggacgcgtaacacatagcgaattatataacagacatcaataaaccgaactcctataacaaagtatctgaatacacgtgtacaaaatatttcccaccaaga

SEQ ID NO: 8454 - DNA, 101 bp, Diabrotica virgifera
  misc_feature (3)..(19): n is a, c, g, or t
  misc_feature (49)..(49): n is a, c, g, or t
  misc_feature (57)..(97): n is a, c, g, or t
  misc_feature (99)..(99): n is a, c, g, or t
agnnnnnnnnnnnnnnnnncgagagaccctatagagtttataaattatntataagtnnnnnnnnnnnnnnnnnnnnnnnnnnnnnnnnnnnnnnnnngngg

SEQ ID NO: 8455 - DNA, 961 bp, Diabrotica virgifera
  misc_feature (834)..(834): n is a, c, g, or t
ctaaaaggagatcaagaagtacaagtagagaccgcaaagataaacaaaagagatccaaaatagaagatacatcagacagagaaagagacaggcataggagacatagtagggatagagaacataccagggagagagataaagagagacatagagacacaagtagaagtagggataaggataaagacaaagatagggattattacaatggaagagatagaaataaagacaggtatagggaacgtcagagatcgagagatagacatagggatgaatattcaagagatttagaagactacaggaggtctaagggaagacataaagatgatgacttttacaaaagagaagatacaaatgaaaagtggtttatgagagataggtatagaggctatgattcaagaagcaagcatagatcaccttccaatgaaagagactccaagtttgacaagaagaaactgttggaaattgccagacggaatgcaataacaatgatgaaatctggaagtctacctgctgcgttaactctaggacctcaagcacaggaaaaggttattgctgctattaaatctggcgggaaaactattgaagaattgacagatttttgtaaaactctttcaaagaaggaagaattaggagaattgtctagtctttcagaaggggatgatagtgacagtgatacagacaaaccatttcatcatccatttcaaattaaagatagacctacatctataactatgaatattaagaattctgtaccgctcccagtaaaatcagctttcgaacgaaccagtgagttgcgcatccagtttccagtcagcagtggccaacaccacaggnaaggtgaggaatggatgcctgtgtcacaccatcagccaaaaaactcgacggtctacctcctcagctgttacagctgctgctacagctgctgctacaagcacggcctctagcaacaccactttctact

SEQ ID NO: 8456 - DNA, 865 bp, Diabrotica virgifera
  misc_feature (20)..(45): n is a, c, g, or t
  misc_feature (95)..(109): n is a, c, g, or t
  misc_feature (236)..(250): n is a, c, g, or t
  misc_feature (451)..(471): n is a, c, g, or t
  misc_feature (618)..(640): n is a, c, g, or t
  misc_feature (777)..(777): n is a, c, g, or t
  misc_feature (781)..(806): n is a, c, g, or t
tttttctttcaagttattgnnnnnnnnnnnnnnnnnnnnnnnnnnatatggatatgaaagtggaagttaatgttaaagttgaaaaggaagagttnnnnnnnnnnnnnnnaaaatatatggacaatcagttatcgacatcaacagatctaccagacataaaagatgaaccagaggataataaaccagatatggatatgaaagtggaagttaatgttaaagttgaaaaggaagaattnnnnnnnnnnnnnnnaaaatatatggacaatcagttatcgacatcaacagatctaccagacataaaagatgaaccagaggaaaataaaccaggttgttcatttcaaaaagaagatttggatggatacgttgaagagaaaacattaaataaaaaaatgaaagttgaaactgggaaaaaatcacatttgatgactcacactggaaaaaagccttatgnnnnnnnnnnnnnnnnnnnnngatttactgcagcatattctttgaaactacatttgatgactcacactggaaaaaagccttacgagtgtgaattttgtttaaaacgatttcctcagcgaagtaatctaaaagtgcatttgacaatacatactgaagaaaaacctcacnnnnnnnnnnnnnnnnnnnnnnnattttctcgagccggtcattttaaaaggcatttgataactcacactggtgtaaagccttacgagtgtgatatttgttttaagcaatgtactcgagcaagtgacttgaaaagacatttgacgactcacactaaagaanagcnnnnnnnnnnnnnnnnnnnnnnnnnngcggtttactagagctagtaatttgaaaacacatttgatgattcacactggagaaaaac

SEQ ID NO: 8457 - DNA, 180 bp, Diabrotica virgifera
  misc_feature (4)..(171): n is a, c, g, or t
gttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttttt

SEQ ID NO: 8458 - DNA, 867 bp, Diabrotica virgifera
  misc_feature (120)..(141): n is a, c, g, or t
  misc_feature (461)..(480): n is a, c, g, or t
  misc_feature (507)..(522): n is a, c, g, or t
  misc_feature (709)..(709): n is a, c, g, or t
  misc_feature (821)..(821): n is a, c, g, or t
aatatggctacacaaggagttcgtggagtttctagagttttacaaaagttggaaaaatcggtaatagatggaaaattttatgaagcacatcaaatgtataggactttatatttcaggtannnnnnnnnnnnnnnnnnnnnngaattaaaagatatgctatacaatggagcagttttatttctagaacgtgaacagcaactaagtggctcagatttgggaatattattaatagaagttttggaacaatcggaagactctaactacgaattgtgggctccaagttaacgaacatattccgtcaaataaatatttccactccagaacgtgacacatttttagcacatgcagttcgttggtcgtctaaaggatcatctcatggacacccacaattacataggagtgtagccttggtttattgggctgaaaaaaattattcacaggcacgtcaccattttatatannnnnnnnnnnnnnnnnnnngtgctaaacttcttatagagttccacnnnnnnnnnnnnnnnnaagaagaagctgacttattcatagcacagactgtattccaatatttatgtttaaaaaataagagtactgcaaatcagacatttacaagttacacagaacatcatcctagaatacagggatcggggccaccatacttgtttcctttgctcaattttatatggttcttgttacaggccattgaaactanatccacaatccacacattccttctactaatcggaaaatatgaaccatcgctaaaaagagatcctggctacatccaatacctcgacaaataggccaaaatttctttggcatanaccaccacaacaacaacacagacaactcattctttggacacttatc

SEQ ID NO: 8459 - DNA, 116 bp, Diabrotica virgifera
  misc_feature (7)..(70): n is a, c, g, or t
  misc_feature (77)..(108): n is a, c, g, or t
  misc_feature (110)..(110): n is a, c, g, or t
aaaagcnnnnnnnnnnnnnnnnnnnnnnnnnnnnnnnnnnnnnnnnnnnnnnnnnnnnnnnnnnnnnnnnagtatannnnnnnnnnnnnnnnnnnnnnnnnnnnnnnngnggtgat

SEQ ID NO: 8460 - DNA, 953 bp, Diabrotica virgifera
  misc_feature (255)..(273): n is a, c, g, or t
  misc_feature (811)..(828): n is a, c, g, or t
ggattattttgttaaacttgaatattttattttgtagtgataataaccaaatacaattgttagaattcattagttattaatttatagtacaacaaaaatattttctttttcgttaataaagatttattgacataaactgcgatagtgaggttatgtatacataattaaactgatggaaaatgaagaatttatatcagattaactgcgtttttattttctgtttatattaatacatcttatcactagcgtgacacnnnnnnnnnnnnnnnnnnngtcccatttaaacatacacaaagcgtccttacaaaatttcaaaaaaccgccaacacgagcaggtcggtcgattttgctttgacactttgttaacgctcggagcgaatatttacaatccggggcaaagcacattaccatttttattatacaacggttcacaacaattcctaacatttgcttggggaatatcactaaaaactatatttcatagaaatttaagatcaaaccatggtggtattatctttccaaacactatacttaagctaaaaaagcagcagaggaagcaaaatttcaactttagaggaattaaaaaggctcgagattggataaaccctggcttttcaaccttcgtttacaaagtgataataacaatatgacagtcgtggcgtcacacttcggctgttagccttaaaatcacatcgtatttttctatatttgaactacatgtattatatcagacattttctaccatatagaatatagagtatttatagcaaatttctaataatgtattaatacattagcacaaaattaatannnnnnnnnnnnnnnnnnctcttgtttttgtaaatcacgcataaagcatacacataagatcgtccccacatagccagaatgtaccacgtgacctattatcatagatagcgctcccagcggattgcctacttcattctcatcac

SEQ ID NO: 8461 - DNA, 113 bp, Diabrotica virgifera
  misc_feature (2)..(17): n is a, c, g, or t
  misc_feature (19)..(110): n is a, c, g, or t
gnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngat

SEQ ID NO: 8462 - DNA, 222 bp, Diabrotica virgifera; identical to SEQ ID NO: 7599
  misc_feature (6)..(28): n is a, c, g, or t

SEQ ID NO: 8463 - DNA, 172 bp, Diabrotica virgifera
  misc_feature (10)..(10): n is a, c, g, or t
  misc_feature (19)..(19): n is a, c, g, or t
  misc_feature (33)..(107): n is a, c, g, or t
  misc_feature (111)..(112): n is a, c, g, or t
  misc_feature (126)..(170): n is a, c, g, or t
aaaagcttanatttttttnaaagacgagagacnnnnnnnnnnnnnnnnnnnnnnnnnnnnnnnnnnnnnnnnnnnnnnnnnnnnnnnnnnnnnnnnnnnnnnnnnnnttgnnggtgattaaaaatnnnnnnnnnnnnnnnnnnnnnnnnnnnnnnnnnnnnnnnnnnnnnga

SEQ ID NO: 8464 - DNA, 630 bp, Diabrotica virgifera
  misc_feature (2)..(574): n is a, c, g, or t
  misc_feature (577)..(599): n is a, c, g, or t
  misc_feature (604)..(604): n is a, c, g, or t
  misc_feature (607)..(608): n is a, c, g, or t
  misc_feature (610)..(629): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnntgaanggnntnnnnnnnnnnnnnnnnnnnnc

SEQ ID NO: 8465 - DNA, 649 bp, Diabrotica virgifera
  misc_feature (7)..(98): n is a, c, g, or t
  misc_feature (101)..(119): n is a, c, g, or t
  misc_feature (123)..(157): n is a, c, g, or t
  misc_feature (160)..(177): n is a, c, g, or t
  misc_feature (337)..(356): n is a, c, g, or t
  misc_feature (597)..(617): n is a, c, g, or t
gcggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnncccnnnnnnnnnnnnnnnnnnnnnnnnnnnnnnnnnnnggnnnnnnnnnnnnnnnnnnggggcccatttggggggaaacatcaaaaggatcaaaaccccaagcaaaccttacaaaggccttttttttgcccgcgggccaaataaggggggggacctgggctacatggaaaccaaacaatttcttagcggcggctttaaggggggggtgggtggcccannnnnnnnnnnnnnnnnnnnggggggggtaatcgtcaaccttcccccggggggctccgggggccagggggaatttgaggaaattgaaacccccctggggggatcgggggggaacccccccctgggggaattggggaccccgggggggcgggggggccttaagacggcggaaggggacggggaaagggttttccctgggggggggcccatgggggcctccactactttcttttggattttaagggctccccctcctgggccnnnnnnnnnnnnnnnnnnnnngccaacccctttttgggggtgtaaaacgggaa

SEQ ID NO: 8466 - DNA, 209 bp, Diabrotica virgifera
  misc_feature (17)..(54): n is a, c, g, or t
  misc_feature (74)..(87): n is a, c, g, or t
  misc_feature (90)..(112): n is a, c, g, or t
  misc_feature (120)..(142): n is a, c, g, or t
  misc_feature (172)..(203): n is a, c, g, or t
actttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8467 - DNA, 600 bp, Diabrotica virgifera
  misc_feature (5)..(24): n is a, c, g, or t
  misc_feature (358)..(380): n is a, c, g, or t
  misc_feature (382)..(403): n is a, c, g, or t
  misc_feature (563)..(584): n is a, c, g, or t
gcccnnnnnnnnnnnnnnnnnnnngtgatatttttttaatagaaaggaccaattatatttaatgatagatagttagtaaggagcgagaagatatcgtttgactccaaaaaagactcatcttttgtacctacgtggagcatgaaggattagtaaataataataaaatcattattatccacgtacaaagagcaaccaaagtaataatattattgttgaaaaaaactttgcataaacttttttccgcgagacagtgatactctttttctctatatctcaaatctttcgaagatagaaattaccttaatttataaccaagattttataaatcaatatgcttagtatatttataactacatannnnnnnnnnnnnnnnnnnnnnncnnnnnnnnnnnnnnnnnnnnnngaaataaaaatgagggataagaaactttcctattgttaaatgaggtgatatttaattttataaactaatggttgctattgattaaactttctctaaaaatatatatattcaatatatacagacaagagtgatgatgacccccattattattaaattgtgnnnnnnnnnnnnnnnnnnnnnnaggataaaggaaggca

SEQ ID NO: 8468 - DNA, 670 bp, Diabrotica virgifera
  misc_feature (2)..(58): n is a, c, g, or t
  misc_feature (65)..(65): n is a, c, g, or t
  misc_feature (83)..(83): n is a, c, g, or t
  misc_feature (87)..(164): n is a, c, g, or t
  misc_feature (169)..(194): n is a, c, g, or t
  misc_feature (199)..(199): n is a, c, g, or t
  misc_feature (203)..(248): n is a, c, g, or t
  misc_feature (250)..(284): n is a, c, g, or t
  misc_feature (287)..(333): n is a, c, g, or t
  misc_feature (338)..(399): n is a, c, g, or t
  misc_feature (404)..(433): n is a, c, g, or t
  misc_feature (474)..(493): n is a, c, g, or t
  misc_feature (609)..(655): n is a, c, g, or t
cnnnnnnnnnnnnnnnnnnnnnnnnnnnnnnnnnnnnnnnnnnnnnnnnnnnnnnnnnatataangtctcgcctgcccactgnattnnnnnnnnnnnnnnnnnnnnnnnnnnnnnnnnnnnnnnnnnnnnnnnnnnnnnnnnnnnnnnnnnnnnnnnnnnnnnngtggnnnnnnnnnnnnnnnnnnnnnnnnnnaattnatannnnnnnnnnnnnnnnnnnnnnnnnnnnnnnnnnnnnnnnnnnnnncnnnnnnnnnnnnnnnnnnnnnnnnnnnnnnnnnnnggnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnncttagggaaaaccgcgggattttttttttggggaggccacnnnnnnnnnnnnnnnnnnnncccccccgggggtggttaaaagtttttattttgtggggggacctatattttttataaggggtcgcgcattttataaatttttccttggggggggtaaaacccggggcgggggcccnnnnnnnnnnnnnnnnnnnnnnnnnnnnnnnnnnnnnnnnnnnnnnnggggagcgccgccac

SEQ ID NO: 8469 - DNA, 763 bp, Diabrotica virgifera
  misc_feature (2)..(23): n is a, c, g, or t
  misc_feature (44)..(84): n is a, c, g, or t
  misc_feature (102)..(134): n is a, c, g, or t
  misc_feature (148)..(200): n is a, c, g, or t
  misc_feature (217)..(230): n is a, c, g, or t
  misc_feature (232)..(377): n is a, c, g, or t
  misc_feature (388)..(400): n is a, c, g, or t
  misc_feature (403)..(483): n is a, c, g, or t
  misc_feature (667)..(679): n is a, c, g, or t
  misc_feature (682)..(695): n is a, c, g, or t
  misc_feature (697)..(715): n is a, c, g, or t
  misc_feature (731)..(762): n is a, c, g, or t
gnnnnnnnnnnnnnnnnnnnnnngtaggtaattaatattggggnnnnnnnnnnnnnnnnnnnnnnnnnnnnnnnnnnnnnnnnnaccctggggatccgggannnnnnnnnnnnnnnnnnnnnnnnnnnnnnnnncaatttaaaagaannnnnnnnnnnnnnnnnnnnnnnnnnnnnnnnnnnnnnnnnnnnnnnnnnnnnaatggaatggtattccnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattttccnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnngaatggaggtaataataagaataaaaaattggataattaagaaaaatatataaggttaataaagggaatccgccacctttttttcccccggttaataaaaacctggccttttggattaaataataaggctccgccggccaccggataatttgaatggccgggggaatttggccggggtaagggnnnnnnnnnnnnnagnnnnnnnnnnnnnngnnnnnnnnnnnnnnnnnnngaaaaaaaactggccnnnnnnnnnnnnnnnnnnnnnnnnnnnnnnnng

SEQ ID NO: 8470 - DNA, 877 bp, Diabrotica virgifera
  misc_feature (176)..(193): n is a, c, g, or t
  misc_feature (669)..(691): n is a, c, g, or t
gaaaaagtcgtcttggtaacatactagtaaaatttcatatttggcggggacagtacttcttgaaaacaaatgtctgtgacaagaagccaaagcaaagacaacaaaaaacaaaaagaatattcaaatcaagaaaataattcagaccaagaagatattttaaacacaacaatcatggnnnnnnnnnnnnnnnnnntgtcagaattagaaaagatattacaacttatgcaactacagtcaaaaaaaatggatgaagcaaaacgaacaatggatgacaatcaaagagaaacaaaacaagcaatggaggaagcaaaaaggacaatggagaaaaatcaggaggaaacaaaactagcaatggatgaagcatcaaagaaaatggataaagtggatcaaaaaatggatgaaacacaacaaaaaatggatgaaacacaacaaaaattggatcaaaaaatggatgaaacacaacaaaaaatgaaacaagcaatagaagagaacaacaagaaaatggaggaacgcataggaaagtatgaaatgaaaattaaagatcacatgcaaccacaagaaatgagaatgaaggaccacatgaaagaacaagaaatgaaaattcaaaataaaatgaaggagttaacgaattgccagaaaaaagaaatggaaagtttggaaaacaagttnnnnnnnnnnnnnnnnnnnnnnntagaagaagtggaaagaaagattgcggaaatcaatactccgatctgatgcgtccatacaaaaatttgcaggagttctgtctcaaatacaaaacgacccagaagtaccgatatgttttatatctcgagtgactaaaacacatggaaaatatagtggtacagaaattggagtttgccagtgtactata

SEQ ID NO: 8471 - DNA, 148 bp, Diabrotica virgifera
gcgcgattttatgtatatggtgattgtgatgatggctctgtgtagagacattctgtatgctctatgatacgcttgcgattacatcggtatcgtaattctttatagatgataacaacgagcgtcaaaggactgattgatacgacggaaa

SEQ ID NO: 8472 - DNA, 326 bp, Diabrotica virgifera
  misc_feature (5)..(26): n is a, c, g, or t
  misc_feature (28)..(29): n is a, c, g, or t
  misc_feature (38)..(38): n is a, c, g, or t
  misc_feature (42)..(43): n is a, c, g, or t
  misc_feature (47)..(105): n is a, c, g, or t
  misc_feature (108)..(179): n is a, c, g, or t
  misc_feature (185)..(223): n is a, c, g, or t
  misc_feature (225)..(311): n is a, c, g, or t
atatnnnnnnnnnnnnnnnnnnnnnnanntttgatggncgcnngtannnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnacgagnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaatttttttga

SEQ ID NO: 8473 - DNA, 898 bp, Diabrotica virgifera
  misc_feature (409)..(423): n is a, c, g, or t
  misc_feature (825)..(825): n is a, c, g, or t
  misc_feature (865)..(865): n is a, c, g, or t
ggctagctgacagttctcatcgcgcgtcagagtagctgtgtgttcttcttttttaatttgtttgggatcaattactggcttacggacgattttccagaaacgacgtagtgttacgtgatttctgtgagtttgaaaagtgatgccaaaaacgtcgaaacggccgacgtttattccttgtggacgtattgacgttcttcctttgttaaacagaaacaggtttccttaccatgccgtccctgctagaggcccttgaacaaaagtatggcgagagctcgacagattcagatgggtccgaggatgaaggcatttctgtgtccatatttgtgccttgtaaatctccaagagccgtcgttccggcgctcctagttctcaacgactgcgatattgctactgccggagaaaaagatgnnnnnnnnnnnnnnngtgcaggtgtcgaagaacttgatttggccaaaaataaattacaagaatggccagaggtttttggcatcctagaacaaatgccccgccttaaattcgtaaacttaagctttaacgtactttctacacctcttcgatcagaggtggagctgaacaaagaaacaaagtggcagcaacttaaaaatctagttttaaattctacgtatattggttgggagagtgtccaagaaatccttgatcatttacctagcctagaagaattacatttaagtctaaatgaatacagtaatgttcatctccatgatgacaagtcaaaaaactgtgatagtgttaaaaacgataacgaaacccaagaagaaacgcttccatgtactcaaacgtgcgcatgtactccttacaaactanagcacaaacattcgaaactgagggttctccattttcacgngaatcccgtagaggagtggaaagaggtaacaaa

SEQ ID NO: 8474 - DNA, 828 bp, Diabrotica virgifera
  misc_feature (65)..(81): n is a, c, g, or t
  misc_feature (701)..(718): n is a, c, g, or t
  misc_feature (725)..(750): n is a, c, g, or t
atgaatttttggattggagtaaaactggggctgtaactccagcaaaagatcaaggcacgtgtggnnnnnnnnnnnnnnnnngtgcagtgggtgccttggagagttacaattttagaaaaacaggaaagttgatttctttcagtgaacaaaacattgtggattgtttctcaaacgatacttgcgaaggaggagtaccagagtatgctgctaagtatatatacaatcacggaatacatctggaatctgattatccctacacagcaggacaagacgcttgcaaaatcctgataaaaccaactattagaatagattttaacgatacttctttcacgaaaggtactgatgaggaccttaaacaaggggttaaggagcatggtcccctttctgtttgtttgtacgttactgccaattggaggttttatggtagaggagtttggtaccataacaaatgttcatacgagtcaaatcactgcgtgctgttggtcggatacggtacagagaaagggaacgattattggatatttaaaaactcgtggggtccaaactggggccaaaatgggtttattaaagtggccaggaataaacatgagaactactgcggaataggttatggaatgtttctaatagatcaaaaatcagaaggtattccagattctgtcgccgagaattcaatataaaaattaataacaaatgtaaataannnnnnnnnnnnnnnnnngttacgnnnnnnnnnnnnnnnnnnnnnnnnnncaatattctttatgtggaattatgttcatacattttgtaagtattatagaaatatattacataaattttaatctatgt

SEQ ID NO: 8475 - DNA, 758 bp, Diabrotica virgifera
  misc_feature (14)..(44): n is a, c, g, or t
  misc_feature (46)..(588): n is a, c, g, or t
  misc_feature (601)..(621): n is a, c, g, or t
  misc_feature (671)..(695): n is a, c, g, or t
  misc_feature (697)..(720): n is a, c, g, or t
cccttccaggccgnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaataatcannnnnnnnnnnnnnnnnnnnngtggaatgaaggggtgtgatgaaataaacaactgtcgtttatttgaatcnnnnnnnnnnnnnnnnnnnnnnnnngnnnnnnnnnnnnnnnnnnnnnnnncgacgaaaaagactctattagaggtgtaaacaaatacc

SEQ ID NO: 8476 - DNA, 359 bp, Diabrotica virgifera
gtagcataaaccgtatggctactctttgtcatattctcgttagtttctttaatactcaatcgtaaatatgacaaagagtagcataaaccgtatggctacgttaaccaaatatcctgcaccaaagaaaaaggaagacgtgaccacgatgttgggagacaataaacattcagaatttcctgtatttgttgattatcctggtagctatgtgaaaactgtagctgttggtatttttgactgcaacgccaaaacttggagcatctattcagacaacccatcgaaaaatgaaccaattgtggtacttcctttagtacttaaagaaaataagtaaatttaatttaatacatcagtgttaccatatg

SEQ ID NO: 8477 - DNA, 966 bp, Diabrotica virgifera
ccaaaatgtgcagtatgtaattctgtcaaaattttatttctcaatttagtaggtataactactctttgtcctctcataataacatcagattgtaatgaaaattcagcttgatttatattgaaggtaaatcgtttatcaacaggttttcctgtttttaacccaacaagtaattttttttgctttgtcaagcgcagtttgacaagtattcgaccatttaaaattgacattctttttaagtaaattatttcatggttgtaaaattgtagaagcatcttttaaaaaacctctgtaataattaattaggccacagaaactccgaacttgagttctgtttgtaggtattggagcatttgcaattgcagttaccttatatgtactagtagacacccccgctttactcatcttatatccacagtagtcaatctcgtctttgaaaaattcgcttttatccaaatttatatgtaaattatgttcagataatttctttaaaacttgttcaagtctttgtaagtgtaaggtattatttggagctgtaattcttatatcatcctgaaatattgaaataccatctattccttgtagcatttgctccattaaacgttgccatttggcaggagcactagcaattccaaacattaatcgatttggttgaaataaagctttatgggtgtttaatgtaagtaaatgtttcatttcatcttttattggcaagtgtaagtaagctttcgtaatatctatttttgtatatttgtccccacctgctaattgggaaagtaggtcatctggtgtgggtaaagggtattcatccactttcatgcaaggggttaatgtgattttaaaatcaccacaaatgcgtatgtccccattttgtttaactacaggaacaataggagttgcccagtccgaaatgctactttctttaagactccctgatttactaaggactctaattctgcctcaacttta

SEQ ID NO: 8478 - DNA, 563 bp, Diabrotica virgifera
gaagagacctcgaggctgtttaataatttgaatgtaattgtttcatctgagttttattgagagataggtattgagtcttctgagagcttactgtatttttatgacatacatagttacttcttgcgccttgtgcatggataatcatgaatatgtactgatatggtatttttcctcgattttggtagacggatataagatattattttattgtagctggaatattttaaccattttttttgtataggatcgtcttacctttctagataatcaactgtttaacgaagagaataagattgatattacagtaactcttccttaatggatatttgtaacagttctataatatagtaatcattggtgagtccgtctgaaaccaagatttcattaccaatttgatctatggtaacacccaggatgactgtgcttgatttattgttgcatgtaaatatctctttatatatgctagtatttcatatactggataaactcttgaacaggatcttcgtcctatctagctagaggtactccagatgctattattgttaataaagagatgtctactg

SEQ ID NO: 8479 - DNA, 972 bp, Diabrotica virgifera
  misc_feature (15)..(37): n is a, c, g, or t
  misc_feature (94)..(121): n is a, c, g, or t
  misc_feature (178)..(205): n is a, c, g, or t
  misc_feature (267)..(289): n is a, c, g, or t
  misc_feature (330)..(362): n is a, c, g, or t
  misc_feature (501)..(519): n is a, c, g, or t
  misc_feature (527)..(544): n is a, c, g, or t
  misc_feature (599)..(621): n is a, c, g, or t
  misc_feature (658)..(728): n is a, c, g, or t
  misc_feature (753)..(780): n is a, c, g, or t
  misc_feature (859)..(859): n is a, c, g, or t
gagaaaaaccatatnnnnnnnnnnnnnnnnnnnnnnngttcagacaaaagtttgctttggatgaacatacgaaagttcacactggagacaagcnnnnnnnnnnnnnnnnnnnnnnnnnnnngtttagccaaaaaagtaatttgaaaatacacttgagactgcacactggagaaactcnnnnnnnnnnnnnnnnnnnnnnnnnnnngtttgcccaaaaaagcaatttaaatgggcatatgagagttcatactagagaaaaaccatatnnnnnnnnnnnnnnnnnnnnnnngttcagacaaaagtttgctttggatgaacatacgaaagttnnnnnnnnnnnnnnnnnnnnnnnnnnnnnnnnngttcaagaaatttacaagaaatataatgtatgaaaaattaattgatctaagttgtcctttacctgtcaatttaaacgaaattatttttccaaaaaataagcagacgttaaaatgtctttacgaatatgtaacgtcctgnnnnnnnnnnnnnnnnnnnggcttagnnnnnnnnnnnnnnnnnngtatccattaatatattataacaccctgtaaatttagattataagtaggcctagnnnnnnnnnnnnnnnnnnnnnnngtaataccatacaaaaaacaaatagtctggctaattnnnnnnnnnnnnnnnnnnnnnnnnnnnnnnnnnnnnnnnnnnnnnnnnnnnnnnnnnnnnnnnnnnnnnnngttgcgcatacgaaagttcacaccnnnnnnnnnnnnnnnnnnnnnnnnnnnngtttagccaaaaaagtcatttgagactgcacactagagaaaatattacagatgtgaaatatgttttaagaaagtctgtncagtatgcgaaaatgaactacatgagagattgcagagtggagaaaagtttataagtgtgaacattgttatattcagtatactaataggagtacacagtgaaagaaaaaactat

SEQ ID NO: 8480 - DNA, 901 bp, Diabrotica virgifera
  misc_feature (728)..(744): n is a, c, g, or t
gatgacgggaaaaggtggttgcgaaattttcttgtcgtgaaaagcgtcgcgccgaattttccgagtcgaatcgaatcaaagaaaagttttttagggccaagtataaaagcagaaaaagaattatcacaatgataaaagtcgacgaaaatgatcccgtaggggaggttcaattaagtttcccacatagagaagttcaaattcaaagagggaaagatccaaaggatttttacacgttagaggaagaaattggaagaggaaaatttggtacagtatacagatgcaaagaaaaatcgaccggattgtgtctagcagcaaaattcatcggttgtcccaaaaaagaagacagacgaaatgtggagagagaaatagatataatgcggtctcttcaacatccccggttaattcagatatatgatgcttttgaaaatggaaagatcatgacagttattttagaattaatcgaaggcggcgagttgttcgagagggtcatcgacgacgacttcatattgactgagaaaagctgcacggttttcatgaggcaaatatgcgaaggcgtcgatttcatacacaaacagaggatattacatttagacatgaagccggaaaacatactttgtctgacgaaaaccggaaacaggattaagataatcgactttgggttagccaggaagttcgaccccaacaagaaactccaagttttattcggcactccagagttcgtagctccnnnnnnnnnnnnnnnnnacgaaatcggatacggaacggacatgtggtcggtgggagttatctgctatgtgctgttatctggtctctctccatttatgggtcacacagacgtggaaaccatggcgaacgtcaccatagccaaatatgacttcgaggatgaggcatttgatgaaat

SEQ ID NO: 8481 - DNA, 631 bp, Diabrotica virgifera
  misc_feature (102)..(130): n is a, c, g, or t
atcgagcgttacaggtcacatgataccaaccccattattatcgaagatataagagatagttgtacattctaacgactagcatatatatccgtctcacaaacnnnnnnnnnnnnnnnnnnnnnnnnnnnnngaatcacccgtccctggggccgaagaagtgtacgtatgacgatgggccttcccaggatctaccggccaacgctggatatgataaaaaggatgcatgacaacgatctacgcgggcgcccgacgcccctggggtctgtatttggctcactttgtcacggctgaatctggtgtcactatgaaggcattataatgacattttcgactaatcgtatatcccacgctcctacaatatctgtgtgttcttcgacaaccatccgggtggatcttcttatgtgcaatcgaacatccaacgacacgttcctaatcctatgatcttctgtgtaccctcccgagcttgtctattaccttttagaacactacactgaccgatgacacagagcagaagaagacttacagtctctgtttcattgtgacaagcccatgttgggtctgggcagtaagtcgcatactatatattacgatagagggacttcgccacactacatacacctgataatataca

SEQ ID NO: 8482 - DNA, 721 bp, Diabrotica virgifera
  misc_feature (6)..(24): n is a, c, g, or t
  misc_feature (663)..(683): n is a, c, g, or t
caaatnnnnnnnnnnnnnnnnnnnctgaatattattatatcatagtattttcattggtattttataaaagcaaacttattatgtaaatgatcctgaacaattattatttttaaatgaatcaaaatttcagtttccaccaaacctttcaaacaacatttattctattgataatgatttaagcatgacttgcagaaaaataataaaggcgtagttatcttcttactcaaatttagatcagttttacaaaataaaaaggaaaaatgtcttcagaacatcccaagaaagcaggaaaacttgctcccctttcaccgcctccaattgttgatatatctgatgatgaattagtcactatttctgttagagatctcaataggcaattaaaactaagaggcctttctagagatgaaattgtacgcatgaaacaaaggcgaagaacattaaaaaatcggggatatgcagcttcatgtaggataaaaaggattgaacaaaaagatgaactggaaacagagaaaacacaggaatggaaggatatggagaatatgcaagatgatgtggtttcatatagaaatgaaatgaatgagatcaaagataggtatgaagctctgaaaaggtttgcagtgacaaataagattagcattccaccagaacttgaacaattgtagnnnnnnnnnnnnnnnnnnnnnctatgaatgatgtataattatttaagtatctatatacc

SEQ ID NO: 8483 - DNA, 849 bp, Diabrotica virgifera
  misc_feature (336)..(359): n is a, c, g, or t
  misc_feature (658)..(658): n is a, c, g, or t
gagcgtaggtagaatctgtttttctattaatcaaagcccttttgtgttgtgctatccgtttgtcaagggttctgccagttttgccgatgtgagtttttggacagctaccacatgtcagtactctgattctttttctttcggctcttattgttcttaatagtatttcgctgagttgttgtttcttctgaaagctggtgttgttcctttgttttttgtgtgtttgaccattttgaaatcttgcctgaatatgtgattgagctccgttttttctgtggtggtggaaacactaatttcgactttcttatgcagtttttggtgttcaatcttcacatgtcnnnnnnnnnnnnnnnnnnnnnnnngtgtttaatctcttattaaaacccttaactttaaataaatctcaagccagtcctgttcagtagcatacacccttacagacagacaataatacttggacacttggaatcgcgacaggagaaatctttctctttctcatcagccggtcgaacgatcaacaagtaccactcgccacgagggtgaaaccttttctcctctacgaccttttcgaagggtcaacccgggtaccgctcatctcttgtctgtccagcctttcttttgggctgaaaagaacaatagcaatacatacacggacagtaanttcgggagtgacgccatacacgatttcgcaacattcaaaacacgaggcacgtggtacggaaacagcaactcgtatgtgaccgtctcagtggtccggacagggttcacacttgatagactctttattactatcaataatgtctgtataaacctttatactcccactgaacagtaactaacaacctaatacag

SEQ ID NO: 8484 - DNA, 179 bp, Diabrotica virgifera
  misc_feature (2)..(116): n is a, c, g, or t
  misc_feature (118)..(158): n is a, c, g, or t
  misc_feature (160)..(178): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnannnnnnnnnnnnnnnnnnna

SEQ ID NO: 8485 - DNA, 297 bp, Diabrotica virgifera
  misc_feature (4)..(22): n is a, c, g, or t
  misc_feature (40)..(72): n is a, c, g, or t
  misc_feature (112)..(129): n is a, c, g, or t
  misc_feature (190)..(210): n is a, c, g, or t
  misc_feature (236)..(267): n is a, c, g, or t
ggtnnnnnnnnnnnnnnnnnnnaattttgttattgaaggnnnnnnnnnnnnnnnnnnnnnnnnnnnnnnnnntttatttaatctagaagaatctttattttaagttaagggnnnnnnnnnnnnnnnnnngaggagaaaaacctaaaaaaagtcataaatgattcactaggccacttgaagattaaatttnnnnnnnnnnnnnnnnnnnnncactcggggttgattacaacgtggannnnnnnnnnnnnnnnnnnnnnnnnnnnnnnnaacttctttggctccctttgaggtgcttac

SEQ ID NO: 8486 - DNA, 896 bp, Diabrotica virgifera
  misc_feature (143)..(165): n is a, c, g, or t
  misc_feature (192)..(250): n is a, c, g, or t
  misc_feature (258)..(286): n is a, c, g, or t
  misc_feature (339)..(371): n is a, c, g, or t
  misc_feature (380)..(414): n is a, c, g, or t
  misc_feature (421)..(442): n is a, c, g, or t
  misc_feature (444)..(460): n is a, c, g, or t
  misc_feature (717)..(750): n is a, c, g, or t
  misc_feature (756)..(780): n is a, c, g, or t
  misc_feature (783)..(814): n is a, c, g, or t
  misc_feature (846)..(881): n is a, c, g, or t
gggatagattattatatttttatagaatataattttgatggttgggagttgctctatgggggggattagtgaataatgatatagttattgttttgggatttattagagttttaaaattaggaattttattgaaaaatgatggnnnnnnnnnnnnnnnnnnnnnnntaatggttttggggtgtaaatatatgnnnnnnnnnnnnnnnnnnnnnnnnnnnnnnnnnnnnnnnnnnnnnnnnnnnnnnnnnnngttatagnnnnnnnnnnnnnnnnnnnnnnnnnnnnngtagggaagagattgtattattatttgatttttatataatatttaggatttgnnnnnnnnnnnnnnnnnnnnnnnnnnnnnnnnnggttttagnnnnnnnnnnnnnnnnnnnnnnnnnnnnnnnnnnngtaaagnnnnnnnnnnnnnnnnnnnnnngnnnnnnnnnnnnnnnnngtgggattagtaaattgtttatttagtagaaatttttaggttattaaaggaattagggaggttttttgtagtggttattaaatgatggctgtttgatggaatattgagtttcgtgtggctctgttttgtttgatgggcagtggattgtgggggggatggggagatttgattaagattgttttggatgttggatgaaggggggatgagagataggtgggttatttgtttattatgattttttttttatgtttaaatgnnnnnnnnnnnnnnnnnnnnnnnnnnnnnnnnnngagggnnnnnnnnnnnnnnnnnnnnnnnnnagnnnnnnnnnnnnnnnnnnnnnnnnnnnnnnnnttggggggggtttgggggtgtaatgttagcgnnnnnnnnnnnnnnnnnnnnnnnnnnnnnnnnnnnnggtttgagttttttg

SEQ ID NO: 8487 - DNA, 788 bp, Diabrotica virgifera
  misc_feature (618)..(708): n is a, c, g, or t
  misc_feature (718)..(749): n is a, c, g, or t
  misc_feature (772)..(787): n is a, c, g, or t
atttttgtttattgtggatgaataaatcatcttttactatgaatagctcatccttctatttcatggtaacttcctactcttgggagataatccttcagtcttataagacaatgattgatctgttgctgctggagaatctggggttattatttaacacttacatatatatgattttcatactcctttggataaaaaattcttactcctattgtctcatggataatatgaataatctatttgaaatgttacgatatacatctcccgatctatcaaattttttcagatccacatgaactttatttagtaacacttcctatgtaggtatatataactctatttcttctctggagaatctatggaaatagacgttatgaataagattattgtaatatatagatttctacgtacaatccagtgaccgtaatgatgctcatcttacatgatgtgatcaatgataattatatagtattatatttaattatcattgatatttaatatataccatatcgtctacaatactttaacagagtattgctgctattatttaatatagtgatattgatagtatgtatgtgagatagattatatctacttaagaatattgtgattttgctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctaatgcnnnnnnnnnnnnnnnnnnnnnnnnnnnnnnnntaatgaatggttgcatgaaattnnnnnnnnnnnnnnnnc

SEQ ID NO: 8488 - DNA, 834 bp, Diabrotica virgifera
  misc_feature (20)..(32): n is a, c, g, or t
  misc_feature (35)..(49): n is a, c, g, or t
  misc_feature (292)..(312): n is a, c, g, or t
  misc_feature (749)..(749): n is a, c, g, or t
attgctgtactgtacaatgnnnnnnnnnnnnnaannnnnnnnnnnnnnnagagagggagagatgctatgaaattataataatattctatagatttattctttcacaagaaataattcatatctataatatagtcataataaaccattaaatgttaagtacatataaatggtaaatatgcagggtaccaaaaagaaaactagaaatcacacaaatgtaagaaagtaccatggacttacctatactagggaacaaaaaatagttgcaacagtatggtaccatgaaaggcttttnnnnnnnnnnnnnnnnnnnnngttatgccaaaactttcgtaccagattcaatttggaatatccctcctataatactcttaagagatgggaaagaaagctgtttaaggatggaagtgagattataagcaacaagaaaaaaccaattcatagaagcgttagtagatgggtttatattccatatgtaaaagaatctttgattcgtaatcctgatatgtcattaatggctagagctaaatatcttggcattacacaagctacacttcacaccattttaaaatcagacttgaaggaatttcatttagctattttaacaaattttaaaacagaagatgtcgctgacaaggctgaagttgatgtgaagaataatgaaagcaaagatgataatacttaaaataatctataatcacattggaacatttatcaaaacaatgctttaattgtgctacactatcctatgntatttaaatacataattgattagttatttttaattatcactattgaacactatgctggaacaaccacgccaaatcagattttgac

SEQ ID NO: 8489 - DNA, 905 bp, Diabrotica virgifera
  misc_feature (40)..(62): n is a, c, g, or t
  misc_feature (399)..(411): n is a, c, g, or t
  misc_feature (414)..(426): n is a, c, g, or t
  misc_feature (428)..(441): n is a, c, g, or t
  misc_feature (519)..(540): n is a, c, g, or t
  misc_feature (769)..(782): n is a, c, g, or t
  misc_feature (784)..(797): n is a, c, g, or t
  misc_feature (831)..(831): n is a, c, g, or t
  misc_feature (847)..(870): n is a, c, g, or t
aataattgataaagtttcaggcaaaaagtgtaccatttcnnnnnnnnnnnnnnnnnnnnnnncagtgtgacttcaaaagtgacaccgattgagtggtggaaaagccaaaaaatattgatactaacattaatgctattgaacaacgtcacacagcctaagcgtcctcggctggggttgaaacaattttttgtcctttgggctagtgcagtcgatatttctaaacaggttgggtacagcaaaagccaccaaactggtgtttttataaatctatttttgtatttccgaacttggctattttgaatattattacgtttgaagattgtttttgttacattaactttttgtgtgtgtaaataaaaataaaagttgtcctaataattgttttcattgtttattacnnnnnnnnnnnnnggnnnnnnnnnnnnncnnnnnnnnnnnnnntatagttataatactttatatcaaataaacctggtttaagataaataaacctggtttaaaccaaaaaagcctggtttnnnnnnnnnnnnnnnnnnnnnnccttggtttttgccaaccctgctcacaagtagtgatgtaaaatttccgggaagattcaaacctcagaaagtttccgggaatattgaaaagtttcggaaacttatggaaatattgcatttttattcaaatgattataataaatgatacaaatcagtagttagctttacttttgtggtctactaactacagaaaaaatctgttaaaaattaaatgtccaaaaatacttacnnnnnnnnnnnnnncnnnnnnnnnnnnnnctctgaatatttgttattagttaatataatttanaaataaaaaagttatnnnnnnnnnnnnnnnnnnnnnnnngcagctatacactgcatagctaataatatgctctt

SEQ ID NO: 8490 - DNA, 867 bp, Diabrotica virgifera
  misc_feature (6)..(95): n is a, c, g, or t
  misc_feature (115)..(333): n is a, c, g, or t
  misc_feature (342)..(503): n is a, c, g, or t
  misc_feature (505)..(526): n is a, c, g, or t
  misc_feature (539)..(572): n is a, c, g, or t
  misc_feature (574)..(616): n is a, c, g, or t
  misc_feature (646)..(718): n is a, c, g, or t
  misc_feature (720)..(751): n is a, c, g, or t
  misc_feature (753)..(766): n is a, c, g, or t
  misc_feature (802)..(836): n is a, c, g, or t
ctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttaaaagagctaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnattcacctgctcnnnnnnnnnnnnnnnnnnnnnnnnnnnnnnnnnncnnnnnnnnnnnnnnnnnnnnnnnnnnnnnnnnnnnnnnnnnnncccgtgctaacgcagcataatccccttacnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncnnnnnnnnnnnnnncattttatccaattgttattaagtttttttacgacnnnnnnnnnnnnnnnnnnnnnnnnnnnnnnnnnnnggggcgcttaaaaaataagttttccttttct

SEQ ID NO: 8491 - DNA, 800 bp, Diabrotica virgifera
  misc_feature (2)..(18): n is a, c, g, or t
  misc_feature (20)..(62): n is a, c, g, or t
  misc_feature (70)..(537): n is a, c, g, or t
  misc_feature (717)..(717): n is a, c, g, or t
  misc_feature (730)..(730): n is a, c, g, or t
  misc_feature (735)..(735): n is a, c, g, or t
  misc_feature (762)..(762): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattagggatgtaatgcagaatcatattttacaaattctagctctagtagctatggaaaaaccagcttcagttcaaccagacgatataagaaatgaaaaggtaaaggtattaaaaagtatagctccaataaagctcaaggacgttgtgttgggtcagtacgttggaaatcctgatggancaggtaatgcganattgngatacttagatgatccgagtgtcctanagatctgttacaccactatgccttagccgttgtctatc

SEQ ID NO: 8492 - DNA, 608 bp, Diabrotica virgifera
cacaatgaaagtgattgttgatattgcttcccttattgtcgctactggagctttattaacaattaagaaacgcacagtctcccttgaaagcatgaaatggacatacatagaagaggagcacgaagagtggaggagtagctgtgcactaataaaggaataccgtgggacgggtacgaagatccttattctgtattgattattgatgaacatggtttctaccaaaggtacacttaagatggtaagactagcacaatacatacgcagctacttcaacgaacatggatggtcctgcttatgtgtttaatcaaaactgaaaaagccaatgtggacgcataagatgccctcacaatctcctgcataaaagaagtacgaggactgcgtggtcaccactcaagagtaaaacttcatgcaggatcgccagattacgacgtttacctaatgctaatccccctagacctacaccactccaaggatagttatcactaactcgataaccacatgtggagcctcccactcatgatactgctactgctgcttagatatatcatctcgaataggccaataattgaacagatagggatgcctattgcatgcgacatatatattgt

SEQ ID NO: 8493 - DNA, 787 bp, Diabrotica virgifera
  misc_feature (2)..(764): n is a, c, g, or t
  misc_feature (786)..(786): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaacccctatagang

SEQ ID NO: 8494 - DNA, 943 bp, Diabrotica virgifera
  misc_feature (745)..(745): n is a, c, g, or t
ggcacactgggggaaaaaccatacaagtgtgaaacttgctttaaacagttttgtacttcaagtgaagcgaaaagacattttttaagagtgcacactgtagaaaaaccgtacgagtgcgacatttgtttaaaacagtttcgtactacaagtgaattgaagtcacatttgagaacgcacactggggaaaaactttacaagtgcgagatttgttttaagcaatttagtcaaacatgtagtttgaaaaaacatttgagagtgcacacaggagaaaaacctcacaagtgcgagatttgttttaaacagtttaatgaggcaggccatttgaaaacacatttgagagtgcacacaggagaaaaacctcacaagtgcgagatttgttttaaacgttttagtagagcagttaatttaacaacacatttgagagtgcatactggggaaaaaccatacaagtgtgaaacttgcttaaaacagtttcttagttcaagtgatttgaaaatacattttagagtgcacactgaagaaaaaccgtacgagtgcgacatttgtttaaaacagtttcgtactacaagtgaattgaagacacatttgagaacgcacactggggaaaaaccttacaagtgcgagatttgttttaagcaatttagtcaaaaatgtagtttgaaaaaacatttgagagtgcacacaggagaaaaacctcacaagtgcgagatttgttttaaacagtttagtgaggcaggacatttgnaaacacatttgagagtgcacacaggagaaaaaactcacaagtgcgagatttgttttaaacgttttagtagagcagataatttaacaacacatgtgagagtgcacactggcgaaaaaacatacaagtgtgaaacttgctaaaaaagtttcttacttccagtgattttaaaatacttttgagagggcccactggggaaaa

SEQ ID NO: 8495 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8496 - DNA, 152 bp, Diabrotica virgifera
  misc_feature (15)..(15): n is a, c, g, or t
  misc_feature (21)..(41): n is a, c, g, or t
  misc_feature (78)..(78): n is a, c, g, or t
  misc_feature (85)..(113): n is a, c, g, or t
  misc_feature (115)..(115): n is a, c, g, or t
  misc_feature (117)..(150): n is a, c, g, or t
taagaatttattttntaagtnnnnnnnnnnnnnnnnnnnnnacgagagacctatagagtttataaaatattataagtnttttagnnnnnnnnnnnnnnnnnnnnnnnnnnnnngngnnnnnnnnnnnnnnnnnnnnnnnnnnnnnnnnnnat

SEQ ID NO: 8497 - DNA, 194 bp, Diabrotica virgifera
  misc_feature (7)..(44): n is a, c, g, or t
  misc_feature (70)..(70): n is a, c, g, or t
  misc_feature (77)..(100): n is a, c, g, or t
  misc_feature (108)..(130): n is a, c, g, or t
  misc_feature (169)..(188): n is a, c, g, or t
taacagnnnnnnnnnnnnnnnnnnnnnnnnnnnnnnnnnnnnnntgcgacctcgatgggtggattaattnataattnnnnnnnnnnnnnnnnnnnnnnnntgttcgannnnnnnnnnnnnnnnnnnnnnnagttaaaccggtgtgagccaggttggttctatcctttannnnnnnnnnnnnnnnnnnngaaagg

SEQ ID NO: 8498 - DNA, 827 bp, Diabrotica virgifera
  misc_feature (716)..(754): n is a, c, g, or t
  misc_feature (756)..(773): n is a, c, g, or t
tacttttttaactttattcaaatacttcctaggctcaatagagtctagcttttatattaaaagaaaaacggtaacctaaattctactaactatacaattaatttaataatagtggtgacccgccatgaaaatgaaatagaggcttctaagtatggttaaaattatttacaatgatagcacaggtattgtaacgtacgaggcaaaacaaatcaaaatttgttttccctcttctcttgtatattatactgcgactgatcaaatgaaaaggcacgaaacgtcgtaacaacttaaccgcaaacataattgcctatgccgttatgggataacgtagtgagacatccagggaggcaaatgtagccttcggattcgatcggggcattcccgggcgcccgcatgcgcaggagagaatagaggctcttataagagagccgtccaattgacgcgacagttcgtgtgagcacatcatggcgttcacattgcaaaattcgacgattgaggagcagcggggcgttatcaggtttctgacagctgaaggagttaaaccagctggtattcaccggcgtatgtataagatgaagactggtatttgccataaagacattagtgaccactgattgatttggatatccgcgggattttgctcgcgctaacgaacgataatcatcagcaattttagtggatgttgaatgaccggttgaatgacaaataatgtgccnnnnnnnnnnnnnnnnnnnnnnnnnnnnnnnnnnnnnnngnnnnnnnnnnnnnnnnnnatcataaaaccctattgaaaactattctactcattataaagtttttatagaatc

SEQ ID NO: 8499 - DNA, 656 bp, Diabrotica virgifera
  misc_feature (13)..(512): n is a, c, g, or t
  misc_feature (514)..(612): n is a, c, g, or t
cctttaagtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaattgatggtttggatgaaaataaacctgtctttatttaa

SEQ ID NO: 8500 - DNA, 638 bp, Diabrotica virgifera
  misc_feature (427)..(448): n is a, c, g, or t
gattgtgatggaatcgaatgatttagctacatctggtgaatgctctggcctaaacatagtgcttcgtaaatatctttgcgaccaaatagagctacaagattttcctaatctagaggacaaattaaaatatttggaaattcacttattgaactgttatatctgataatttaatcattttaaaacaaagatttcgagattttaaaacggcgatgatagagaaatggttaaagactcacgaaaacatgctgtatagtaaataaagattggttagttggaacatttaaaactgatagaaaacaaataaatggaaccaagtcggatttctaaattatttgagtcttttcatattaaggatatttaggaatgagcttgaaaatatcacgtttattactagttgttttttaaatcctaattaggaccaccacgnnnnnnnnnnnnnnnnnnnnnnctatttattcttatataccaccatttttattttttatcaatttttcactaaaatatagatttatattatttctatttattcccgatcgacaccaatataatcacagcagtgcatatttagcacagatatattagttttcccaaccggaactccttaacctttttttcccctcgcttattctcaaccttgt

SEQ ID NO: 8501 - DNA, 875 bp, Diabrotica virgifera
  misc_feature (162)..(185): n is a, c, g, or t
  misc_feature (344)..(369): n is a, c, g, or t
acccgtttggacgtactttaacactaactttaacaaattgttatcaaacgttgttgtttgataagctgaagttttgtttttatcgaaccttttgtcattcaatgtacttgtatgccggtaattattataagcgttgtttagttagttaagtagtgaattacnnnnnnnnnnnnnnnnnnnnnnnncaatggggcagatatttacgacaaaatgtgactctgacgtgagattggacggtaaaactgcagttattactggagcaaattgcgggattggaaaggaaactgccagagatttatatctaagaggtgctacagttatcttggcatgtaggagtgtttctnnnnnnnnnnnnnnnnnnnnnnnnnnaaagacacaatgtgtatgggaaaagaatgtacgacaactaaaagcaatagagctggatttatctcgattgaagtctgtaagagattgcgctgcaaagctgttggaaaccgaaaaagaaatcaacatattggtgaataatgcaggagtatttgcagttccttttgcgcttaccgaagatggcaacgagacaacttttcaggttaatcatttgggacacttcttgtttactttactgttgatgcctttacttaagaaaagtaccccagcaagaatagtgacagttgcatccagtttacatagtgccgtatggaatttagatttatccgatatgaaatgcgaaaagagaaaatatggcagcataaatgcttacaacgagagcaaagtgtgcaacattttgtttactcgagaattgcctcgaaagcttgaaagacacaatataaatggcataacagtatattcggtccatccctgtgctgtcaaactgatgccgcagatatctggattct

SEQ ID NO: 8502 - DNA, 665 bp, Diabrotica virgifera
  misc_feature (17)..(17): n is a, c, g, or t
  misc_feature (28)..(28): n is a, c, g, or t
  misc_feature (33)..(33): n is a, c, g, or t
  misc_feature (55)..(57): n is a, c, g, or t
  misc_feature (67)..(67): n is a, c, g, or t
  misc_feature (70)..(70): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (88)..(88): n is a, c, g, or t
  misc_feature (100)..(100): n is a, c, g, or t
  misc_feature (115)..(115): n is a, c, g, or t
  misc_feature (141)..(141): n is a, c, g, or t
  misc_feature (186)..(186): n is a, c, g, or t
  misc_feature (203)..(203): n is a, c, g, or t
  misc_feature (205)..(205): n is a, c, g, or t
  misc_feature (241)..(241): n is a, c, g, or t
  misc_feature (243)..(243): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (315)..(315): n is a, c, g, or t
  misc_feature (335)..(335): n is a, c, g, or t
  misc_feature (345)..(345): n is a, c, g, or t
  misc_feature (347)..(347): n is a, c, g, or t
  misc_feature (382)..(382): n is a, c, g, or t
  misc_feature (402)..(402): n is a, c, g, or t
  misc_feature (506)..(506): n is a, c, g, or t
  misc_feature (513)..(513): n is a, c, g, or t
  misc_feature (516)..(516): n is a, c, g, or t
  misc_feature (536)..(536): n is a, c, g, or t
  misc_feature (561)..(561): n is a, c, g, or t
  misc_feature (567)..(568): n is a, c, g, or t
  misc_feature (602)..(650): n is a, c, g, or t
tccttataaggccgagnctctggtatgngatgnggaaaaagacccttggttggannntaatgaaatnaangaaattggnaanantaantgaagaaagaanatttgtaagttgatnaaggatggtattattattaagaaggnagtagatgtatattggggtgggagtgttagtaaaaagattgaagngtggaggaaaggaaggnantggggttttggtaaaaggaagggtaatggtaatgtntngtagtgagaaaaggaattatggattgaatggatgagagttttgngtngtntatttaaaaaatatagggaagntaaaaagattgagagagatntatatgagtnantgtatatgaagggtaagggtaatgtatttaagaanaagtgtgtttttatggaatnatattagaagaagaaggtagagaaaggttgtgttaagatgttggtagattaggttaatggtagaaggatgaaggtaaaataggttagagaaagaagtgaggaangtattgntanaaagaaataagaagttttgnagaattagatgagggaggatgaagntgtggnnattaagaaataagttaattgttttataagatgannnnnnnnnnnnnnnnnnnnnnnnnnnnnnnnnnnnnnnnnnnnnnnnnggtggttttagagga

SEQ ID NO: 8503 - DNA, 846 bp, Diabrotica virgifera
  misc_feature (623)..(623): n is a, c, g, or t
  misc_feature (689)..(689): n is a, c, g, or t
  misc_feature (698)..(698): n is a, c, g, or t
  misc_feature (725)..(726): n is a, c, g, or t
gatgatttgtactcgaaggatccttccaagtgtctcgcatctattgtctgtattaaaaattcagtgattggctcgaaccgccaaaaggaaagtgttatagcccaaggaatagtaccaaggcttctatttctgttgagagacaaaggcacgaagacaaatgtgcgtattgaagcagctgtaacgattggatctcttgccaaaggtactgaagaccatgtagaacttcttatcaattctggaactagtcaaattctgttagaagtacttgaagaaaacgagcccagattaatagatgcgtgtctgtgttgtctacgtacattgtcccagcattccatctcgtccgatgtcaaatataatgtaaaaaatctacagaagttactaagtttcgctggtcccaaagataccctccagcgccaatcatgtgttgccaatattataacgtctgcatgtcgaggacctgctgaacaaaatattttatgctcgataggagctcctgcaactttagcctctctactgtctgtccaaaactattccgttactatacctattgtaacctgtctagctacgatgtgttttaataattctgtggtagctggtgttatagtgaatactagttgtaaggngatcagaattccagattatcttgaaatactcatatctagagatagacctattgatatgcagcttgnggctgctanatgtcttacaaatttgtatagagctgnngccatatcagcatatgatccaatcattacctatagaacccttccatgtctagtacgattgtgccagattgaacatcaagaaactcatcgagctgcagcagcagatactttggcttatttg

SEQ ID NO: 8504 - DNA, 923 bp, Diabrotica virgifera
  misc_feature (88)..(105): n is a, c, g, or t
  misc_feature (808)..(825): n is a, c, g, or t
  misc_feature (869)..(893): n is a, c, g, or t
atcaaaataaagaattgtcattttctatttttaaattctcgcaaaattcaaacaaacgtgtacagtttgttaatcattaagttttagnnnnnnnnnnnnnnnnnntatcttatttctttaccaagaattaattcgttattaactttgtcttgcatttgtggggccggtttgtcattgtatggttattacataggactagaattggaaagaaatgagaattataaacctatgtgtgatattaacccacaggttagctgtagtaaggctatgacatctaaatatggaaaaggattgggcatttttggagaagattcacaattttacaaaccaaacagtttatttggaataatgttttatagtatgatagctaccttagttcaatccaactcaaaattcatcgcctgggtgtcactggtattgatagccttatcaaactttttatccatttactttgcatacatactatactttgtactttatgatctatgcattgtatgcgtagctatttatgcagtaaatgtaattaatttattattgatcaaattaaaacttaaaacaattgatgccatcagagagcaagaagaggaaaagaataaataaagttaggtattgctttcttactggcttcatgtataccggcctttactacaagattcgttgcaagtaattggccagttattttattttgtagtagagacataaggaatctcgaaaattataacaaatattttcttcacgtgtatacagtttgcaggcagaaacaaaagtaaaaggcactactaaaaaatagtaaattttttctgccacnnnnnnnnnnnnnnnnnnctgggtaatgtatcagttttcatgagatgtcatttaatatatgnnnnnnnnnnnnnnnnnnnnnnnnncaatgtgccaaattgaaataaaacacaaaa

SEQ ID NO: 8505 - DNA, 373 bp, Diabrotica virgifera
  misc_feature (3)..(3): n is a, c, g, or t
  misc_feature (8)..(47): n is a, c, g, or t
  misc_feature (55)..(55): n is a, c, g, or t
  misc_feature (62)..(64): n is a, c, g, or t
  misc_feature (66)..(108): n is a, c, g, or t
  misc_feature (110)..(110): n is a, c, g, or t
  misc_feature (118)..(141): n is a, c, g, or t
  misc_feature (168)..(204): n is a, c, g, or t
  misc_feature (297)..(357): n is a, c, g, or t
tanattannnnnnnnnnnnnnnnnnnnnnnnnnnnnnnnnnnnnnnnatttattntattggnnngnnnnnnnnnnnnnnnnnnnnnnnnnnnnnnnnnnnnnnnnnnntnataaattnnnnnnnnnnnnnnnnnnnnnnnngaaataattaccttaggggataacagnnnnnnnnnnnnnnnnnnnnnnnnnnnnnnnnnnnnnggcgacctcgagtttggattaagtttttaatgggggagcaggttaattattaaacttgtccactttaaaattttcctgatttggggttaaacnnnnnnnnnnnnnnnnnnnnnnnnnnnnnnnnnnnnnnnnnnnnnnnnnnnnnnnnnnnnncggggggccccgcaga

SEQ ID NO: 8506 - DNA, 883 bp, Diabrotica virgifera
  misc_feature (4)..(807): n is a, c, g, or t
  misc_feature (813)..(881): n is a, c, g, or t
tccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnaa

SEQ ID NO: 8507 - DNA, 178 bp, Diabrotica virgifera
  misc_feature (26)..(65): n is a, c, g, or t
  misc_feature (69)..(94): n is a, c, g, or t
  misc_feature (104)..(172): n is a, c, g, or t
gagggttggatggaaaaaaaactggnnnnnnnnnnnnnnnnnnnnnnnnnnnnnnnnnnnnnnnnaccnnnnnnnnnnnnnnnnnnnnnnnnnncccataaagnnnnnnnnnnnnnnnnnnnnnnnnnnnnnnnnnnnnnnnnnnnnnnnnnnnnnnnnnnnnnnnnnnnnngggggg

SEQ ID NO: 8508 - DNA, 786 bp, Diabrotica virgifera
  misc_feature (108)..(127): n is a, c, g, or t
  misc_feature (169)..(197): n is a, c, g, or t
  misc_feature (232)..(251): n is a, c, g, or t
  misc_feature (280)..(310): n is a, c, g, or t
  misc_feature (312)..(462): n is a, c, g, or t
  misc_feature (464)..(567): n is a, c, g, or t
  misc_feature (569)..(656): n is a, c, g, or t
  misc_feature (663)..(689): n is a, c, g, or t
  misc_feature (752)..(767): n is a, c, g, or t
  misc_feature (769)..(782): n is a, c, g, or t
gccccccttgcggccgttcgaataatagtatttattaataatatactacatgttagtaaaggataagaaatgttatctatactgatatctaattcgtaatgagagagnnnnnnnnnnnnnnnnnnnngaaaaagtgatatttgtacctcgcgtatcccggattattagnnnnnnnnnnnnnnnnnnnnnnnnnnnnnattaaacgagctaaagaattagaatttatatagtnnnnnnnnnnnnnnnnnnnncgtttttgtagtgaaacggtattcgttgnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnngattacnnnnnnnnnnnnnnnnnnnnnnnnnnncaattcgatggccgcggcattttgcccgtgctaaggacgctactcactaggttttttattgcnnnnnnnnnnnnnnnncnnnnnnnnnnnnnnctgc

SEQ ID NO: 8509 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (156)..(156): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggntggttnnnnnnnnnnnnnnnnnnnnnnnnnnnnnnnngaaagg

SEQ ID NO: 8510 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8511 - DNA, 993 bp, Diabrotica virgifera
  misc_feature (164)..(184): n is a, c, g, or t
  misc_feature (278)..(306): n is a, c, g, or t
  misc_feature (929)..(929): n is a, c, g, or t
aaacaaagtggtttcattttaaatccaattttaaaatgtctttatttagaaaacccaagaaaactatacaacgtagagtttttacagaaaatgacgatgaagatgatgatgtcacacaaccaatggaagtttgtcaatctattccagttgaaaagaaatctaannnnnnnnnnnnnnnnnnnnnaacaccaaaaactttactaagttttgatgaagaggaggaaggagaagtttttcaagttaagaaatcgtctcacagcaaaaaagttttacgtatnnnnnnnnnnnnnnnnnnnnnnnnnnnnnctaaacaagaaaaggaagaaatcaaatctaaagaaaaaactgagattgtaactgatgattttgtgttagtggttaatgctagccacaaaaaacctccaacacctcctctaattcttagtggaagagatgctctatgtgcaggtaaagatgacctatcctcagaagaagatgaaccacagaatcataaatttaataaacctgataactttaaaaggattttagaatctggtgctattcctgatgcagcaatgattcacgcagctagaaaacgtagacaaagggcaagagaactaggtgactttatacccacagaagaggaagaacctgaggataaaggcaggttgttaagggaagatgaacatgaaggtagtgatgaagaaagaattgacatggagataaacttaaacttaagagatcaggagagaagacgagaacagtttttagccgctcaagaatcagaccatgaagttttagaatgggaagaccaacaaataagaaaaggtgtaaccggagctgcaatggaagctgcgagggaaatgttttatccagtggagcctccctctcctccgcgcatatctgccccaggtccattcatagaacctggtattccagaactccacaantgattgctgaaaaattaagagaacagtatgaaaaggtaaaatcatcagagcaaatcatgaagcc

SEQ ID NO: 8512 - DNA, 236 bp, Diabrotica virgifera
  misc_feature (196)..(226): n is a, c, g, or t
aaattaccttaaggaaaacaggggaatttttttgggaaaggtcaaatccaaaataaagaatgggaaccccccatgggtggattaaagtttaataatggggggaagcagctaatattatttaaggtctggtccgactttttaaaatttttacattgatctggagtttaaaccgggggggggccccgggtgggtttcnnnnnnnnnnnnnnnnnnnnnnnnnnnnnnnccaaaaggac

SEQ ID NO: 8513 - DNA, 749 bp, Diabrotica virgifera
  misc_feature (2)..(63): n is a, c, g, or t
  misc_feature (68)..(744): n is a, c, g, or t
cnnnnnnnnnnnnnnnnnnnnnnnnnnnnnnnnnnnnnnnnnnnnnnnnnnnnnnnnnnnnnncctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 8514 - DNA, 831 bp, Diabrotica virgifera
  misc_feature (184)..(208): n is a, c, g, or t
  misc_feature (395)..(426): n is a, c, g, or t
gcgatattatgtttatttttgtcttatgtttgtttggaactattttattagaaatcactaaatttttggattttacctgtgactagggaacattgttatataaaggtatttttatgtaggtattttttctataaattcctgttactgtaaaggaaaaatcaataagttgtaggttcatatcacnnnnnnnnnnnnnnnnnnnnnnnnngatgtttatattaaataccgatatagttcgacgttcagatgcttcctgctcggatatacaaagaaatgagcaattaagaaacgaaataaataggtataatatagaggagaataatgagaagggaaagtgatgcatttactttaggagtttgtagatctatttatatcaacaacagacatagtgaacnnnnnnnnnnnnnnnnnnnnnnnnnnnnnnnngatgtttatattaaatactgatatagtttgacgtttagatgcttcctgctcagatacttggtcatatacaaagaaatgagcaattaagaaacaaaataaataggtataatatagaggagaataatgagaagggaaagtgatgcatttactttaggagtttgtagatctatttatattaacaacagacatggtgaactatttttttgagagtcttatacctcataatatgtcataatccgttcatccaagcagtgttgagccttcactgccaatttttgcctcacttatttttatgcaataagttcctatcaaagagtagtcggtcagagctatcagttatttttcgtccgctataacttttcccatgtgtagcgattcattttcagaccaattgagtcaaaacat

SEQ ID NO: 8515 - DNA, 60 bp, Diabrotica virgifera
  misc_feature (11)..(48): n is a, c, g, or t
ctatagagttnnnnnnnnnnnnnnnnnnnnnnnnnnnnnnnnnnnnnnatttatataata

SEQ ID NO: 8516 - DNA, 869 bp, Diabrotica virgifera
  misc_feature (127)..(147): n is a, c, g, or t
  misc_feature (316)..(332): n is a, c, g, or t
  misc_feature (856)..(856): n is a, c, g, or t
gatctcactagtgttaacttgttatgtttactgttatttgtttatgctaatttttatcaaaatcatccgcacacgttttgataacaattgacatacctttcatactaacatgattttgtttgagtgnnnnnnnnnnnnnnnnnnnnnccagaatacttcacatgctcttgcactctttgacaaaatcctgcaaaaatccccgtcctcacccagagctttgtatggaaaagcactaacattggatctactagctgaccaaaggagaagcaacgacatattggagaaagctcttcagttgtacataaccctgttaaannnnnnnnnnnnnnnnncagccctctttcttgaagcatccgaaagatgtatcaacaggatgagattcttaggtcagtacagaactgctcttcaaatacacaagttggttatagacaaatttccaaatgctcctcaacatttaaatagtttagctgttacatatttaaccattaataggattgaagaagcacgaagtgttttaaaggaagtgttggcaaaatggcccaataacggttttgccttggtacattatggttttattttgaaaactacagataatgcacttgagaaagccgtacggtatctgaaaaaaggaattaataccaaagatgaaggagtgatagatggcagattttatttccatctaggtgacgctcttgttcgtttaggaagacgggaggaagccgacaaggtatacgaagaaggtactaacaacaaagtgtttttttcaaatatcaaagatctctgtacaacgtacccaaactatctggtaaaccatggtggaaccctgaagacattccataccccaaattcttcaatnttgtacttcagtc

SEQ ID NO: 8517 - DNA, 875 bp, Diabrotica virgifera
  misc_feature (5)..(674): n is a, c, g, or t
  misc_feature (681)..(718): n is a, c, g, or t
  misc_feature (738)..(751): n is a, c, g, or t
  misc_feature (754)..(776): n is a, c, g, or t
  misc_feature (784)..(806): n is a, c, g, or t
  misc_feature (836)..(867): n is a, c, g, or t
cgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggga

SEQ ID NO: 8518 - DNA, 1122 bp, Diabrotica virgifera
  misc_feature (36)..(60): n is a, c, g, or t
  misc_feature (68)..(178): n is a, c, g, or t
  misc_feature (191)..(675): n is a, c, g, or t
  misc_feature (694)..(694): n is a, c, g, or t
  misc_feature (699)..(745): n is a, c, g, or t
  misc_feature (749)..(768): n is a, c, g, or t
  misc_feature (773)..(811): n is a, c, g, or t
  misc_feature (814)..(901): n is a, c, g, or t
  misc_feature (905)..(926): n is a, c, g, or t
  misc_feature (1000)..(1026): n is a, c, g, or t
  misc_feature (1029)..(1082): n is a, c, g, or t
gatagttaatcagtatcgtgagagaatatttcattnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaatggaagggttggnatgannnnnnnnnnnnnnnnnnnnnnnnnnnnnnnnnnnnnnnnnnnnnnnaaannnnnnnnnnnnnnnnnnnncgagnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnntaccccttggaaacaacggattttttttttgtgggggcacccccaaataaaaatgcggccccccccccttgggnnnnnnnnnnnnnnnnnnnnnnnnnnnccnnnnnnnnnnnnnnnnnnnnnnnnnnnnnnnnnnnnnnnnnnnnnnnnnnnnnngtgttttaaaaccgcgcggggggcggggcggggcgggggg

SEQ ID NO: 8519 - DNA, 347 bp, Diabrotica virgifera
  misc_feature (2)..(157): n is a, c, g, or t
  misc_feature (159)..(196): n is a, c, g, or t
  misc_feature (201)..(239): n is a, c, g, or t
  misc_feature (243)..(337): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnttggnnnnnnnnnnnnnnnnnnnnnnnnnnnnnnnnnnnnnnngtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggga

SEQ ID NO: 8520 - DNA, 442 bp, Diabrotica virgifera
  misc_feature (2)..(419): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgaacatcagtcatttaaatt

SEQ ID NO: 8521 - DNA, 188 bp, Diabrotica virgifera
  misc_feature (5)..(36): n is a, c, g, or t
  misc_feature (38)..(162): n is a, c, g, or t
  misc_feature (165)..(179): n is a, c, g, or t
atatnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnaacagaaga

SEQ ID NO: 8522 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8523 - DNA, 876 bp, Diabrotica virgifera
  misc_feature (154)..(172): n is a, c, g, or t
ttttaatctgagacatattgtaatggaaaccttaaaaatacatttgtaaagaatatcaacccctccatcactttttatattgcagaaaagagcaaaatgataaatatttttgataaaataatctcaacatgtacaaatttaaagcaaaaacatnnnnnnnnnnnnnnnnnnnctatacctcgtttaacataattaaataaaacaagtttttggtaacaggatttgacacaacttgaccattgcagtttctttaagagatttgtattggatgttttgtgtattgcaatattttttgcctctgaagagacctaaagcggactcgtacaccaaagcaatatcccacagagatcacatataacatacattgcggaatgatatgcagtgagcggggttaaaaggacgtccatcaagttagcagaacaaagtcagcagaacacagttattcttataccataattaagtgtaaataagatgcaaatttaatgttccaagaaaaaatttattgctctttttttaaaaaagttatcgcatgttctgctaacttgataatcaagctagcagaacaatagttcaaaaatttgataaatcatttataattgaatgccaaagtattctctgaattaaatgcaaatttaatgttccaagaaaaaatttattgctcttttttttaagttatcacacgttctactactaaaatctactatattttctacatataattggtttggagaatttttaactggccgttagtacaggaagtcgttaacacaggttttactgtatatacatggcttacaaaatctactgatttctactgattctttgaaagaaaaccattgaagaaataaaaactaacctggcaaccctgctcactgc

SEQ ID NO: 8524 - DNA, 586 bp, Diabrotica virgifera
  misc_feature (5)..(512): n is a, c, g, or t
  misc_feature (519)..(556): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgaccctcgatgatggattaaagttata

SEQ ID NO: 8525 - DNA, 204 bp, Diabrotica virgifera
  misc_feature (137)..(193): n is a, c, g, or t
tacagcgtaattttattgggagagtcaatcgataataagatggggaacctcgagtttgggataagttttataatgggtgagcatatatttttttaagtctgtccacttttaaaatttacatggtctgagtttaaacnnnnnnnnnnnnnnnnnnnnnnnnnnnnnnnnnnnnnnnnnnnnnnnnnnnnnnnnngaaaaaggacc

SEQ ID NO: 8526 - DNA, 104 bp, Diabrotica virgifera
  misc_feature (14)..(40): n is a, c, g, or t
  misc_feature (57)..(79): n is a, c, g, or t
taattttttggatnnnnnnnnnnnnnnnnnnnnnnnnnnnacctttagggatacagnnnnnnnnnnnnnnnnnnnnnnntcgatataaagattgggacctcgat

SEQ ID NO: 8527 - DNA, 940 bp, Diabrotica virgifera
  misc_feature (738)..(738): n is a, c, g, or t
  misc_feature (795)..(816): n is a, c, g, or t
  misc_feature (821)..(821): n is a, c, g, or t
  misc_feature (894)..(933): n is a, c, g, or t
agccacgtcacttaaaagaagtcagaattccaaaataatattgtcccaaaatgaatattttcagacttacaggagatttatcccatttagtggctataattattcttctgcaaaagatttggcatacgagatcatgtgcaggtatatcaggaaaaagtcagatcctctttgctatagtctatactacaagataccttgacttagtgacgtcatatgtatctatgtacaacactgttatgaaatttgtatttttggccacatcgtatgcaactatttatttaatctacatgaaatttaaagccacttatgaccataaccatgacacattcagaatagagtttctcattttaccatcgtttggtttggctatgcttatcaatcacgagttttcatttatggaggtcttgtggactttcagtatttatttggaatcagtggctatattgccgcaattgttcatggtcagtaaaacaggagaagcagaaagtattacttcccactacttattcgcactgggatcttatagggccctatacattttgaactggatctaccgctatgcaactgaaactcattacgatctcatcgctatagtagctggtgttgtgcagactatattatattgtgacttcttttatctttacattactaaagtactcaagggaaagaaactacaattgcccgcttaaacccctcttatataagacttaactgtacaaacattttactttcagctanacggtattaacacaatgatgcctaatgatcatgtgtttggatagcaatcaatatccnnnnnnnnnnnnnnnnnnnnnncgttnaccatttcgtcagaaattcaaatatataggattagaattaatagttttgtacaatttcgttcataataccagnnnnnnnnnnnnnnnnnnnnnnnnnnnnnnnnnnnnnnnnccgctct

SEQ ID NO: 8528 - DNA, 707 bp, Diabrotica virgifera
  misc_feature (507)..(542): n is a, c, g, or t
  misc_feature (704)..(704): n is a, c, g, or t
cgcgctaataaccggcaagatggatcaagggatggaaaacataacacattgcgaaacaaggagagatgagactagtggagatggtggagtagctagggaagttcagaagcatccacttgttaaggaaattgttcaggttgagatcgacgagaaagtggtaaatgcaagcaaaaaacaccttcctttcatggccaaaggtttcgattccgccaaattaacgttaaagatctgtgatggatttgaatatatgaagaaacacaaaaatgaattcgatgttattataactgactcttccgatccaattggacctgctgtgaatctctttactgaatcgtattataaacttgccaaagaagcacttaaaccaaatggtatcatcagttgccaagctggaactgtctggtctgatctaccacacgtcaagaaaaccctcaccaattgccgcaaacattttaaaacagtaagatatgggttttcaaccattccaagctatcccgatgggcaaannnnnnnnnnnnnnnnnnnnnnnnnnnnnnnnnnnnacctaagaactccaaaattcaagtttactcaagagcaacttgataatctcaacttgagattttacaatgatgaaatgcattcagctgcttttgttttaccaaattttgtaaagagagaattaagagaattagctgaataaataaattgttgtttttctttgngag

SEQ ID NO: 8529 - DNA, 905 bp, Diabrotica virgifera
  misc_feature (8)..(644): n is a, c, g, or t
  misc_feature (784)..(808): n is a, c, g, or t
  misc_feature (834)..(862): n is a, c, g, or t
gctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacttctttaagagcggttttccggactgaggcattaggcgcctccgaaaaagtttcatgaaccggggttaaaacatcttttattggaaaggaaaagaaagtaagccctttggtccaggcaaaaattaaattaatcannnnnnnnnnnnnnnnnnnnnnnnngaataatggaaaaaaaaacacgggtnnnnnnnnnnnnnnnnnnnnnnnnnnnnncgccctaaaaagaacccaaagtttaacgaaaccggggcatggc

SEQ ID NO: 8530 - DNA, 817 bp, Diabrotica virgifera
  misc_feature (108)..(130): n is a, c, g, or t
  misc_feature (510)..(510): n is a, c, g, or t
tgatgaataacattgctagttgtttaagtacctaacttttttattatccaacataggcgaatgaatcaggaagcggaatgttaagaaagcctattgctgcagttgagnnnnnnnnnnnnnnnnnnnnnnncgctggaatattccacagggtgttccaggctttgaggaaggagcgaactatcattgttacacccggtatacagtgacacttgcctctttagcaatgatattattaggtcgatatccttggggagtggagctatgatatactgaaaaagtcactcaaatcggacaacaggtttatgaagtgcgagacatcaaggatgtcccatttttggggtggtgcgttaattttgatgcttagtgtacctttcgaacaaattttttcctgacaatcacaaatttcattaaaaattaggtgaaggtagaaggtagttttatatgtatacaacaatctctactgactgaatttcttggcccgagcctttaactatttttttgaccgcctanaaattgagctttttgcttcattagtaggaaaacacacgttgtcgttaaggatttctctcatctgtttggttactctgcagtattagtactcaactgattattaaaatagaacctaaattttgagcgtttatggaggcctttagatggccgagagctaaagttgtgggcagttttaattttaactttaatctgacgtatcaaatacgtttattcgttattcgtctttccgtaggttatcttatggagtgacgcatacttgttcgctttatactgccagcagtactagcgttcacgtatttaatccatc

SEQ ID NO: 8531 - DNA, 898 bp, Diabrotica virgifera
  misc_feature (783)..(783): n is a, c, g, or t
gtgctgtgttttgaaaatattgttttagattttatatgagtctcagtaattatatttttggtgatattaattaagaatgtcagaaactgccgttgtggtaaaagccaaaccagaaaggaaagtatttaaggctacgaaagttacgaaaattccacaatccttgttgaacaatcctaaacttcaatctgctattgaaggtttgcctaaaaactataactttgaaattcccaaaacgatatggcgaattcaggaattaaaagccaagacggttgctttacaaatgccagaaggtcttttgttgttttccaccaccatagcagatataataaaggagttttctggagctgattctatcataatgggagatgtaacatatggagcttgctgcatagatgaccttactgctaaagctttaggagttgaattactagttcattatggccatagttgtttagttcctgctaaccaaacgtgtggtataaaagtcttatatgtgttcgtagatataaaaatagaccccttgcattttatcgaaacagttaaattaaactttaagaagactactaaaataggcttagtaagtactatacagtttgtaactaccattcaagcagcagctacaagactcaaagaaatggaatatgatgtctcaattccacagttcaaacctttatctccaggagaaattctcggatgtacagctccggtcttgaatggtgccgaagttcttatatacataggtggatggaaggggttcatctggaagcagccatgattgccaantccaggggttcagcttacaaatatgatccatattccaaagaatttactagagaatattatagccacagtgatatgggaaaaattaggcaaagtagtatacaggaagcaactaaag

SEQ ID NO: 8532 - DNA, 364 bp, Diabrotica virgifera
gtggcgattctacaatacctatagccgcacagaggtctgactgtttaacgcccaccaaaacagatcgccagacgcggcgacatttttagagatcacaagctacatttaccgggctggaggccatgggatgttgaagtaatgataatacgtagatttcattctgatgtcagagaggaagagattatggtcatgtttggaggatacgatatcttgagttttttgttcctgggagtatggaattgggtatgaggtaactctaggttgatgatgatggaaactgtttatggagtgcacaggaagagagagctaagtgtacgaggtattttgacgtaatgaatggtatggttatccgcatcatgagatg

SEQ ID NO: 8533 - DNA, 783 bp, Diabrotica virgifera
  misc_feature (144)..(166): n is a, c, g, or t
  misc_feature (345)..(363): n is a, c, g, or t
  misc_feature (691)..(711): n is a, c, g, or t
gaaatatgcggttttcgcagaaatgttttattttagtaacagttttgtctgaagggatttcattttttatatcgctttcaaatacgaaaaaatggcggatttttgaaaaaatcattgttgactttttttaatagaacacccagnnnnnnnnnnnnnnnnnnnnnnntgccattcgcgtatccagcgatgtagtgtttttcaagattggttgtcaaaccactgagtgattgatttttagggtgagaggtgcaacgtgggtgtcacataacgatattatgttgtgtgatttccacattgcatctctcattttaaagattaattattgctcactaatttgacagccgnnnnnnnnnnnnnnnnnnncgctggatgggtgaatgaccgttttttcaagtataaaaaatggcgaatttaaaaaaaaaacgttgttgacttttcttattataacacccagtatatttttttataacgtgagaaaacggtcatttgcgtatccatcgatataaaaatttaaagtaaaaattacagtgtggagacctagagcagacagaagaagtagaggtagaccacctacacgatggacagacgacgtcaaaaggattgctgggaattggttgcagaaagcccaagaccgacaaaattggaagaaattaggggaggcctatgttcaactttggatgcagaaggctgnnnnnnnnnnnnnnnnnnnnncaattttaaagtctcgggttatggagtcctctgcatgtggcctgcccatcatagtcgctgtgatttaattta

SEQ ID NO: 8534 - DNA, 847 bp, Diabrotica virgifera
gtgtcattcaggcaacctccggctctgtttgctatattcactcgatcttccacttctgtttcaagcttttcgtaactagatagtgtgatgcctagatatttaaactccatcacttgttctagtatctcaccctccagctccaagcttaaataatccaatcttattggatcatcatcatcaatggtgctacagccctatgaaagagcttcgaccttcccaagtctattacgccagtcagttctatccattgccaaccgttgccagtttgctgcgcctatttgtctcccatcctcatctacaccatccttccatctgagttttggcttacccctatttctacttcccacaggttgtgatataaggattattctaggagggttgttctgctgtgatcttgctagatgttctgcccatcttagtctccctattcttataagagatactacgtcattaccaccaaatttttgtttatatctgtggtataccatacctcgtagttgtacctcggaaacaccattttcacagatgccacggaatattcccctcaggatccttcgttcaaatataagcagaaggttttcatctgcgttggagatggtccatgcctctgatccatatgtcaacactggttgtataagggttttgtatatggttatttggtataccgattgagaaatttctcatggttggtgtgcgcatttaatgagagcgacaaagagacatgtatttattatacatttaaaacgggctggaagatatacgccggcaaagcgaggtagcgcgaacaaccacttcatgccgaaagtagggctttctcagcacagcgttgccaaagaaaatttaaaaa

SEQ ID NO: 8535 - DNA, 949 bp, Diabrotica virgifera
  misc_feature (44)..(58): n is a, c, g, or t
  misc_feature (921)..(921): n is a, c, g, or t
gacgattccaacaaatattattttgttgctgtgtttaatatttnnnnnnnnnnnnnnngacgcagttaatgattgtaatagtgaactagtggctcttgtacagatatttaggcatggggagaggtcacccatcacattttactcaactgatccatatgcaaatgcagcttactgggaagatcttggcggtgagctagctaaccgaggaaagcgtcaacatgaagctcttggtcaacacacgcgaaatgtatattctgatttccttcctacaagattcaattccaatgtattatacgctactacaaccgacgtacacaggactcacatgtctggccagtgcaatctttatggtatgtttccagcagtaggtaacaacatctggaaggaaaaccttaactggcagccgattccgcttcatcaagcagatccatatatatttaatggaaatccagttgactgtccaaactatgacctagtgtatgctgacttgtggctgcggaaaccatatgcagcgcttttaaacaaatatcaaagtgtgtttgaatatctaactgaacatactggtgataatgtaacagattttttaagcgctctcacagttcatgattgtttgctgatcgaagatggtgttggttatgaactccctgaatgggctagtgaagtctatcctgaacctttagcaacaatagcagggattggctataagtctttgactgatacacttgaactacaacaattttattgtggaacactcgtcaacgacatcgtagaataccttgatgctaagatctcgaacccgctggatgtagagcaatatcgaatatacagcggacatgactccaatattgcagcgctcctaaatactttcggagcatttgatgaaccctattccccagctttttgcagtaccatttacattgnattaagacagcgcgaatccgacgacctc

SEQ ID NO: 8536 - DNA, 864 bp, Diabrotica virgifera
  misc_feature (5)..(30): n is a, c, g, or t
  misc_feature (616)..(616): n is a, c, g, or t
atacnnnnnnnnnnnnnnnnnnnnnnnnnngttttagtaacatattgataaatcttgttatagtcttttcaatcccaatctcattccattaacaggcattaaattaaaatttctcttcattaactgcggaggaataagtgtatctgcaatcggtactatctcaaagtgatgcaggagatgtgaaaacaatgccttcatttcaagcaacgcaaatctggatcctatacagttcctgggacccaatccgaaaggaaaatacgtatactccccgattttttccttgttctcgtcgctgaatctttctggatcgaatcgttctggatctggaaagtatttggcatcgtggtgaatcgacataatgggtagaacgagaatagatcctttttccacgattaatggcttttcatccggactttctggttgtattacatattccttgctacattctctgtcaataccaggaaaatttggccactttcttaaacattctgaaataaccatatccaagtacttcattttcatcaacacttcgtatgtcatttttcctttaccttcttcaaatcctcggtcaatttcttctctcaatctggattgaaatctgggatgggttgctaanttcgtgtgctgcgaagcacatagtactggaaactgagtcaaaaccaccaaagaagaatatcaaggcgtgagcggtaaatcttcgtttgtgatttccttagaatcttgcatgtgttttcctggtagatgttcttgaactgtgtaaaacccctcatcgactccattttgctcatctttatgctgtataccccttctttgcttcaattaaaaaattcaacatatcagggctgaacattgtttttttcttcc

SEQ ID NO: 8537 - DNA, 887 bp, Diabrotica virgifera
  misc_feature (652)..(652): n is a, c, g, or t
  misc_feature (662)..(662): n is a, c, g, or t
  misc_feature (671)..(671): n is a, c, g, or t
  misc_feature (869)..(869): n is a, c, g, or t
cagacagggttgtgtgctatcaccgataatgtttaacgtctaggtactcagagataatatttgcgaatgctttatagcactcttcagaaattgtcagagtaaacggacaaagagtaaataacatccgctatgcagatgacactgttttattgactgattcggaccatagtcccctgatactgttaaatagtgtcactgggagttgttaaaatatggaaatgaagatcaatactgagaaaaccaaagttatgaaaatatcaaagaacaaaaatttacccgttccaatatgcgtgaaccaccaacagtttgaatacgcagaccaatacaaatatcttggctgctggttttaataatcaacttgattataaacaagaagtaagggcgagaatagaagtagtccgataaggctttatcaaaatgaaaagcttactttgtaacagtaggattaatatcagtcttagatgtggttttctgcattgctatgtatcgttactcttgtatgtaatggaggtctggaggctcaacataacgctgatgaacaagttagaagcctttgaactctggcttaatagaaggattttgaaaatatcttggataacccacaccaacgaaaatgtcctgaggagaataggtatagataaagagctgctanaggtcttcanagttagaanatatagctacatgggacacataatgagaaacgaaaaaagtaccgcctcgcgcaactgatcatccagagtacgattggccagatactggattgatcagatactggactggactttattcacatctttgttagagccgcatagacatagacagatttatacttattgtcgtgattagatgacagattgatatacatattnaagatttctattaacggc

SEQ ID NO: 8538 - DNA, 676 bp, Diabrotica virgifera
  misc_feature (6)..(41): n is a, c, g, or t
  misc_feature (48)..(85): n is a, c, g, or t
  misc_feature (105)..(118): n is a, c, g, or t
  misc_feature (121)..(143): n is a, c, g, or t
  misc_feature (151)..(173): n is a, c, g, or t
  misc_feature (203)..(234): n is a, c, g, or t
  misc_feature (241)..(344): n is a, c, g, or t
cccggnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagccccccccatttatacccccccaggtggaattttttgtttcaaaaattaggaatttggacttttccaattttttggaactccccccaattttaaaaaaaccattttccgaaaatccaccggggctttttcccttcccctttgaaaaaaaaaaggcccccatattaaaagaaaacccttttttcgggggcctggttcccctttaaaaaggggcccccttggccccggctccccttaaaaattaaaaaccaaaattaaaagtggcccctttatcccccaaaagggaacccctctccccccccctaaaaccagtttttgtccctgttt

SEQ ID NO: 8539 - DNA, 222 bp, Diabrotica virgifera
  misc_feature (10)..(11): n is a, c, g, or t
  misc_feature (183)..(210): n is a, c, g, or t
taccttaggnnatacagcgtaatttttatgggagaagtcaaatcgaatataaagattgcgacctcgatggtgggataaagtttaataattggtgtaacagttattttattaagcctgttcgacttttaaaattttacttggattgaatttaaacgggggggagcccgggtgggttttctatcnnnnnnnnnnnnnnnnnnnnnnnnnnnnccaaaggggacc

SEQ ID NO: 8540 - DNA, 857 bp, Diabrotica virgifera
  misc_feature (765)..(765): n is a, c, g, or t
ctccagtcggcgaacgccattttgactagtgtaagaaggcaaaaataatagaaacattaaaaataatccgggttcatccgtccctctatagcctaaaaagaatttatttcttgttatttgcggataacccatttggacggaccaagaaataaggttcgttcactgggtcttgtagatctaaatggttgcgtgcagacagcatgtctactttgccagggcaggcctccaagggggagaaaacaaaatcaaagtttcaatctttggatataaataatttgtatagagtgagcaggggtgaaaatttagaaaaacaacagcaaaaaagttcatcagtctacatcaaacatggcatgcaatcactcggtaaagtcccaaatgctcgtcgggccccagcaaatcttccatctttgaaagcagaacacagcggaacagacgcagcagtacctttagtaccaccaggagcgccaggatggggaaagcaagatacatcagccactgggacatctcaatcacccaacaacaatcatcagacagttgcacaatctcaggattcgaatgtacccccactgaatgcccccaatcagactggagtctcaccacaactcagttcacatcaagctgcaattgcccttccagtaacgaacactattcccccacaaacacacaaacagttaacccctactgcacagcctgtgcctacagacaaactatggagttccgtcatgacaggacccgagtctcatcctccctatatcagagtgtacnattccaacacgaattccccagcttgtcatctggagatggcgcccccacacgcactgggtccgatgctccccagtatccttcagggctcagtc

SEQ ID NO: 8541 - DNA, 1133 bp, Diabrotica virgifera
  misc_feature (948)..(969): n is a, c, g, or t
  misc_feature (1056)..(1077): n is a, c, g, or t
  misc_feature (1086)..(1105): n is a, c, g, or t
cacatacagaagattctgactcttctgcttcagagaaagacgataaagaaactaacaacagtctagtgagactcgatgatgacgctgatgttaaaatacctacaataaaagaatattctctgatgacactaaagagttaagtaaggataagatttcaataaatgattcaagtaacagaagcaaaacagcttcttcaaaaagtagcttaaaatcttttgaagagttcagtgaagaagaagaggtagattcaggagttacatcagacatgagtaggcatatatcagataccgaagagtttcccgagttgaggaagcttactaaataccaaagagcagctacacactcaagactgtttaaacttttacaagaagaatgcaataacgaggatgtagaagaagatgctgaagagagcaagcaagctttagatctgaatttaaacgatgctaaaaatccagtaaatgaaagactagttaatgagttggtagatagtttactaaaactcaaaaaaggacaagcgtttaagaacttacctaaagaaaaattgtatgcagcagccgtgaaaatattgcaagaagatatggaggttacagataccctttctggatattccacaagtgtccaaacacctcaagagttcggaaccaattctgatgattataaacaatactacgatacgtgggatagaagcgaagaaagctttgacatatttccttcaaaagcgttcaaagttctgcaagaattatcgagcaaacaacaaggaggggggattggagcctaataataaaggggcccaagggggtggccccctaaaaaattcccaaaaaactgatcagaatttttaaaaaacttctgaaaattcttttaagtccccttcctggacaaccctcccttaaaaacgaaacgatgtcaagaaagtcccctttgaatttccaaagggggcttttaacnnnnnnnnnnnnnnnnnnnnnngggccccggttttaattttgggaaattttggaaaattaaaaccgaatttttaaggcgccccattttcccgaattaatggaagaaaannnnnnnnnnnnnnnnnnnnnngaaaagggnnnnnnnnnnnnnnnnnnnnccatctaaaactttaactcaattttttt

SEQ ID NO: 8542 - DNA, 932 bp, Diabrotica virgifera
  misc_feature (811)..(838): n is a, c, g, or t
aatatttgttggttcttagtgcattttgtgtgattaattatgtgttgtagactctgtttaaaaagatcacttaacatctaacctatcttgctagttagtgcaaaacttgattgtgggaaatacaagtacagttggcaaagcgtttcctattgcattcactataaaaaggccagtgacttgctcccccctttcagccgatgtcacttgtcctacttgcttttcaccacgcttaggcctggcgcaaattgaacctaagccagacacaacctgcaccggcgggacgggtgacccgtgcatttatttgtctggcgtgccgcatattgaacacaacccaacccaaccgttggctatcgacgtggcgaatagaggcgggcaaaatcagtgcggacatgtaacggttacttttgataccggttctcagtggtactgagtacaaatactgattacaaaatactgatggatctgatccttgtactgaattgagtaggcaacttaaaatcggtatttccgtacttgtaagtagcaacgttttaaaaatatcttacacgtccctagtagtcgtagcggtatgactttcgaaaacatcgaatttgatcataagcaggtgcataagaagatatcttacactgagtattttatttctggacataatacctacgtattgaaaataatctctcccctagtgggatgtcgttactcatattcctcaaattactgcctcgattataatcatttacaataattgggggtctaatttctaaacccctccgcttatgtatcgatataaaatataaccttttcggcataattnnnnnnnnnnnnnnnnnnnnnnnnnnnngccatatgacgatataaaataataggaaaattcttaaaagttggattttgtgaaattacaacttttttaaagttgcggtgtttacaaaaaaagc

SEQ ID NO: 8543 - DNA, 713 bp, Diabrotica virgifera
ggacagttagaaaaattaaatttgccagtggaaaaggtggatattttggtatcggaatggatgggttactttttattgttcgagggaatgttagatagtgttgttcatgcgagagatacatttttgaagccggacgggctcattttaccaaatagatggaatataagtttaataggagtaagtgatatagatagatataactctgtaatcaatttctgggacgacgtgtacggtttttcaatgaagtgtatgaagccggatgtccttcaagaaccatttgtcgaaatcgttcctgtagaaaaacttcttactgacagtcaagtggtcactgaaatagacataaaaacgtgtgatatgaacgcctgcgtatttagctcgaaatttaatttgacctctgctcgagacggaattttaacggcgattgcaggttactttgacacatttttcgatttggaaaacaaagtggaattttctaccggaccaaattcaaccaggacacactggcaacaaaccttattctttttgccaaacacgatagatatgaaagctggagacactgttgaaggaaccataagttgtaaaaggctaccgaaaaacgtgcgaggactatcagtaactataacaatcggatcgaacaagtatcaatatattatggattaagattcataactttgtatgttttttaagttttgtattatacaaaatatttatta

SEQ ID NO: 8544 - DNA, 78 bp, Diabrotica virgifera
  misc_feature (9)..(30): n is a, c, g, or t
attatttcnnnnnnnnnnnnnnnnnnnnnngaggattaaccacttgattatttaacgacaatatatagattgttgtca

SEQ ID NO: 8545 - DNA, 1089 bp, Diabrotica virgifera
  misc_feature (618)..(642): n is a, c, g, or t
  misc_feature (661)..(687): n is a, c, g, or t
  misc_feature (859)..(881): n is a, c, g, or t
  misc_feature (923)..(950): n is a, c, g, or t
  misc_feature (993)..(1027): n is a, c, g, or t
cccacgcgtccgatgtcattcacaattatcaattattttgttcgatacgcgttacgtggtaatatttatgagaggtttttaggttttagagtaaaaaggcagaatatatttttggtgttttaaagaacagattcaaattttttgataccaaaaataaattggtagggcaaactggggcaatcttatgacggcgttgctgtgatgagtggtgaattgaatagtctccaggcaaaagttaaaactattgcatcacaagctttatttactcactactattatgcgcatataatgcatttagttttacatgatacgtgtaaaaaaataaagaatatcatcttttcttgccagtttagctcacctaaacggattactgctttagaacaaatttgtttcgaaaaaaaaagcgaacaatttgtcagacgcgatgaaattttaaatctctgttagttttatctaagcagattatctcttatagttttagtatctgtagcagattttcgtgaacagcttttggaagtttttgattttattatcgaaggcgatgattttgaaagtggcgatacctcgatccgtgaagcaatcggtttgagaactttattaaatactaatgactctttnnnnnnnnnnnnnnnnnnnnnnnnnacagagtttgcccaagatnnnnnnnnnnnnnnnnnnnnnnnnnnntgacattatttattctaaaagtagaatacgaaagctggtgcaaaatctcagagattttctaatgatagtaagttcccatatatacgcagggacgttttggattcccttgatatttccgaacccccccaaaaaaaacaacgacatggtacttatcctcccaaaacgagtaagnnnnnnnnnnnnnnnnnnnnnnnccctactttttatttggcaaaaaaaaacccccctttttccgnnnnnnnnnnnnnnnnnnnnnnnnnnnncccctcttttaacgattttaaattttaaaaagttacggttggnnnnnnnnnnnnnnnnnnnnnnnnnnnnnnnnnnnaggttagggaccttaaaaaaattttgggtgggggccaaaagaatttttccaaaaaggggggc

SEQ ID NO: 8546 - DNA, 817 bp, Diabrotica virgifera
  misc_feature (282)..(300): n is a, c, g, or t
  misc_feature (678)..(678): n is a, c, g, or t
  misc_feature (714)..(736): n is a, c, g, or t
aaagaaatcacttttctccctttgggagcttcaagccatccacaccggtgatggaactaaggctgacacaatggggactttgacatccagactccagcatccaacacctttagctgcaggggcctagggccgaagatctgcccaggcctacgagaagtctacaacagcagtaccatacgacatcaagaagataccatcagctaccaaaagccataagtataatccagaattgttagtttttggcaagaatttaaatacatttgttaatgcaatttactaagnnnnnnnnnnnnnnnnnnntttatgaacaataaacatgattagttaaaaactatgttttgtttgcttccattccaattttcatagttcatatctgaggttaggacaagacgaacacacacctgagtgactgagctaagctaagggtgtaacgatggctatcttggttggttgaggtaatattttcgaatattgtttcaattagctgggtagtccatcgctactcgttacactggcgcccaacgtttctcatgtgcgcttttttcgttacactggcgcaccaacgcacttgtcttatccgaagaatcgagctgtgagtgtgtggtttggtagcagacaacaagcattaataaatactattttcatatatttcatttttatattcaatttttgcagtanatctatatatattatctattttgggactttttgacnnnnnnnnnnnnnnnnnnnnnnnctaacgtcatatgttatgggtcaaaaaactgttaccacttttaataatttatttgtatatttcaggaataattgatttaaa

SEQ ID NO: 8547 - DNA, 548 bp, Diabrotica virgifera
cggacgcgtgggagaaaattgatccatttatggaacgaagtcttatttttaagaagcaaattgctaatgccactgttgaatatcagtctgaattgaagcaatttttaaaaactaccaagcaacgagtttcctaaattctttaaaccattgcctaaagctgaagataatatgtaattaatcaatctgtgtggtcaaaacttcaattaaactgatttttttaggaattctcttttttatttcggcgcccaggaacgcatcccctataaccccatataaattaccattccatattcacggtttccgtattcgcggcatatttacggaacgaataccccgcgaataaccgagcttcaactgtatgggccgatgacgtcactagccctaaatccaaaacaaaaagtaacgttttcgggatgcatatcaacctctttggaagctagtgcaataaactgatcttctctggattcatatgatctgccattgctcctcattgtggtaaactgagaaagatatgtctctgagacttgaaacggctactgtgaggatcc

SEQ ID NO: 8548 - DNA, 145 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttggattaaagtttataattggtgtagaagctatattattaagtttgagtgaacttttccattttttactttaatttcatattaaaac

SEQ ID NO: 8549 - DNA, 667 bp, Diabrotica virgifera
  misc_feature (217)..(232): n is a, c, g, or t
tatatatcttatgacctaatttccatatcttaaatgatttccgccttcattttatttgccgcttgccagtttttatcgggaaaccatactttacctctaccagatgacgactcaccttgggcatcatgagaatcattggtaactggaaaacagatagctatatatgatgctgctgaaggtgacagctgagaatttggatcttttctcgactttgctnnnnnnnnnnnnnnnngtttcgtctgatgtggtatcactctctcagctgatctactcttgattaataaatgacgtatatttataaatcctagcatattaacaatagagattttaatgttattaatataacccatgttgaagatggaactagaggataagatattagtagaatcccattcttctttggatattcagatcaaggactttcatatttcagactatgtgattatttattagtatagattgttgttttgattgtttatgaatatgtcatcctctaatgaacttggatgatctaattttattaatgcacggttgtattattatgatgatattgccatatctactatgaatatatggtgaagactaaaggcattccacacctgtattctcccccgcccatcgtgaacctggctctatgaaatacatgtaaaaacgcgtcagcgcactg

SEQ ID NO: 8550 - DNA, 699 bp, Diabrotica virgifera
  misc_feature (14)..(36): n is a, c, g, or t
cgcaaaaaacgtgnnnnnnnnnnnnnnnnnnnnnnnggttaaaattgcgattttgacaatgtccccccacataaaattcaaaataaacctcattttctttttcagcaccctcgaaaatataaagtatgaataaaattatcctttcccccctccgtggtcagtatctcgaaaactaagtgcttttttgagggtgtcccgctcgtgtatatcacaaaaaattgtaacgtgatagtatgaaaaaatagaggatacggcaacggtgttacaagtgatggtcggatccaatgccaaaatctacacagacattattagggtgcactaatgtccaagatgtccaaaatctttatcataatattttcattgttttgaatcatgaccttttgttggaacctttgagaatcgactgccttcttctctactgtcggtgtcgctccgaacagttccttacaggcttttgacacttggtggtcagcgttggcctaagatggttgattgggtttcctggtagagtttcaccatgttcccggaggttatatcttttgacatcggcgtttggcctgttcaatatcactacaacatgatgtggattgaattgtaattgcacccattgtttggttctggggctgtttagcaagtgttcgggtaagtgatcataaccacattttttgacttttagggttcaaccatctttcattttat

SEQ ID NO: 8551 - DNA, 180 bp, Diabrotica virgifera
  misc_feature (4)..(23): n is a, c, g, or t
  misc_feature (39)..(58): n is a, c, g, or t
  misc_feature (62)..(107): n is a, c, g, or t
  misc_feature (110)..(170): n is a, c, g, or t
ggcnnnnnnnnnnnnnnnnnnnnaaaaaccccataaagnnnnnnnnnnnnnnnnnnnngttnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnncccatttttt

SEQ ID NO: 8552 - DNA, 92 bp, Diabrotica virgifera
  misc_feature (7)..(78): n is a, c, g, or t
aaagaannnnnnnnnnnnnnnnnnnnnnnnnnnnnnnnnnnnnnnnnnnnnnnnnnnnnnnnnnnnnnnnnnnnnnnntggggggataaaaa

SEQ ID NO: 8553 - DNA, 914 bp, Diabrotica virgifera
  misc_feature (747)..(747): n is a, c, g, or t
  misc_feature (753)..(753): n is a, c, g, or t
  misc_feature (855)..(855): n is a, c, g, or t
ataactgtgtcggtattttgtatttttgtaataaatattgcaattaaagtgttttgaaatgactgcgtgtaataagcttttaaaaaagtctagattgttttctcaaactaacaaatttatcaagcgacatgtaagtgccaaagcttttatttttgaaaaacagtttgatggatttcccaaagaaagtgactttaaacttgtaactgaagaattgccggcgctcaaggatggagaatttttggcagcagcagaatatttaagtgtggatccgtatatgagagcatacgccccacgagtaaagacaggaaggacttttatgggatctcaagttgctaagatcgtagaaagtaaaaattcaaaatttccagaaggaacatacatagtgggagaatatggatggagaacacacacaatatcaaatggaaaaggtgctgtcaacgggctgccatcggtttggatcataccagacattgaagaccttccacattcactagctttaggagtgttaggaatgccaggaaatactgcctacttcggatttttggaactatgtcagccaaaagtaggtgaaacagtaattgttactggtgctgctggggcagtaggcagccatgtcggacaaatagcgaaaataaaaggatgccgaactgttggtgtcgctggatcagacgaaaaaggaaaatggcttgtagatgaactcggatttgatcattttatcaactataaaaaagatgatttacgaagtanaattanagaatttgcaccatatgactgttattttgataacgttggtggagagatcagttcgatgataatgttgtacatgagcttgtttcgtagaatctctgtatgtgnggcaatttctggatataacgatacatcattgccaaaagctcccattgtcccatatcctc

SEQ ID NO: 8554 - DNA, 809 bp, Diabrotica virgifera
  misc_feature (14)..(44): n is a, c, g, or t
  misc_feature (49)..(665): n is a, c, g, or t
  misc_feature (667)..(711): n is a, c, g, or t
  misc_feature (733)..(777): n is a, c, g, or t
tcctttaaggccgnnnnnnnnnnnnnnnnnnnnnnnnnnnnnnncaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnngttataagattaataataaggnnnnnnnnnnnnnnnnnnnnnnnnnnnnnnnnnnnnnnnnnnnnngggggagaagaaaaagcaagaagcttttttat

SEQ ID NO: 8555 - DNA, 963 bp, Diabrotica virgifera
  misc_feature (41)..(74): n is a, c, g, or t
  misc_feature (536)..(564): n is a, c, g, or t
  misc_feature (825)..(825): n is a, c, g, or t
  misc_feature (857)..(857): n is a, c, g, or t
  misc_feature (879)..(879): n is a, c, g, or t
atttgtacactagaatattttttatctaggccacgtaaggnnnnnnnnnnnnnnnnnnnnnnnnnnnnnnnnnngtgtttatacgtatttattttgtccttgatatggagcttatttctcaccaatatgtttacaataattgtggatcgctcgttatatcaaacctataacaaagtgaaaggattaaatccaaaaacaagctgagaatacgagcattatcataacgaaaattttgtttacggttagcaaaaatcatctctatattactatatttaaatgaaatatatgtacagtatttctcatgatcatttttcagtgcgtaacaaatgataggaaaaagggtaagtccgtgataatacacatttatgacatttattctaacatgacattttagttaaatctgacagttgtcacattttattttcaatttggaatataaacaaatcaaaagtgtttcttgcatttataaaatggtattttctttgatttgtatagtcttataaattatacagattatatttgtaatattattatcnnnnnnnnnnnnnnnnnnnnnnnnnnnnnggcgccatctatcgacaactagaataactagaataactgttataaaaatgtcaccgacgaaatgtaatcaccgacgtgccttttttctgtcacatacaatttaatgcgttagaaagaaatcgaaaaactgtgacgcactgaaagatgatcatgagaaatactgtataacctgaatttacataatatatcgaattcctaaagtcgaaaatgtaatttttcgactttgggatcggttatttcgaatttggtttgagatatcanactcgcaagatgatattccttctttcttctanagtgcccatccgttctggatgntggcgatcatcatggctatcttgactttgtttacacagcgcgaataagtcagcggtagtcgtgtataccactttcgtaaatttt

SEQ ID NO: 8556 - DNA, 241 bp, Diabrotica virgifera
  misc_feature (2)..(35): n is a, c, g, or t
  misc_feature (37)..(122): n is a, c, g, or t
  misc_feature (127)..(185): n is a, c, g, or t
  misc_feature (189)..(214): n is a, c, g, or t
cnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnngggtnnnnnnnnnnnnnnnnnnnnnnnnnnnnnnnnnnnnnnnnnnnnnnnnnnnnnnnnnnncccnnnnnnnnnnnnnnnnnnnnnnnnnnctttagggaaaaacgggggaatttttt

SEQ ID NO: 8557 - DNA, 695 bp, Diabrotica virgifera
ctgaagcttgtgcatcacgcatagagggagcattatctaccgagaccctttcgtcctgttctaacacatagccactgatattttgcccgatgctaagaacccccctcatggacccttctgtgccattaggcgaactgcagccgctgtcgttgtcatcttgtcgtatcccttctatagtgcgccaaagcgtatgatgatgcttgccgctctgaagaacatcaagaccgtctacatcatgactggtctctgctcagacacaatggccaatatcaatggcaccgacgccttgttcaagggagctctctcctccggcctccgtggaaacggtgctactaatgcattggacatggactacgaaaacttgaacgtgagtgtgtcattaggatttcattgatatcaagaatcgcgcatcattatcaactctccaatcactttttcgtaagaagtatctgaaccacagtctataatatattcatctaggcgcgtgagcctcatatctttccaagtgtaagcggaccattttctcgacctctacagctcactgaaaagtagatgttgtcaccccacctctcgctgagtacgatttggaggacaatgcatacaggtgtcgcgcatctatccccttgattgccgtagataatgtctacatgctcacccgaacgagtatagactatatttttgatgttacgagactg

SEQ ID NO: 8558 - DNA, 84 bp, Diabrotica virgifera
  misc_feature (7)..(71): n is a, c, g, or t
ggggtgnnnnnnnnnnnnnnnnnnnnnnnnnnnnnnnnnnnnnnnnnnnnnnnnnnnnnnnnnnnnnnnnntcccaattttttt

SEQ ID NO: 8559 - DNA, 842 bp, Diabrotica virgifera
catttaagctcataaactccacaacactcagatctatcacgaccgtcctcgttattcaagaaaaccaaacctaaatttgaattagttctaaaagaaatattacagtaatctttaaaaatatcgagctaatttgtaagagaatcgacccgtaaacgttaacgatctatatcggtttcggctcccgttcgaccggaataggccgtgtatatactcgacgttctaaaattctatttgttttttcgtgtaaaattttatttactaagtccacagtataaccattattaactcgctatttgttggataattcttaattctttattaaatgaagttgaagtcaatggggatagagacaagcctgttgatggtaactataaaaagcagccagtttatgttgtatgggggtgggtgtgaatcggcagggataactggtacctggtatggtggttggttttctataaataccaaagtcaattggttccattttctgagtggtcaatggtaagatctaaaaagttcaaactctttgagtcattctgaatctctaaagtaaatttaatagtggtcatggtaaagtattgaggaaatctaagaaatcgtgaagaaggtcaattggggcattccatattattaaagtatcgtcaacatacctagcgtaaaatttaatataatctggaaatgggattatttttcactattttattagattccaagtcatttagaaaaatatcagctaatatcggtgaaagaggagatcccatagctagtccgtccggtggactatgtgtggtggtgggtgaattaaagaaattctgactcagacacaaattcaaaagctctgtata

SEQ ID NO: 8560 - DNA, 800 bp, Diabrotica virgifera
  misc_feature (320)..(346): n is a, c, g, or t
atatttttagaacttgccatcgttaattctaacttgaccagtgatattgttctgacaaagtttttacagttattttataatcatgggttccagtgatttacttatgaacgacagagaaaaagtgttgcaggcttttgagaaaaccgaaaaagatcttgcagaagatgttattgtgatcaaggaatggattaaaagtcaaccgcatcttcctgaggttccaagtaccagtattatagaaagttttctcgtaaccaacaaattcagcattgaaaaaacaaaaaataagttggatatgtactacagtataagaacgatgatannnnnnnnnnnnnnnnnnnnnnnnnnnaacctaccccacatgatagaaatcaccaaatatgtgcaatatattccactaccaaaattaactaaagatatgttcagagtcaacatttccaagctaagcggaaatccaaaatatttcgatgtctacaattttttcgctcatcagatcaacattaatgaaatcagattgcacgaagaacttatactgggtgacgtactattggtagatctcaaagatgtttctctaggtcatatggtcaaggtgactcctcaacatatcaagaaagctgttttggttttagagaaggtattctctaacagaattaagcagatccatttggttaatccatcgacaagtgtggacatgttggtatctgttttgaaatctacactgaagcaaaaattggctgacagaattcaagtccataataatatcgaaactctattgaatcatatgtcttctgaaatatttgcca

SEQ ID NO: 8561 - DNA, 645 bp, Diabrotica virgifera
  misc_feature (4)..(31): n is a, c, g, or t
gtcnnnnnnnnnnnnnnnnnnnnnnnnnnnnggacaccttgtataaataattatgtcatggtgagtaggagggggagctatgttttcctacttaattcggcggcgctgtgaccgcggctatttagtgtgccacgtatattgtggcagctatttagtttgccgaatattttgtgacgggaccatatggaacgtaaacctgacgagactacaaaatcactaaacaactatgtctatgaagcattctggattggtgacagactagaatgatgacacacgataattactatactcaaaagacactaccttctataggtctcctccccttattttctactttccactcttcttctctgactactttctcctgtgacttccatatcgagttttaatgacaaagattatgatctactatgatcatatgctagctagcacttacgagacccacacgtctctaatcccgcacggctcatatgttccagcgaccaagtggatgatcgaccctggcccagagatactctgcccgacggcggactaaccaactgactcactatgtatctggatcttgctcatactgaattatgctcatattaagcgacatggaccacatgccgcgtggactactagacgtgctgtctgacatatcta

SEQ ID NO: 8562 - DNA, 154 bp, Diabrotica virgifera
  misc_feature (7)..(69): n is a, c, g, or t
  misc_feature (71)..(105): n is a, c, g, or t
ggggtgnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnctttagggaataacgcgcgaaatttttatttggaaaaggttcaaaccga

SEQ ID NO: 8563 - DNA, 744 bp, Diabrotica virgifera
  misc_feature (17)..(17): n is a, c, g, or t
  misc_feature (21)..(21): n is a, c, g, or t
  misc_feature (25)..(25): n is a, c, g, or t
  misc_feature (30)..(31): n is a, c, g, or t
  misc_feature (71)..(71): n is a, c, g, or t
  misc_feature (87)..(87): n is a, c, g, or t
  misc_feature (91)..(91): n is a, c, g, or t
  misc_feature (277)..(277): n is a, c, g, or t
  misc_feature (341)..(341): n is a, c, g, or t
  misc_feature (347)..(406): n is a, c, g, or t
  misc_feature (408)..(583): n is a, c, g, or t
  misc_feature (585)..(612): n is a, c, g, or t
  misc_feature (634)..(647): n is a, c, g, or t
  misc_feature (650)..(663): n is a, c, g, or t
tcccttttaaagggggnaggnaganggaanngaaaggaagagaaaactttttagaaagagcaaagaaaaanagaaaagaagggaagnaaangagaaacgagagagaagagcaaagaggcaaaaaagaaaaagggagcgaagcgcaccaggcgaaagagggaacaggaaggaagagaaagacagaaaacacgaaaggaaaggagaagaggtaaaaaagaaaaagggacacgggaaaagaaagcagagaaagaaggggacgaaaagaaaggagacgcgngaaaaaacagaacgaagtgaccaagaaagaaaccaaaggaaaccaggaacaacaaaaacagaancaaagnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnntggtaacatttttttcaactgnnnnnnnnnnnnnnggnnnnnnnnnnnnnntatatatagtctcgttttgccactgattattttgtatggccgtggaattttgaccgagttaaggtaatatagtatttattt

SEQ ID NO: 8564 - DNA, 88 bp, Diabrotica virgifera
  misc_feature (9)..(35): n is a, c, g, or t
gaaaaaatnnnnnnnnnnnnnnnnnnnnnnnnnnngtttttcccaaggatggacactttttaaaagtcttgcttttgggggggcggga

SEQ ID NO: 8565 - DNA, 59 bp, Diabrotica virgifera
  misc_feature (8)..(9): n is a, c, g, or t
  misc_feature (15)..(41): n is a, c, g, or t
gtgattannaaaatnnnnnnnnnnnnnnnnnnnnnnnnnnnataattataattttttga

SEQ ID NO: 8566 - DNA, 660 bp, Diabrotica virgifera
  misc_feature (82)..(99): n is a, c, g, or t
atttatgcaagctgtcgctgtttgacgccagtaaaatttttctatgatttgtacattttgactatcaactcctttatccttnnnnnnnnnnnnnnnnnngtgatgttgttgtcgatcaaaggccttgtcatagtcaataaatacagcaaagacgtctttcctttgatctcggcatttctgcaataatacatttagtgcaaagagtgtgtccctggttcccagtccatttctgaagccaaattgtatttcatcctggtcttcttcacaattatctgtgattctacatactgtggatgatacgtagaaatattttcaaagtgtggctcataaggcttatcattctataatcgctacagtttttggacgtttcgattgttcttcatttagtttaaaactgctcttacttctgacactgtaattaatttcaatcctgatttataagagtcttttctcgtgttaggaaattgtcttgtggtctttggctggtatagaggtctttataaaactctatagttattttcagaatgtcctgtttatctattgttgcctttcccttctttgtctctcagcttgtatatttcctttttactttgtgtagaattctcacttcattatctttatatcattgaactcctatactgtgtgagtatatatattatc

SEQ ID NO: 8567 - DNA, 864 bp, Diabrotica virgifera
  misc_feature (732)..(732): n is a, c, g, or t
  misc_feature (745)..(786): n is a, c, g, or t
aacatttttattgcacaaaattttgtgatatatttttttccataatcattactacgatgatgatttattgtattgaattgtacattacaattacaatctggtcataactgaccaatgagcaattttaatttaacctaaattactactgttccttaaaatgaagagcttaccccatagcgtctcttatctaatctaacaagatcgtgcactattctaacatacacaggcacacaagcactatgctctgcttttcactatcacctatcactcaaactagttcaaaaggctttgtcctcttcaatcttctagtttgcccagtagtatcgaggagctggatttcctcaatattcttgtaggtacttatgaagttgttgctcgtgacttccaactttactccaactttaaaaacaaatccagctgtaaaatatttttatgtgcctgaaggcttttgtatgctttcataattattttcagcttcaataaatatttaaaacaataaaagaaataatgttattgctttcaaaatctatcaatattgataaatatcagggaaaaatgaacagtaaataaaaattgtttcccctacctttctccaacatctgtagtttccaataataatttccttaaataatcactttgcattgtggtaaagtttataaagttcacaaaatacagcaaatgaaatccaaaatagacaaaatacgacgataaacaatgaaaaatagatattancaacataacctcnnnnnnnnnnnnnnnnnnnnnnnnnnnnnnnnnnnnnnnnnntgcctaatacatagatacacgcgcggcaaatttgaaaacgaacgccaattgaatagtaaatggccctctgtaaaatat

SEQ ID NO: 8568 - DNA, 106 bp, Diabrotica virgifera
  misc_feature (8)..(105): n is a, c, g, or t
gagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8569 - DNA, 881 bp, Diabrotica virgifera
  misc_feature (35)..(53): n is a, c, g, or t
  misc_feature (714)..(714): n is a, c, g, or t
  misc_feature (734)..(734): n is a, c, g, or t
  misc_feature (743)..(743): n is a, c, g, or t
  misc_feature (770)..(770): n is a, c, g, or t
  misc_feature (840)..(840): n is a, c, g, or t
cgttcagactgaaaacgtgaaagtgaaaatttcannnnnnnnnnnnnnnnnnngttggtcgttaagtaagtttatccatccaacgtttacttcgcttaataggcctttatcgatattattaaatagaagtagttaatttacacttctcaacgtaattcaaatcagaatggcaattgccaccaatgtggtttttaaaattccccaagagccatgccccttaactaccttagaatcggacgaagaatctttcgttgttttgggtcagtctattccagatgctagcactgaactgtatccagaaccgattggattgtccgtcatagcagaagcaaaaagattaataaattttgagctcgaagctatcgaccaggcgaaaaataatgacgaaaaaaaggggtgtctggaatccaataaagatgtttttaaactaagttcgtctacaatggatacatccgaaaattttcctatgatggcaaatataaaccggggtgttgaattatctagtgttataagtattgcttcttttacacctgacatgtcatccgaagaagttcagaaaaaaattgctcatatcatagacgaaaatatacgtctgaaggacaccgtactgcaaaacaacctgagcttgaaatctcaatatgaacgcatcgttgcttggcaagaagatgttcaaaaagttcatcaagcacacaaagataaactattagaagctanagcgtttattgaaactttanaaagagaanaggacagtttgaaacgcgaattgacgnaagatattgaattcggtgatagccaagcatctcaaattgaagaatttgagaacgattagatgaaaaggantaacaaagatatgattacagcatcaaagaatctcagctaaa

SEQ ID NO: 8570 - DNA, 801 bp, Diabrotica virgifera
  misc_feature (218)..(238): n is a, c, g, or t
  misc_feature (293)..(404): n is a, c, g, or t
  misc_feature (406)..(704): n is a, c, g, or t
  misc_feature (706)..(754): n is a, c, g, or t
  misc_feature (762)..(779): n is a, c, g, or t
atttatctcttaaaatcataaaatctctctctctctacgtaaatagtaaagaaaaaatctctctctcttcaatcgataagttcaatctcagtatccgcggagagaatcacttctcatcttttctcaaatagaaaaatctctcacttttccgtaccttcgcgtatccagggatctcttaattaatcaattcacacacttaccactttcgaatcttcaannnnnnnnnnnnnnnnnnnnncttttcatcgtaaaatcaaatattttaaatcaatttttttcgtaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnntaatcacnnnnnnnnnnnnnnnnnngtggaatgtaaagggtggaatg

SEQ ID NO: 8571 - DNA, 169 bp, Diabrotica virgifera
  misc_feature (2)..(81): n is a, c, g, or t
  misc_feature (89)..(103): n is a, c, g, or t
  misc_feature (105)..(121): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnncaagtcannnnnnnnnnnnnnnannnnnnnnnnnnnnnnnaattttgcccgtgatatggtagtataatcgttaggttttttattgaat

SEQ ID NO: 8572 - DNA, 168 bp, Diabrotica virgifera
  misc_feature (19)..(112): n is a, c, g, or t
ccctgatacacaaggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtgttattgattgggaattatggatagttattggcaggtgtatcagattaata

SEQ ID NO: 8573 - DNA, 279 bp, Diabrotica virgifera
  misc_feature (71)..(91): n is a, c, g, or t
  misc_feature (107)..(135): n is a, c, g, or t
  misc_feature (153)..(169): n is a, c, g, or t
  misc_feature (171)..(184): n is a, c, g, or t
  misc_feature (187)..(210): n is a, c, g, or t
ccccctcgcgcgggccctcgcgtccgatttttattcattttagtctaatagaatattttatagtagaagtnnnnnnnnnnnnnnnnnnnnngatagataattagtgnnnnnnnnnnnnnnnnnnnnnnnnnnnnngaaacattcatttttgcnnnnnnnnnnnnnnnnntnnnnnnnnnnnnnnccnnnnnnnnnnnnnnnnnnnnnnnngaaagagagctcaaagaatctaaaatcttttgattgtcaaaataagatatctttaaatagtctctttgt

SEQ ID NO: 8574 - DNA, 552 bp, Diabrotica virgifera
gactagtcctttctggaaaaggtggagttgggaaatcaacagttagtacccaattaagtctaattttagcagaaaaaggctacaaagttggtttattagatgtagatttatgcggtccaagtgttccttatttattgaaacttgaaggaaaagatgttcatctgggaaatgaaggatggattcccgtgcctttggatcatggccaagatgcttaccttgatatgttacaacccctcttgcatgtgacaggtgatgggcttactactgtatccgaacatgcagcgaatcctgtacatttacttttattaaacctcttacacgcgaatacaggaccagaatttgacgatagaaaagagcgtgatccccgatggtaggactgtataattcatgatcttaaaactgatgacgatatgactatttagattagccaccctcctgttccctgcaatatttacgataatgagtgattactttgaggataattccggtctgttcgaaaatgttagctgtaaaatataccaatataattgaactcagtgatacttatttcgc

SEQ ID NO: 8575 - DNA, 851 bp, Diabrotica virgifera
  misc_feature (107)..(139): n is a, c, g, or t
  misc_feature (381)..(399): n is a, c, g, or t
caaaaagttgaaaacttccatcttgccgctcattcttcggtgctggtcatgactcaaccccctaaattgggatcagctgaaagaaaagatcacttccaagttacaannnnnnnnnnnnnnnnnnnnnnnnnnnnnnnnntccatgtcgaaaaaattgtacatcctggaccacgtcatctcgtaaccgttttgcctggcgagagccacactttcgatcttagtggatctcactataatatgactgtcttacaggtaacaaatcatgaggatggagaggcagtattttctgctgaaggtggaaatgttattcccgatatggagcaaaccatccaagaagaacttccagaacacgttgaacacaaagtcgacaacgtacatttnnnnnnnnnnnnnnnnnnncttgttatgagtcaacctatcaacgaaggtgaagaaggaaggcaggatcatttccttgtttctaacaagggaaatgttaaaattgatgctgaggttatccatgtcgaaaggatagtacatcttggaccaagtcatcttgtaactattctacctggccagagccacacattcgatcttactggcgttcacttccgcagagctcttctgaaagttataaatcatgaagaaggagaagctgtattctctgctcaaggtggtaatgttctaaaagactttgaggaaactgtacaaaaactagaccacgatgtccaggctgcacaagaggttgaaaacttccatcttcccgctcattcttcggtgctcgttatgtctcaacttcccaaacagggaacagaagaaagaagagatcacttccaaagtacaaataacggaaatgtaacaattgatgctga

SEQ ID NO: 8576 - DNA, 470 bp, Diabrotica virgifera
  misc_feature (38)..(54): n is a, c, g, or t
aatggcaacccgagtgtttgtgggtgatcccttttagnnnnnnnnnnnnnnnnncctccatggaagattaacgaaaaatgggccatacattctagatggttttgcttgcttaaaaactgatcggatcaagaggtggaagagacattgcttaaggaacttcaacatatctacatctcaatacaagttgaccctaccgattattacctaattgccttgatataaaaatttcatcctccctcataaatgacatgcaccatcagcacaactatatgggaacatgcatgatatcctgcacatttactaaaaaaaaacatattaaatgcgaatatatgtctagaatctgacgataaaagcgagttgaaccaccgatagtacgaatgcataattcataaacttctaacattagacaaagattacgaattataaagctcaacatcctgctccctgctgagattcactttaatgaataa

SEQ ID NO: 8577 - DNA, 944 bp, Diabrotica virgifera
  misc_feature (802)..(802): n is a, c, g, or t
  misc_feature (869)..(869): n is a, c, g, or t
agtacaaatacatatagaaccattcaaacagtactaaaaactttatgagcgctgaaaaaaatcctattaaaagggggaacttcctcaacttttttattcggacgcccttcgtttaaatttgaagcacactgcccataaaaaataagtaaagaaggggtaatatattttgtccagtctccaataagcactaggtcaggtcagtcacgtcgctggtataagcttatcgtcagtacacggtagtacccaaaccacgtagctttttatacattttattttgacctactaccgactacattgatattattcaacgaggtgatatctaccgacctatgtttcctttgaggagttcagtgttcagtgtgttatagaaagtgagtttgaattgtttgaagtgtattgaccttttttggttacgaaacgcattaaagataaacaatgttaccctcgtctagaagagctacgagactatcaaaaaatctcgaacggtgtataaaactactcgaaaaaaggtcactcagttcacaggaagtttttgacaaggaagcaaaatatgcggctcataactatcacccactaccagtagctttgaccaagggacaaggtgtgtttgtttgggacgtagaaggtaaaaaatatttcgacttcttaagcggctactcagccaataattttggacattgtcatcccaatattaaaggcgctgcacgaacaaagtgctgttttgcaccacacctccagagccttcttttcagaccagttgggacaatatgctgaagcaatcaccaagctgtttggatacgancaactgatgcctatgaatacagggtgtgaggcaggagatacggctttgtaactagctaggaaatggngctacaggaaaaagaagatccccagaatcaagcaaagattatttttgctgcggataatttttgggggcgatcatt

SEQ ID NO: 8578 - DNA, 752 bp, Diabrotica virgifera
  misc_feature (234)..(254): n is a, c, g, or t
  misc_feature (617)..(617): n is a, c, g, or t
aattatcgacgtataatcgacataattattatccgccaatgaggaggctgaaagaacaatgtgaagaaaatcgacaaatatgaattactggcttttactggtatgttaattttgatgtacattttaatgttgttgtaaagggcgctttacagcttgcaattctacctgcaagacgcaagaaagttgtttaaaggcatgcgcagtatgtcgtcagttgattattgcatgcgactnnnnnnnnnnnnnnnnnnnnnggtttggtgccattttctctgcaagtttgcatgcaagtgtaggggaatttgtaggaagtttgatttttccacaatgtcaaatgtcataatcactgatttacttggatacatgccaatcagctgttttctgtttatgaaatatcaacatttttcccacgacgcgacgcggccacgcttgagaatgaataatgaaatggcactttctgagattctataattgtacattaagctacggaagctacctcctctcttctgtagctcagtatcttaaggcaataattcaattgtgtttcgccgaaatactatctcgaaatatatattcctttgtgattatgcgctaaatttttcccaagagtttattanatgtacctactttcattcattcgtagacaattagagtattttagtatttttcatcatctacttggataaattcttctgttagagatatattacccctcttctcgttcaaccaaggtcttacccaagtagatgatg

SEQ ID NO: 8579 - DNA, 138 bp, Diabrotica virgifera
cgcacctaataaatattgtgacgcgcggtcgcggaaaaatctccttcaacaagatgtcgaagattaataggctaaagacgttggcactataaactatttaaaacaatgtgatcattttgttcattatcttattactca

SEQ ID NO: 8580 - DNA, 522 bp, Diabrotica virgifera
aataccttacagctggaatccctacggtatactgatacttattaagaaatagagggcctatattctatttttattagcttgaccataaactgatcgcaccaaggggtttaagagacatcgccaaaggatgttgaacctatttacctctcaatacagagtgagcagcccgtttatttctcatatagctggcgataaatattttaaccctccctcacgaaaagacaagtaccaggtgtataactagatgggaacctgcatgtaatcatgacatttacgcacaacaaactacttaaaggcgaatacatgaccagtccctgaagatgaaacggcttgagcccacgagagtacgattgtatgtttcttaaactcataccctttacgacactatgactatttagaaagcataccgtctagctcacgctgtgatttaccttaatgagcaactaccttgaggcaacttccaggtctgaacgcaaagtacagtgtaaaatatcccctataattgaatacagttacacttct

SEQ ID NO: 8581 - DNA, 740 bp, Diabrotica virgifera
  misc_feature (268)..(288): n is a, c, g, or t
agaaaatcttattttggacgcattgcttgcattggataacttcctattaatggagacttatgttcatattcttttttctacttaggtcttacttacaatgctgtggaacctaatcaaataattatgttcaaaaaactatatttagataaatcaacgatgattgattaaacgagtattgatcccaaaacatgtagtcgtgagttactaacatatttttgtaaaaattcagaattttattgattttttagctttgtaattcatatgttcnnnnnnnnnnnnnnnnnnnnngtcgatgataaactttgttgcctatgtttaagtaaataaatgcatcattaccctgtttttgtgcagcttccaggctctatatttgttttgtagcctgtactttgcccgaaagaatttatgataaaaaggcatttgtggttatgaatatttccgattttttgtagggcaatacgtaaaatagtgttggaattgtattttttacatagtttcagttaattttttagtgtggtatttgagagtttgtgtatgtaatgtagtaactttgcttccttatttctgaatcgtatttgggcactctagattgatctttcttattgtgacggctaattgtgtgtgtattgatacacacactcgcagtccattacacctcaatccagtgtaatcacacgtattcctacaatcaaaacatcgacacacaactactcatacaataactccgaatcggaaatggc

SEQ ID NO: 8582 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (160)..(191): n is a, c, g, or t
  misc_feature (198)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaccggtgtgagccaggttgggtnnnnnnnnnnnnnnnnnnnnnnnnnnnnnnnngaaaggnnnnnnnnnnnnnnnnnnnnnnnnnnnnnnnnnntaatatt

SEQ ID NO: 8583 - DNA, 507 bp, Diabrotica virgifera
gacggagcaaatttgtgttggtattttgtccctgaatttgacaattaaaatcataattgtactgacgaagctataaaaaaatacgtgcaaatttattctgcatggatagaataagccttaaggtacctcccgtagaggaaaaggaaagatcggtgtagacttattctaaccacatttacaatacttgtcaaacttaatttatgatgagtctaatggtgaccgaactacttacacaaaactttcatgtaagtgaacgtatagatgtaaacaaaatcagcatcatatctattacatatcttaacaagaaattcgctcgacaaagcgatatcctatacgccggcgataacagaaatgttagtgtcacgaaggaggacacaaaaagttaacacatgatgagttacaatccccaaaccgaatattagatttcatcttttcttttaatatcaaatgttaaaacatatattcaagagaaagaaattcacatcttaaatgcaaaaaatcatacca

SEQ ID NO: 8584 - DNA, 133 bp, Diabrotica virgifera
cgacgatgaaggtattagttcttctttcctcttttttatttatgtgtgctcatacgaatgcaactagttaattcatctacataaaggaaagaatgttttatgaccatatataggaaacgttcgctattgaaga

SEQ ID NO: 8585 - DNA, 92 bp, Diabrotica virgifera
  misc_feature (6)..(77): n is a, c, g, or t
  misc_feature (82)..(82): n is a, c, g, or t
aaagcnnnnnnnnnnnnnnnnnnnnnnnnnnnnnnnnnnnnnnnnnnnnnnnnnnnnnnnnnnnnnnnnnnnnnnnnatttnatttatatat

SEQ ID NO: 8586 - DNA, 841 bp, Diabrotica virgifera
  misc_feature (13)..(13): n is a, c, g, or t
  misc_feature (16)..(16): n is a, c, g, or t
  misc_feature (23)..(23): n is a, c, g, or t
  misc_feature (25)..(25): n is a, c, g, or t
  misc_feature (524)..(541): n is a, c, g, or t
  misc_feature (575)..(595): n is a, c, g, or t
  misc_feature (742)..(742): n is a, c, g, or t
ccctttaagtccnggnggatggngnataaatcgattaaattttccttgttttttatgaaagtttttttacacgtacatatattctttatctagtaaatgagaattggctttaacaattgaccatctcattttatctgtcgagcttaacgggcttaataggatacaaagttggtatgacccacgtgttaagataagtagacagacctggttcaaagatgaacaagaaagaaattgtataggttgtaataattttggaaactccaaccatggtaattgatggtgttgacgtttacatcgaaactccacatgtgtcttaatgcttagcacacagattgttatgaggatgtcatggaaaattgtatcaggtacttctacactatttggtactattgtttaatatacggaatatgacagaagtttaccagtattggagtgatgattcaaaaattaaagtaagcagttcaatgcctttaagatacattgttttattatgttgagatgcctcatagatgtcattatatttnnnnnnnnnnnnnnnnnntataatagaattagtgatagacggtgtgtgagannnnnnnnnnnnnnnnnnnnnttatcccatgtacccttatgatccttgtaatagtaagataattgaattttgattttgattgttttaaatgtttatttaatagtatttgtatattggatttattaaattattatgaaaattttttatggattttgtaaggtttggatngtttatatttggtgggggtaaagggaaaggtatttatttattagttttgggggaaatgttgtttggaatttgatggtttgtttatagtaaatggtttat

SEQ ID NO: 8587 - DNA, 745 bp, Diabrotica virgifera
  misc_feature (2)..(509): n is a, c, g, or t
  misc_feature (702)..(734): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagaaaaattaccttagggataacagcgccatttaatttgagagttcaaatcaaaaaaagaatgcgacctcgatgttggattaaggttaaaattggggacgcgactatttattaagtccggtcgcactttaaaaattttaaatgattcggggtttaacacccgggggggaccccggtggggttttttatcnnnnnnnnnnnnnnnnnnnnnnnnnnnnnnnnncagagacccaa

SEQ ID NO: 8588 - DNA, 510 bp, Diabrotica virgifera
  misc_feature (24)..(25): n is a, c, g, or t
  misc_feature (27)..(28): n is a, c, g, or t
  misc_feature (31)..(31): n is a, c, g, or t
tcttctgcgtccggctttgatcgnnannagnggaatggaacccttttaaagagacacagaccgacctgcagagacgacacaaaaggagaaggccaaagaaaagcggcgggaaggggagcccaacaacggagaccaacaaggggccgcagcgaacgcccaacaaacaacccaaccacaaaacgccccagcccaaccacaacagcagcactaccaccaaacagaggccgaacaacaacaagccatcccacacacacaaacgagcaacaaggacgcaacagcaggagcagccccaggacaaaaggacactaacgcaccacaaaccgcaaaacagcaagaacaagaccccaagcagacgaagagaacagccacaccaacaacagcaccaacgaaacaaacaacaaccaaagccagaagaaacagaaggcgggacaacaagccacaagccacgacgacgccgagacccaccaaaccgaacaaccagccaaagccgacaacagaccccaacccaaa

SEQ ID NO: 8589 - DNA, 200 bp, Diabrotica virgifera
  misc_feature (65)..(78): n is a, c, g, or t
  misc_feature (81)..(103): n is a, c, g, or t
  misc_feature (111)..(133): n is a, c, g, or t
  misc_feature (163)..(194): n is a, c, g, or t
taacagcgtaattttattcggagagttcaaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8590 - DNA, 496 bp, Diabrotica virgifera
  misc_feature (218)..(241): n is a, c, g, or t
  misc_feature (295)..(314): n is a, c, g, or t
  misc_feature (440)..(466): n is a, c, g, or t
atctgaatatttgtcagcatatggaaacaatagtggtgtcaaatgatagattattattattgagtgagagatatgttattcttataatggaagactttctttattgcaccttgggtatgccggatgataaatgcatagcttatgaatctatcattccagaagttttacgacctccagaattataagctgttatcaggaggaaaagactttaaataacnnnnnnnnnnnnnnnnnnnnnnnngattcatgtatatctagtactttaagaaatacagtaaatttatttattatcggnnnnnnnnnnnnnnnnnnnngttatattgattaatattaaatatttctagggaggcgctctaagaatacaacttctattaagattacatgtccaaataaatgtgacgattaataattttcatactttagaatcatgttattatagnnnnnnnnnnnnnnnnnnnnnnnnnnnggtatacagtttttcttatcatatacattt

SEQ ID NO: 8591 - DNA, 570 bp, Diabrotica virgifera
  misc_feature (368)..(477): n is a, c, g, or t
gtacagtgaatttaattaattaatcatgtttaccaagattgtagctcttaccacactcgtagcctgtgctagcgcaggtttccttggtggattaagtggacatggatatggtggtggacatggattagcccttggagcagtctcagttgcgcatgttgcaccagttgctattgcacatgcacaaccctcacacgagtctgttgattactatgcatacccaaaatacgaattcaactatggagtcgctgatggccacaccggagatcacaaatcacaaaaagaagtccgtgatggtgacgtagtcaaaggttcctacaccgtagctgaacccgacggtactctccgaactgtacactacaccgctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttaccattgatgatctcagacggctagaaatgttgcttattcatgtatatatctcataagttgtttttagtgttgtcttttttttttttt

SEQ ID NO: 8592 - DNA, 747 bp, Diabrotica virgifera
  misc_feature (621)..(639): n is a, c, g, or t
atttatattattcaccttgtttttatttttctgatttccatctaaaggccatcatcttcattggaaattctattcttcttctaattactacggtccctatccttactaggatatgacccttctaatattgttattgtcatttcccttgtatatattatactttatgttataactgttccgattgtcactctggatattgtaaatcgagtagatcccttaataatcgtggctcccgatatatcatgccctccaccaaataaaataatatatagatcggttcccccgtctcctttatcatcagtattattaaggatatgatatgggttttctgtgaccacctgataaatatacccacctctgacatctgacattgccattgtctgtccatctctatattctcttattcctaaattacttttatctggcatttattaaattccatgtgtgaatacttttattacgacggtcatctttatacgatcaatatatataatctttgatctcatacccctatatgtctgagcggtcgcaattacagtaatccttcttctatcagctataccagtctgagatggagctattacaatattattaccagatcttaatataaatacatcattnnnnnnnnnnnnnnnnnnnggtgatcctattctctatcaacatttattctgatatgttggacgtcctgctgtatatattataattttaccaggatttgtattagtatctcatattgttaggcaagag

SEQ ID NO: 8593 - DNA, 548 bp, Diabrotica virgifera
  misc_feature (20)..(40): n is a, c, g, or t
  misc_feature (57)..(83): n is a, c, g, or t
  misc_feature (88)..(109): n is a, c, g, or t
  misc_feature (199)..(220): n is a, c, g, or t
  misc_feature (268)..(299): n is a, c, g, or t
  misc_feature (301)..(314): n is a, c, g, or t
  misc_feature (316)..(332): n is a, c, g, or t
  misc_feature (354)..(391): n is a, c, g, or t
  misc_feature (402)..(428): n is a, c, g, or t
  misc_feature (432)..(452): n is a, c, g, or t
  misc_feature (467)..(497): n is a, c, g, or t
acttatttcattaatctccnnnnnnnnnnnnnnnnnnnnnctaatatctgatattcnnnnnnnnnnnnnnnnnnnnnnnnnnngttcnnnnnnnnnnnnnnnnnnnnnncaccctttaacttgtggtttaatattattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncaaataatttaatcnnnnnnnnnnnnnnnnnnnnnnnnnnnnnnnctttaattgcagtagtgaaaattacaaaattcttatatggcccattacgac

SEQ ID NO: 8594 - DNA, 844 bp, Diabrotica virgifera
  misc_feature (150)..(167): n is a, c, g, or t
gtaacaaattagtctgaccctgcaaaagttatttgacaaattatcttaagttgacgaaattgtcttctccaattatatatctaaatcttttacagctacttggtaaaagttacgtgtccgttaataaaaaatacagatcatgaaagcagnnnnnnnnnnnnnnnnnncattaatatgcacagtacataactacaatgttctcataattagcccaatggtttcatctagccatttttatcttggaaatgcattaggaagaggtcttgtagaagctggacaccaagtaacagtagttagtccttacgaagataaaaatccgttaaaaggctataaagatgtagttttaacaggtttagcacaacaaaaaagagatatttctccactggacttttaccacatggatccattttccataagtagtcactttgctgatgtgggcaccggaattgtcaacaatatattcaatcatccgaattttaaaaacctcattaattcgaatgaaaaattcgatgtattaattatacaatacttcagatcagatgctttaaacatttttacaatgtcattacaatgctcctctgattgtttttagtatagttgtaccaggtttttgggtaaatcccatagttggcagccctctagaaccgtcatatttcccagatttttttgttaaatattccagtaatatgaatttttgggaaagaacggttaattcacttcttctcttatttaactatgtacacaaacatttatattttatccccaacaaaaaaagttgatgagcgaacattttccaaagtgtactgatcaggatgcagcgttttacaatgcttcactggtattt

SEQ ID NO: 8595 - DNA, 828 bp, Diabrotica virgifera
  misc_feature (756)..(756): n is a, c, g, or t
attgagtgattttttgcagaagtgattaatttcatcttgtttaataacagtaaacgctgaaaatgacatgagaaagcatgtttgtgcaagaaaaatgccaagcacccaagcacaatgtattttgtattgtttatcacgtgacctatccgattattatggcggaaagatcggacaacgaccataaagtaaaattttgacattcccatttgttgtttgtcgtttgttttcctaatctaccacgtgtattttattcaaagattgacagttgaccccaaggatgtcaacaagaggtatgaaaaagagggggcgtccccctaaggtccaagtagcagaaagaaccaaaaaatttcagatacaccttcttaagaaacccaaatatttgttaaattataaaggtccagactctcagtcaagtactccaacagcttctagagcatcttccccacacgagagtgagtctagtaggcgtagtagtaatagaattaggggtaaagatgggcatagagctggtcgaaaatctggctatgctggatctgtttatcaacgtaggggctacaatacagccccgaatgactatcatgaatctgagtaccattatggctcagattttggagatgattccagtgaaaacaaaagtgatatcgaagatgaaatggggttgagtgagagtgaatctgaaggatctgtgcctgaccgtggtagtgatagtgacttttcattaagtggttacagtactgttagtggaactcctcgtanatgttacagtttgaatagggcacccacgccagatcctcctctatggctacaaaaccgtgaaatacctcccct

SEQ ID NO: 8596 - DNA, 686 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (630)..(630): n is a, c, g, or t
  misc_feature (633)..(682): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattanacnnnnnnnnnnnnnnnnnnnnnnnnnnnnnnnnnnnnnnnnnnnnnnnnnnttac

SEQ ID NO: 8597 - DNA, 137 bp, Diabrotica virgifera
  misc_feature (10)..(99): n is a, c, g, or t
  misc_feature (107)..(132): n is a, c, g, or t
ctggaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagnnnnnnnnnnnnnnnnnnnnnnnnnngtata

SEQ ID NO: 8598 - DNA, 245 bp, Diabrotica virgifera
  misc_feature (16)..(92): n is a, c, g, or t
  misc_feature (97)..(238): n is a, c, g, or t
gctggatggaaggggnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttt

SEQ ID NO: 8599 - DNA, 416 bp, Diabrotica virgifera
  misc_feature (2)..(70): n is a, c, g, or t
  misc_feature (82)..(189): n is a, c, g, or t
  misc_feature (192)..(245): n is a, c, g, or t
  misc_feature (250)..(301): n is a, c, g, or t
  misc_feature (304)..(331): n is a, c, g, or t
  misc_feature (386)..(410): n is a, c, g, or t
cnnnnnnnnnnnnnnnnnnnnnnnnnnnnnnnnnnnnnnnnnnnnnnnnnnnnnnnnnnnnnnnnnnnnncttaataaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnntatgnnnnnnnnnnnnnnnnnnnnnnnnnnnnnnnnnnnnnnnnnnnnnnnnnnnnggnnnnnnnnnnnnnnnnnnnnnnnnnnnncccaataaaggtttatacaaatttttataaagcttttttaagcttcccatttggnnnnnnnnnnnnnnnnnnnnnnnnnggggag

SEQ ID NO: 8600 - DNA, 853 bp, Diabrotica virgifera
  misc_feature (686)..(708): n is a, c, g, or t
  misc_feature (765)..(785): n is a, c, g, or t
tttaatttttaattatcatactttgttaaatttttttgataaacacgttcaaagtttaaacaataagtaatggaagtaaaacaagaagttagtgatgagacgtgtcaagcagaaacgtgttataatgctgttgatgatggtcctttggatatttgtaaaattgaagttaaagaggaacccaaaagagaaagtatacatgatacatttgattatgtagcctcaaaggaaattcccataaaaactgaagtagaacaagacgaacataaacttacgtcatttaaagaaagacaaacaattccaagagggttggtagtttacgagatatagcgcgaaacccctttgcacaccatttccaagatggcggccggaggacaagggtggcgaccccaaaaacttgaacttaagcttctacccatccccctacacattaaagaaataaaactgactcctctaacaaatgcaagattttctccaagacaagatgggaattaagaaggcaacaactgaacattcacctcacaaaggaacttgtatgaatccacatgctgaaggaaaaacatcaacgaaaaatttgaaagtggttactgggaaaagaccgtacaaatgtgacatttgctacaagcagtttagggatggaagtaaattgaaaacacatttgagagtgcacactggtataaaaccttatnnnnnnnnnnnnnnnnnnnnnnnatttaatcgagcaaatcagttgaaagcccatttgagagtgcaccctggaagaaaacnnnnnnnnnnnnnnnnnnnnnggatgaagttaatggagcaaaaagtttgaaaatacatttgaaaagtggaccactgggggaaaaacctt

SEQ ID NO: 8601 - DNA, 388 bp, Diabrotica virgifera
actacagacgttattgatgttgtaaaacagtaccctctaagactagcccatagagggtactgttttactacagacgttattgatgttgttaggttggtacagtaccctctatgggctagtcttagaacttttcgcattctcctcttataacacatagcatttctaatttttcaacataaacatatctgtatcaatattgcatagattaagttgtagtactagtcagttttgctctctaacttttagcaaacaactacttaaaaatttctaacaaactgttgatattctactaagtttctcatgttccttcttttctctctttgtaggtcttaaagtttgaaacgaacaattttataactagttttaggaaaaaataaactattttagc

SEQ ID NO: 8602 - DNA, 478 bp, Diabrotica virgifera
  misc_feature (2)..(27): n is a, c, g, or t
tnnnnnnnnnnnnnnnnnnnnnnnnnncgatatagacttaattctgatatagccaacatactttctgatcacaccaaaaagatgattgagcataggtcgctatctgccccaggggattatcactgtcatcagaccccgcaaacaatgaataatcagtcacctgtggaaaattcttactcagcggattaaaatttgcaaatacaggacttcattgaagaaaatgaggatcaggtagaagaagacgcagatgacgtgcgatgatcaagatgtatacgttgaagacgaacacgacgtagaggccgaggtccggacaaatcaaacaggatgatgacactttttatagtgagtgacgtcaaaacccgagcactttctttggaggactatctcagcgccaacccgcgagctcctttgcgcacatttcaatttgctttttcacttagtcggtggacaatgcgccttacacgacaggatgttccat

SEQ ID NO: 8603 - DNA, 935 bp, Diabrotica virgifera
  misc_feature (53)..(73): n is a, c, g, or t
catggatgaagccatcaagagcgtcaataaaggaagactatacagaatggcgnnnnnnnnnnnnnnnnnnnnntgttatgcaaacgatacaatatgtaccgatagccaaaatgacgatagcctttaagggttagctcacaagagatcaagtataaagaggaaattgattagaaggatgccttagtaacactatatggagtaagggtatgccacacctgccatcgatccgatgaatcgtcggatcgacgcaacacatcgcaacgcaccgatgggcctttcgatgcgttgttccgttgcgacgtcgcaacgcaacgctgcgcaacgcactaatggggccacgtcccgatgagttggtccgttgcgacctcgcaacgcaacgcagcgtaacggactaatggggcctcgctcttatgaggcctcgctctaactcacacatcaactactgtgggatgaaatcaagaatttataaggacagtataagatcaataatgacgtacgcatcagaaacaagactcgacgcaatcaaaacacacaaaaagattaaacagtaaagggagcgttcaagtattacgtaacgcaatttttgaaaaattttgaccccactccccctcatgtaaagcagcgtaatatttttctgtaccccctcctcctaccaaaccattacgtaacacccaaatgaccattttaacctaactggaacaattatgttgcgaaaagtactggagagtcggtaaaaaattaatttaacagcatttgtggtaataataaaaacttaacataataatcttttactactaattttttgcgttttcccctagtggccccatcctttattacatattttttggcttcatcctttattgtttttctcatgtattaaactatactgtatatggacttcagaaaacgagtagacaaacgatttatgactctct

SEQ ID NO: 8604 - DNA, 774 bp, Diabrotica virgifera
  misc_feature (11)..(32): n is a, c, g, or t
agtgattaggnnnnnnnnnnnnnnnnnnnnnncatgtaatttgaaacaataaatattgagctgtgtcataatttcaaactcattatgttgcagtcttttccagttgattagttgataaaatttcaattcaaaaacttagatttgcactgtatggatggcacaggaagagaacaagactacaagaacatcttattatgaatgtatatgtatgtgatcctcaaaaaattattttacaaaacaagatagagaaagagctttaaaatcccaaggatcctgcaaaatgtttatttggtgtactagtcgaataatagtatctaaaaatattgaaactattttaaaacacattacgggcatgaggatgatatagagcacttacataaataccaaaatcagataaatatctcttcaaagtttattttgagactttcttcaaaaatgtagtaaacttcagactgttcaggatagcataatagcataggaggcgaattaaaaagaattgatttacttacaagaaaagatatcacaaacattaaactcccttatggcattgatttgaaagatgggtatatgtaccatgatgatgcaaccagtgtttatttttgggttgaatgcttacagacttatgtccaatattattttacaaacaacagggcatactaatggatattcattctgaatttaacatttatgatttttgtcttattttccttatactgtgccaaaagaaatgttaattaagtttggaaaatctttatcgcaatcgatggaactcat

SEQ ID NO: 8605 - DNA, 63 bp, Diabrotica virgifera
  misc_feature (3)..(19): n is a, c, g, or t
  misc_feature (24)..(62): n is a, c, g, or t
gcnnnnnnnnnnnnnnnnncgagnnnnnnnnnnnnnnnnnnnnnnnnnnnnnnnnnnnnnnng

SEQ ID NO: 8606 - DNA, 918 bp, Diabrotica virgifera
  misc_feature (320)..(844): n is a, c, g, or t
ttgacgaattcttcgcagagaacacttactttactttgcagtgtggtgttgccacctcctcctgagcgcgccaaatataagtgggcgttttcgatttacaaggatcccgatgtgagttacggaatgccaatccaaatacgaaaacgacgcgatagatatccaacattccgatttcgaataattacgattcgacttgtgtcatttctattcgttttgttaaaagttacagaatagggcagaatttcatgttaagttatgtgagtacacacagaagaacagtactgtatacacttaatataaaaaaatcattcctgaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatatattagtataaaaaatgtatattagtaaaatattagttttataaggaatcggcacattttttcactg

SEQ ID NO: 8607 - DNA, 105 bp, Diabrotica virgifera
  misc_feature (2)..(24): n is a, c, g, or t
  misc_feature (26)..(88): n is a, c, g, or t
  misc_feature (90)..(103): n is a, c, g, or t
annnnnnnnnnnnnnnnnnnnnnngnnnnnnnnnnnnnnnnnnnnnnnnnnnnnnnnnnnnnnnnnnnnnnnnnnnnnnnnnnnnnnnannnnnnnnnnnnnnga

SEQ ID NO: 8608 - DNA, 915 bp, Diabrotica virgifera
  misc_feature (427)..(458): n is a, c, g, or t
  misc_feature (766)..(787): n is a, c, g, or t
  misc_feature (838)..(838): n is a, c, g, or t
  misc_feature (872)..(872): n is a, c, g, or t
aactacttgaaaagtaattctgattgaagaaaaaaatgagattattgaaaatgaaagacctattttaaacaatttaaaaaaggaatcaaaaaagtagttcgatattttaaatttagttggtacagtgaaaatccttggttatgtggttggaagaaaaatagaccgtattgttggccatgtcttctggtttctacaaaaaaatgggtggaccaagttcacggtttaaatagttttagagttttaaaaaagagacatgaaatttctccgttacctacatgtaagatgtagggatgggaaaaacctaccggttttaacctaaaaccggttttttacctcgtaataaccggttttatcggttgctttttgtcccggttttaatcggtttttcttttcaaagtaataaccgtgaaaaaccggataagttatnnnnnnnnnnnnnnnnnnnnnnnnnnnnnnnntttgcttaaattcatcagtaactcttgatttgtttaatgttatattcgttataactcactaaaataatatgtttaagaaatgtgataagctggattggctattttgatgaacttgagaattagcacctcttatttattgaattggggaatcctagcaaaaacggatattactatcaatcatctgtgcagtctacatagttgtattatatgtaattgtatagagaggctataccgacacaaacgagaataagcttatattttatcattaataaatccagaagaaaaaatcattcctgtgaaatcacttnnnnnnnnnnnnnnnnnnnnnngttttgtgtatgttgtgtaaaagggaattattgtttttcagaaatacaacngtgcaaaaacatttagggcaataacacatccaantttagaattttaacaatgatttctttatttgtttttataagtt

SEQ ID NO: 8609 - DNA, 432 bp, Diabrotica virgifera
cggacgcgtgggatgcaaaacaccacatacacttgtaatattcaatgtcggttacgtaggattgacttggcttgcccatgctaaattgaaccgaacttgacttcttagagcaggagacgcaccacatacccagacgcggctgcaccgatcaagagattagaagtttatatttattgacagccggatttattattgttatttttctacttatcaccaggcatatgagtgaatagtgagattccaagataaacgccctacccttctttcccgctccaccacacatcactgtgtaatgtctcccatcttactatatgttcttatacacccataagctaactattattaagtctttgatgctgtagctatctaccagcacttttacaacattttcatcttttattattgaacattgtaataactgtataatatgta

SEQ ID NO: 8610 - DNA, 454 bp, Diabrotica virgifera
ctcgcgcctggtgttacatcccaagaatccccttaagtggtgatgaagattttcttggaagccagcatagacttaattctgataaagccagcatatatttctgatcacaaaacaaaaagttgactgtatagatggttggtatctagccggagcgggataaggacctgtcagcagactctggcaaatagtgaatactgcagacacgtggggcaaatactgatgcagcggattaagatgagcaagtacaggacttcattgttgactatgtggacttggtattagaagacgcagctgaaggggatgacgaagaaggatagggtgaacatgagaaggatgcataggccgagggagtagaagaagaataggatgttgacgttttttaaagcgccctgccgtcaaatcctgtgacactccattggccgactatctcacgtgaaaagactcgagttactcc

SEQ ID NO: 8611 - DNA, 325 bp, Diabrotica virgifera
ctttgatatgtaggtgagttagtggaacttatcaaaaagacaacatattttttagaacgaaaataaggggtgtagcgacagggtcattgtggtccgatggtcaatagctgaatcctagcatccagccattcgtgatctaccagtgccctgggtattgttagttattattggctaaaatttattcgtccagatattcatttatgcccacgtcgaaggagtggtaggatgattgtcgtttcctgtttgattaagatagacagtctagatgtcgaaacgcggaatagatcacgaaaggaaaaacactactagtggagacactatttat

SEQ ID NO: 8612 - DNA, 678 bp, Diabrotica virgifera
  misc_feature (203)..(230): n is a, c, g, or t
  misc_feature (326)..(343): n is a, c, g, or t
atcttatgtggaggtagtaggaagccatcttatcaaatttagaaattattaatattgatttgcattatatttgagttaaattttatctgtggctctgagttaaatattttttatctttactaaaatgtaagcactaatatatctctaagaaaatatttaccgctacagattcaactattttcagttaccattgcacaaaatgnnnnnnnnnnnnnnnnnnnnnnnnnnnngagggatatggaataaaaattttagtttacgattagcattactattagtagaatcaaaagtactgcataaaccaagttagataggtaaaggctccnnnnnnnnnnnnnnnnnnataaaattgcattacaactcatccattagtaaaaatgtatgccatttttattcagttgcaatgcgaagagcaaaagaatgttatttttcacttggaatacggagcatcatatccagcactctgaatcaacgattttctactcttgttggagtctcatcgaagagaacgtatgactgctgctatctgctcaaagtgaccaaaccatgaaagattatccccgcattgcaactgacatgtatggagtaggtgactagcgtcatatgtctactgaaaggtatagttatcaatcctattagcaacattaatattattacaatatattaccaatattacta

SEQ ID NO: 8613 - DNA, 159 bp, Diabrotica virgifera
  misc_feature (3)..(3): n is a, c, g, or t
  misc_feature (41)..(42): n is a, c, g, or t
  misc_feature (96)..(96): n is a, c, g, or t
  misc_feature (128)..(149): n is a, c, g, or t
tanattaccttagggataacagcgtaattttattggagagnntcaatcgataaataagattgccgacctcgatgttggatttaagtttataattgntgtagcagctatatttattaagtctgttcgannnnnnnnnnnnnnnnnnnnnnagtttaaacc

SEQ ID NO: 8614 - DNA, 520 bp, Diabrotica virgifera
  misc_feature (22)..(321): n is a, c, g, or t
  misc_feature (328)..(365): n is a, c, g, or t
  misc_feature (385)..(398): n is a, c, g, or t
  misc_feature (401)..(423): n is a, c, g, or t
  misc_feature (431)..(453): n is a, c, g, or t
  misc_feature (483)..(514): n is a, c, g, or t
gattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8615 - DNA, 376 bp, Diabrotica virgifera
  misc_feature (32)..(54): n is a, c, g, or t
  misc_feature (60)..(184): n is a, c, g, or t
  misc_feature (186)..(303): n is a, c, g, or t
  misc_feature (319)..(341): n is a, c, g, or t
ataaatgatgatatagtaagataatattatannnnnnnnnnnnnnnnnnnnnnnggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaaggaaaagacnnnnnnnnnnnnnnnnnnnnnnnggaagacttttttaacaataagttgagttatacta

SEQ ID NO: 8616 - DNA, 636 bp, Diabrotica virgifera
atctattaaaagattattcagattgtctaatcgatatacctaacatttttttgaaataaactattgatgtaatactacatgacgttttatgacgatctccgacgttttccgacttggaaccgccaggatgctccataggtcctctttaatgattctttctcacagctctatgtttctgatccttcgctcctacttgtcctcattctacctcgatatctcttttctcctggttgccattttatgacttcccttggtattcatagctcatcctttcttatgttatgtacaaacaagttaagttgttttatcaatattagatacatgtatgttcatttgattcccaatatttctctattgccttcattgtaaaatcctatctcatctaaatttttctgtcacaattcttataaaatcttttcccatttgctcccagtgtagcatatgttcttacaaataagtattaccatactgcatgtatgagtgttattttaccttatagtctcatatatccgtattaaatatgctttgatgatggataggactcataaaatgttgtaaagtatattccacctgtcatatttttctctcttatggttttgatcttgttacatcgaagctaaatattttatatccatg

SEQ ID NO: 8617 - DNA, 227 bp, Diabrotica virgifera
  misc_feature (6)..(219): n is a, c, g, or t
gccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttatt

SEQ ID NO: 8618 - DNA, 499 bp, Diabrotica virgifera
cccagaagcccgaaaccaaaatgactgacaacaaggctgatgatgcacccccagacccacccccacaccctggaggacaccatggacgtaactctggcactccaacaggccctccaaaaagcccttattcccgacgtaatccaccatggattgcatgatgctgctaaagatgtggataaaagacaagacaaactatgagtgctcgttgaagagtgcgacgagcctatggataagactctatactcaactctatgctcagaacaacgaactcatcttattattgcacacaataacgaaaaataaagcgagagatcaggggaatgcaaaattgaaaacactgttgaagaaccagaggacgctggatgtgcctgtgtatgcaccagggactatgtaaaagaatccccagaccaatatgctcttatagatgatcttaagaatgataataaaagtgacacataatgtatctaataatatatataatacaatataaaattcaaaa

SEQ ID NO: 8619 - DNA, 197 bp, Diabrotica virgifera
  misc_feature (85)..(85): n is a, c, g, or t
  misc_feature (91)..(91): n is a, c, g, or t
  misc_feature (97)..(97): n is a, c, g, or t
tcatggtagtacgtgttgacatggttgtagtattttttgatgaaggggatgatgaagaaagagaggctgaagatgcggaggatgnatagcntgaggncgtagaaaatacaataggatgatgaggatttctatagtgccagacgtcaaaccctgagaactttacttggcggactattttatgggaaagtctcgagata

SEQ ID NO: 8620 - DNA, 299 bp, Diabrotica virgifera
ccctgcgggcaccgccccagaaatccccgggaccccctctttgcgcccgaaattttcaactatacaaattttattatatcctctgataaagactactgtgatagccgagtgagaaagagtaatctctgtaacagccaacaactttttacaacaaaacacaagattccagccaaaatatccttatcgtccgattccctttatctcaatcctaccatccagccattctagactcctctgtcccttggcaaatgatcgttatcagcggcttaaaattcacacgtctatagcttcattgaagc

SEQ ID NO: 8621 - DNA, 900 bp, Diabrotica virgifera
  misc_feature (577)..(594): n is a, c, g, or t
gattcagaacaacaagaagcagatacccttattccatttgtgtagtccatggcgtggcacaagcacgaacacgtaatgctcatggataaaaataaaccaaaaatgccagtagcacctggtggtggaggagacatgtctcttagtcaaaggcggcatgttcctctctatggccgcttagtagctgaagacactttggggatcccacccatggcaaattcctcatccactgatattcaagctatgcaagcaagaatacctcctacctttagggactcatcttcagcaccccttagaaaacttagtgttgatttaatcaagacttacaaacatataaatgaagtgtattacgctaagaaaaaacgaagggcagcccaaattcaaggagaagattcttctcataagaaagagaggaagatatacaatgatggttatgatgatgacaaccatgattacatagtgaaaaatggtgaaaagttcctggagagatacgaaattgattctcttattggcaaaggttcttttggtcaagtcgtaaaggcatttgatcatgttgaacaatgccaggtggctataaagnnnnnnnnnnnnnnnnnnccctttcttaaccaggctcaaattgaagttaaattattagaaatgatgaatagggccgacgttgagaataaatattacatagttaaattaaaaagacatttcatgtggagaaatcacttatgtctagtgttcgaactattatcttataatttatatgatttacttcgaaacaccaatttccgtggtgtatcattgaatctcacaagaaaattcgcgcagcagctctgtacagccttactctttctttctactcctgaactgaatatcatccattgcgatctgaaaccagaaaatattctactatgc

SEQ ID NO: 8622 - DNA, 211 bp, Diabrotica virgifera
  misc_feature (3)..(3): n is a, c, g, or t
  misc_feature (73)..(73): n is a, c, g, or t
  misc_feature (85)..(85): n is a, c, g, or t
  misc_feature (93)..(111): n is a, c, g, or t
  misc_feature (114)..(114): n is a, c, g, or t
  misc_feature (134)..(134): n is a, c, g, or t
  misc_feature (182)..(206): n is a, c, g, or t
tanattaccttagggataacagcgtaattttattggagagtcaaatcgatataaagattgcgacctcgatgtnggattaaagttnataattgnnnnnnnnnnnnnnnnnnnagngtctgtcgacttttaaattnttacatgatctgagtttaaaccggtgtgagcccagttggtttctatcnnnnnnnnnnnnnnnnnnnnnnnnngaaag

SEQ ID NO: 8623 - DNA, 220 bp, Diabrotica virgifera
  misc_feature (76)..(76): n is a, c, g, or t
  misc_feature (93)..(93): n is a, c, g, or t
  misc_feature (96)..(116): n is a, c, g, or t
  misc_feature (127)..(149): n is a, c, g, or t
  misc_feature (183)..(208): n is a, c, g, or t
gaataaattacctttagggatacagcgtaattttattggagagtcaaatcgataataagattgcgacctcgatgtnggattaagtttatattnggnnnnnnnnnnnnnnnnnnnnngtctgtcgacnnnnnnnnnnnnnnnnnnnnnnnagtttaaaacggtggggagccagttgggtttctnnnnnnnnnnnnnnnnnnnnnnnnnngaccaaaaggac

SEQ ID NO: 8624 - DNA, 173 bp, Diabrotica virgifera
  misc_feature (144)..(171): n is a, c, g, or t
gtacgctccatataagagctaccccattactaatgtaactatagattatatttatattactataggtaattatttcccattgtcattttagagttacatagtttgtatttttctaactcagaggttgtcaaaaatctaagtagnnnnnnnnnnnnnnnnnnnnnnnnnnnngc

SEQ ID NO: 8625 - DNA, 105 bp, Diabrotica virgifera
  misc_feature (2)..(45): n is a, c, g, or t
  misc_feature (47)..(87): n is a, c, g, or t
gnnnnnnnnnnnnnnnnnnnnnnnnnnnnnnnnnnnnnnnnnnnntnnnnnnnnnnnnnnnnnnnnnnnnnnnnnnnnnnnnnnnnntctcacactgcccactga

SEQ ID NO: 8626 - DNA, 492 bp, Diabrotica virgifera
  misc_feature (51)..(73): n is a, c, g, or t
  misc_feature (95)..(118): n is a, c, g, or t
  misc_feature (187)..(211): n is a, c, g, or t
acatcccaagtagagttccttttattctaagtataatttcgaacagctgannnnnnnnnnnnnnnnnnnnnnnaaaatgggaaacgaaaagatannnnnnnnnnnnnnnnnnnnnnnncgcgtaccttgtggaacatctactactactgagacatttaaattactattgtgttggtatcgacaatannnnnnnnnnnnnnnnnnnnnnnnnagccccagaatcggataaaggcttcattcacaagtgcatgagcacgagattagccgtagcgtcttcctcaacagataaattacaattgttactgttgaagtgcatatataatccactcttcatacatcctaacaacagagtagcgattggcctgtcataagcaatatcatcgcatttccctgaagtcatctaagtagactcacgagtaataattatcgcaactgagtatcgtcataccatatctgaatatataacaaggagctatctcgccaaatcaggat

SEQ ID NO: 8627 - DNA, 821 bp, Diabrotica virgifera
  misc_feature (611)..(611): n is a, c, g, or t
cacgtattcgtgttcagcagccccaaggacctgtgactaatccgtttgcattagtgtggtgccaacgaccctcgaaactccaggagcacctttcgcggaccttggaaatcaggtgctccgggagtcggttcgggtggcatgtttgtgtatagcgacctcaaggggcgctccagtggttcatttgcatcggttaaatgccgagagccatcggagctctggaagattacgtcccttgcagtggccctggccgcgccgtcatccggtcaattctgatggtatattcgtgtttggcgatgccaagggcccgtgagtggtctgtttatatcgatttaatgccgagggccctcgaagctctagaagatgacgtccgttgagggtcggggtcagagtgggggtcgccattggatagccaggaaaaagttcttgactgctagtacttttccttgatccaaacttctacatgttgccaagtagccagtagctcgcggagttggagtgccccgtgaatcttataatttttcgagtttgggcgtttttcgcggtttcgagagtattttcccaaagagtgagcgaaatccactgggacctattttccatgaggtttgtgcggngtcctttggcattaggatttttgactatattagataatttttttatctttttttagtacattctgatagcatcagttttctactttcatttggcatatccagaactgccctatcttcattattttctgtcttatgttattgcaaaataaaggtctctgggataaacaattagaatactcctaaactaattaaatggatcggtctcaaatt

SEQ ID NO: 8628 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8629 - DNA, 137 bp, Diabrotica virgifera
  misc_feature (2)..(98): n is a, c, g, or t
  misc_feature (102)..(136): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgnnnnnnnnnnnnnnnnnnnnnnnnnnnnnnnnnnna

SEQ ID NO: 8630 - DNA, 942 bp, Diabrotica virgifera
  misc_feature (790)..(790): n is a, c, g, or t
  misc_feature (798)..(798): n is a, c, g, or t
  misc_feature (902)..(902): n is a, c, g, or t
  misc_feature (925)..(925): n is a, c, g, or t
caagaggaaattccagtacaacatgaacgcaggcagacctgtgacgccgccaagaggcgcaacgaataaaaacaagaagaagtgaatgaataatatatttataaggttaggtttagtcgcaacataaacatgttcaaaacattttaaatactaaaattttctaaaggttacaaagattcaagataaattaagattttcttcatgtttttgttggttgttttataggttaagatagtaaactatataataataaagttctcaatattgttaaaaagaagtgaatgttagtatttaaaatgttcgattatttcggccgttttactttattttatatctgatattactagaaaagggtgatatctatgaacccagacaactaaacgttcgatttgaacaaatgaaaatttattgaaaacattaatcctcacagccttgcttatttaattaaagaacaagatcagtaatacattaaagtctatcattaataatacttggtttgtataaactttggtgaattaattatttttctatttggtatataactattaatttctataaacttgctgaaaaaaattggtgaattatgggatagtttctacattgtcttgtgtcaatcctaagtaacaatgcaacaaacgcaggattgctgcggttctaaagacatgtggtgatgttgttaccccattcgctaggaaccgcaaagtgggcgacgtctggtggtaaatatcaaaagcatcaaaacatagggcatttcaacattctgtcaaaattaaatcaatatggctgctgngaggcaancaaatgttattctgtcagttcttaatgtgtttcttaattttctaatgtatcgcgcgtcatgtgaacggggtctaagtttccactgcattttagcacagaattgngagacctagatgaaagtcacggntgattgaggatgagcat

SEQ ID NO: 8631 - DNA, 1211 bp, Diabrotica virgifera
  misc_feature (798)..(798): n is a, c, g, or t
  misc_feature (904)..(904): n is a, c, g, or t
  misc_feature (956)..(956): n is a, c, g, or t
  misc_feature (1046)..(1064): n is a, c, g, or t
  misc_feature (1073)..(1099): n is a, c, g, or t
  misc_feature (1127)..(1197): n is a, c, g, or t
aacatgtgctcgaactacagctgtcactacttgtagccaagtacgtctatctaaaacaattcctctactaatagatgactacaaaaatatactttcgatttctcttgacgaacatactgatacaatatatagtaatgtgtttaaacgattagctgaattaaagcgtttatatttaagcaacaacaagataaaaagtttggaatcaggaagctttgacggtcttagtaaattggaagaattatctttgtacaataatttgttgacaactgttgtcagtggtacatttcgtgatcttcacaacttaaaaatactaaatttgggttccaataaaataacttcgatccctaataatgcttttcttggtttagataatttagaagaaataaatttaagtttcaaccaactagctgagattcctgttcaaataaataccattaagtctcttcggtctttgcatatgaatagcaataaactaaaaagtcttaaagctaattcttttcgtaatttaaataagctggaaacgttaaatctccacgataacatcatagattctttagaagctaaatcttttgctggtctacgcaatcttaagcaattaagtcttaagtcaaattatttgaagcagttcaatacacaagacgttttggaagacttaggatccctacaaatattaagtctcgctattaacgatttgaagtgtgctgatttgagaaatattgacagggaattgaaaagaaagcgagttgacttcgaggcaggtataaataaacaaaatccaaatacataccgaggcataanatgtactaattaataattataaatagtatatttaggggccagttgttcaaatcatggttaactccatggattaagtaaaccatgattaatttaaattccgagatantcttaaattaagtggtccatgcagttaaacttttccggaatttttaaccaanaaactgaagcagtgacaatggtgccaaggtataaataacgacttaaaacaaattttatcatgaaaaatgtacgaaaaaaaattctggggnnnnnnnnnnnnnnnnnnntcttgtagnnnnnnnnnnnnnnnnnnnnnnnnnnntccgggggggggtggttttttttggggnnnnnnnnnnnnnnnnnnnnnnnnnnnnnnnnnnnnnnnnnnnnnnnnnnnnnnnnnnnnnnnnnnnnnnncttttttttccggc

SEQ ID NO: 8632 - DNA, 161 bp, Diabrotica virgifera
  misc_feature (2)..(61): n is a, c, g, or t
  misc_feature (68)..(85): n is a, c, g, or t
  misc_feature (87)..(99): n is a, c, g, or t
  misc_feature (101)..(101): n is a, c, g, or t
  misc_feature (110)..(139): n is a, c, g, or t
cnnnnnnnnnnnnnnnnnnnnnnnnnnnnnnnnnnnnnnnnnnnnnnnnnnnnnnnnnnnnagtatannnnnnnnnnnnnnnnnngnnnnnnnnnnnnngnggtgatacnnnnnnnnnnnnnnnnnnnnnnnnnnnnnnatatcactcataaattttttga

SEQ ID NO: 8633 - DNA, 119 bp, Diabrotica virgifera
  misc_feature (11)..(118): n is a, c, g, or t
agtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8634 - DNA, 96 bp, Diabrotica virgifera
  misc_feature (2)..(86): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnngttggatgac

SEQ ID NO: 8635 - DNA, 127 bp, Diabrotica virgifera
  misc_feature (17)..(43): n is a, c, g, or t
  misc_feature (54)..(90): n is a, c, g, or t
  misc_feature (94)..(124): n is a, c, g, or t
aagacgagaaacccccnnnnnnnnnnnnnnnnnnnnnnnnnnngttttttagtnnnnnnnnnnnnnnnnnnnnnnnnnnnnnnnnnnnnngggnnnnnnnnnnnnnnnnnnnnnnnnnnnnnnnatt

SEQ ID NO: 8636 - DNA, 693 bp, Diabrotica virgifera
  misc_feature (680)..(692): n is a, c, g, or t
atagtacctgaaactcagtacctgctttttaacctcttttagattaatttagtttgtttcctaagtaacctcgacaccttcctgtataagaggaacgtcgattatgtatgtatgcagtttgtttcctatgctgtttctttgtaatatttaaactggttacaagcaaaattccaatctagcgacgaaaaaatctaataactggcgcagagaataggataaatatgtcaacattcgtagcagtgcaaattttaaactcaaattgacatcacgatggcgaagatatccaagaattggcgcagtcgatccaataagtgtgataaagtttctaacagtgacgtttaaaaatatatgtgtccaactacgattatgtaaatttcgaagttatggtggcactaaaagccaaaatactgctcgagtacttttaaaacctctattatactgatcaggaaccaaattagtgacttttttcaaacaactataaaaacaaaccacaaatttttatgtattcaatcaatagtgttttttaatatcttttgaaaatagcatatacattgtcagtaatcttccaaaatattacggctaacatcccagcaaaaagtgaaaaagaaactaaagtcgtttcgcttaggtagagacgttatgtcccaatcagtaaaagaatgaatataagtttgtatagnnnnnnnnnnnnnc

SEQ ID NO: 8637 - DNA, 945 bp, Diabrotica virgifera
  misc_feature (12)..(29): n is a, c, g, or t
  misc_feature (60)..(87): n is a, c, g, or t
  misc_feature (769)..(769): n is a, c, g, or t
  misc_feature (775)..(775): n is a, c, g, or t
  misc_feature (851)..(851): n is a, c, g, or t
  misc_feature (900)..(900): n is a, c, g, or t
ggccattcaaannnnnnnnnnnnnnnnnnctctttataaccctactttttcagttcatcnnnnnnnnnnnnnnnnnnnnnnnnnnnnatagtaattgttcaacatgggccatgattctgagatcacggcttttcttaatttccataaagaccaattaatgagatcaggcgtgccggaacatttgtggaaaagcttatataaaaagttggtaaaacagacatttgatgcttccagtacctttgatttactaaaaattgaacgagacgatgacgaagatgatgtgatacgatcaagattacttcttcaagcttctaaagatataaaactatcagatcctgatcatatctaccttatagaccatgcctggacttacaaagttcaagatgcgaaaaagcagcttgtggctcatgatgcccttcgagaaagactatgcaacgttttcgacatagacataactcaagataaatatgaaatagccgattcattgtttgaacatatgtggaaaattaataattactattgtataagcaataatgaaaatgtggaagatcggttgccaatctggtacataatggatgaagtaggtattgctgtaatacatagtgatgaccccaactgcaggatagtaccttttgtgtatgtaaatgatcaaattacttactcaattctatttccaattaaagatatacagaaggaagatataatttgcagagacttcggagaaggaattacagataaagggagaagagacgccttcttagtaccttgngttccnaaattatttgacgatgatgtaacccaatcaccccatctgagggatattttcttagtggtcatataaaggaaagttnaccagatttgtcgaaattggagaataatactcagcacggaaatgtattngaagtattttctcagtatagcttagtcaacatgtatgtaactgat

SEQ ID NO: 8638 - DNA, 931 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(719): n is a, c, g, or t
  misc_feature (721)..(754): n is a, c, g, or t
  misc_feature (766)..(795): n is a, c, g, or t
  misc_feature (798)..(812): n is a, c, g, or t
  misc_feature (818)..(818): n is a, c, g, or t
  misc_feature (827)..(827): n is a, c, g, or t
  misc_feature (850)..(923): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnncnnnnnnnnnnnnnnnnnnnnnnnnnnnnnnnnnncaaataataatnnnnnnnnnnnnnnnnnnnnnnnnnnnnnnccnnnnnnnnnnnnnnnaattanatttaatanattttattttttagctcatcccnnnnnnnnnnnnnnnnnnnnnnnnnnnnnnnnnnnnnnnnnnnnnnnnnnnnnnnnnnnnnnnnnnnnnnnnnncttaaaaa

SEQ ID NO: 8639 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8640 - DNA, 421 bp, Diabrotica virgifera
cggacgcgtgggttagtatactgttttttacatatatgtgtcatccaaggatttgagtcagaagcttcggaagatccttcgaaactatagtacgtgccttgttaggtacacccgagaatcgcgtaggggcgacccaggctataaaggaattggtaaagatcgagcatttcttacgatttgatgtacagctatacctgttatattctgtgtggttttggctgttgcggtgaacccttgctacgcggatgctaccgaaccatctttccctcgatcagataatataagctcttgaaggtttcccccttctccttcattctcatcataaggatggatacaataaaggggacgacggaacccgaggtgcagataacccgacaatgtcatccacatttctcatggagatggatctgtaaatataccc

SEQ ID NO: 8641 - DNA, 183 bp, Diabrotica virgifera
gataatatgtggaattagtaaaccatggtgtaatgaatatgcttaaatttgaaataccatgccatatcacgtatttgatgcgaaacaacgtgatagatatcgttcaggccacgagggccacgctgcgaactctccagttcactagtgaggcaataaggatggttactgggtctgtgtacctct

SEQ ID NO: 8642 - DNA, 85 bp, Diabrotica virgifera
  misc_feature (8)..(8): n is a, c, g, or t
  misc_feature (10)..(81): n is a, c, g, or t
ctatagangnnnnnnnnnnnnnnnnnnnnnnnnnnnnnnnnnnnnnnnnnnnnnnnnnnnnnnnnnnnnnnnnnnnnnnnngggt

SEQ ID NO: 8643 - DNA, 213 bp, Diabrotica virgifera
tctctactagttttctatcgaatagtattgtgaatgtttgcatgacgggaaattctgatactgattttactattatttagatagacgtctctgactaataaaccaaagaattggtaattcaaaacttttgggattttaagtataatgcataatatcaccagaaggggttgagagatcgatacagtcgtatttcgtcatatatttccgattgaa

SEQ ID NO: 8644 - DNA, 1214 bp, Diabrotica virgifera
  misc_feature (306)..(327): n is a, c, g, or t
  misc_feature (425)..(425): n is a, c, g, or t
  misc_feature (494)..(494): n is a, c, g, or t
  misc_feature (548)..(548): n is a, c, g, or t
  misc_feature (630)..(630): n is a, c, g, or t
  misc_feature (779)..(829): n is a, c, g, or t
  misc_feature (942)..(962): n is a, c, g, or t
  misc_feature (964)..(988): n is a, c, g, or t
  misc_feature (994)..(1021): n is a, c, g, or t
  misc_feature (1040)..(1076): n is a, c, g, or t
  misc_feature (1080)..(1105): n is a, c, g, or t
  misc_feature (1108)..(1148): n is a, c, g, or t
gtctgggtaaaaattccaacgaatcttggttccctgtactcagatgggagtaaaatagaaaatgaattcattgaaatttatttcctattacttttactgctatctgagtacaggcacagaagattcgttggcatttttacctagacgaatggacgggtggtggagtgcaattttagatttcccctagtcttctagtttatcgttcgtttgttttgcaagttttggaaatcccgaatttgggttgtttgccagaactcggatccagttagaagtgtttagttcttgggatctaaaacttcgaaatgnnnnnnnnnnnnnnnnnnnnnngcaaattttttgaacgcctttggcaacatagtggactgtatccgttgtactctatatttatgaatataagtttgtgttttgcgtatctcagtttgtanagagactcataatcattatcatggaatcatctcatcatccgcctgtttgtatcaccactgtttcatacncatttaagattagtatattaaggcgttcaaggggagaatcgtgagactgagggngggtatgcgatgcatcccatcgtactaaggcccgatcttttttttgtgtaatatgatgtcggtccgactcacctgtctgtgntgcgcctcccatgtttgtctccccttatgccgaatagagaggacgtgccattctgttccccaccgattttagcctattctggatagtatttagaccattattcgcagtcatacgatctaaaaaaaacattggtggaagaaagatctccnnnnnnnnnnnnnnnnnnnnnnnnnnnnnnnnnnnnnnnnnnnnnnnnnnnctctcccctttcgaactgcttttattgcaaggtaaaattaacttataaaaacaggtggaagttcttggagggattggtttcctactaattttttatttttggacgaacccggnnnnnnnnnnnnnnnnnnnnngnnnnnnnnnnnnnnnnnnnnnnnnnttgggnnnnnnnnnnnnnnnnnnnnnnnnnnnnggattaaaaaagaggtatnnnnnnnnnnnnnnnnnnnnnnnnnnnnnnnnnnnnngggnnnnnnnnnnnnnnnnnnnnnnnnnntcnnnnnnnnnnnnnnnnnnnnnnnnnnnnnnnnnnnnnnnnnagagaaaatttttgtaaggggaaaaatttcctccccttctcccaaatatttttccccccaccaaaa

SEQ ID NO: 8645 - DNA, 709 bp, Diabrotica virgifera
  misc_feature (130)..(152): n is a, c, g, or t
  misc_feature (609)..(630): n is a, c, g, or t
  misc_feature (666)..(697): n is a, c, g, or t
tgcaaagattttttatagtcaattttaattttacttcctaagtagtttaagttttaattaagataaaaacagtgagtttttaagtttgcatttttcatcaagtaaacctacctagtatacctgtgattgnnnnnnnnnnnnnnnnnnnnnnngtgcaagtttgaagtaaaacatctcatgtctatgttaaaagatacaaaagcctttgagcaatgtttgaagaccttgaatatcgtatccatggaacatggcaagtgcatcgcagaaatgaaagtcctagaggaacacacgaatcccttgggaacattacatgggggactctcagctactctagtggatagtgtttctagttatggtctatttacacatgagaaaggggccgttaaaagcgtttctgttaacataaatgtgtcctacatgggtggtgcaaaattgggtgaggagatagtcattgaatccaatactctcagagtagggaaaactcttgctttctgtgaagttctgataaaaaataaggcaaatggaaacgttttagtaaaaggtgaacataccaagtacttaatgaggtaaattattgattgtatgtgtagaaaaatttgtagatatgtnnnnnnnnnnnnnnnnnnnnnntactcaattgttacattaaagtgttaaaatactatnnnnnnnnnnnnnnnnnnnnnnnnnnnnnnnncgtgctaacgcc

SEQ ID NO: 8646 - DNA, 68 bp, Diabrotica virgifera
  misc_feature (9)..(62): n is a, c, g, or t
cgaagggcnnnnnnnnnnnnnnnnnnnnnnnnnnnnnnnnnnnnnnnnnnnnnnnnnnnnnngttaaa

SEQ ID NO: 8647 - DNA, 629 bp, Diabrotica virgifera
ttaataactaatggacttattacttgcacttggtactctccacactcatggccgcgagagaacgcgtgataaccattgagatagctttgtgggaattctcaacacctatatactatgtgaccatctttgatgccccctcggcacacagatatctttataaacatgatctctgtgacatctcacgctgtactgtgctgtgctcttttgtggcgcctgtgactcgggagtttgaaacacgtatatctcagaaatggcacacacgcgagcatgctctcctcgctttctccctcgtggtgaaacacctcatagtggtggtgaccacaatgtgctctcctgagccaccatacacagagtctcgcttctagaagatctcgaaagaggaatcctctcacatctcgaaaattgtgtacaccccccctgtcgctgctctctcacccctttctcgatgtgacgcagacaccatgtgataaagatctgacacgatgccatgtgtctcgggatgtgacatctcacgcatagaaagagaagctgtgagagagtgcgtgagtgaggctctgtatgctatccttctcccatctctcccacctgtgaaacccctctccctcctcctccccgatgtctacacaatt

SEQ ID NO: 8648 - DNA, 856 bp, Diabrotica virgifera
  misc_feature (20)..(50): n is a, c, g, or t
  misc_feature (674)..(700): n is a, c, g, or t
  misc_feature (741)..(833): n is a, c, g, or t
gctcaacacgagttttctannnnnnnnnnnnnnnnnnnnnnnnnnnnnnnggctatcagtttgccatcggcaggtgctgtgccactaagggtggtgtcaggctacttcagatcacagaccgtggaaaggaatataatggattcgaaggtgcagcatatgctcgtccaccacatgcggatttataaacaataaaacctgtaccagtcgagccgtggaggggaatttggtaagtaaatggctctatgaggtgaattattgtttatctagttgcacagtgacatacagataatggggcatgtaactctaacaggtccgtatttcagaaacggttttagcaatagatggaactagagagcgaatgtgtaatagtatcaatgatgtgtaattataggaatttatttataacagagttgctacccatcactgtttgtatagccaccaaaaaagaacccatcaggccctgatccgccattacaccttattcaataaccatggtgtatgaagaaaatacaaattcatcaatgtgggattccccgtatcgttaagcccggaactccacaaatatactttgtaatatatgagtcctagatcgagctcaggaaggaacacccccgtttatttaactttgccggcatacatcaaacccaaagctctcgcaacaccccccgagtagnnnnnnnnnnnnnnnnnnnnnnnnnnncaatgcacccccttcccacatctcctctagtcttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccactcccccccccccccc

SEQ ID NO: 8649 - DNA, 1103 bp, Diabrotica virgifera
  misc_feature (344)..(375): n is a, c, g, or t
  misc_feature (686)..(686): n is a, c, g, or t
  misc_feature (904)..(925): n is a, c, g, or t
  misc_feature (1015)..(1030): n is a, c, g, or t
  misc_feature (1033)..(1046): n is a, c, g, or t
gcctagcttttttattgtccgacatagacgagtgaatcaaggggcgtaatgttaagaaaacctgtggctatagttgggttttaattgcagtgttttgtagatgctggagagttccacagggtgatgcgagctttgagagggaaacacagtttgattggtatacccggtgtacaatgagaatttgccgttttagcaacaatattgttacactggtgttgctgaggaatcgggctatagcatgttcagggaatcgcttaaatcggtcaacaggtttaggaaatgtgggacatcaaaaatgaccaaatttttaagtgggccgatttctgcacgtaagtttagtttcnnnnnnnnnnnnnnnnnnnnnnnnnnnnnnnngggatgaaatgttgatctgcggtttgcttaacttcgcacagtagaggtgaatgttagaatattttcattagttgtttttagctctaagtgtacttaaatattgagtaaaattttcataacgatgtggtttgaatcatcctatacgggtatgggtataccatttaaaggtttattttattttcgtaacaatgtttaacataatatttataaatttcatgattaatttcagtatgtcagtatgttaattttaattaagggtgaaatgtaatgtacaaaaatcgttcatcaactcatcaataagtgttttttgngacaatgataatattattttatttcatttattaaacagtaatataacgatagtaattttatctagattgaataatagatatataaattttatcttaaattatcttaaaattgacacattgttaattcatagtaatttatttatttggaattactgggttaaatatactaaattaaattttgtacgaaacatcttattttaactaacatttgctgtcannnnnnnnnnnnnnnnnnnnnncttattaactattcaatttaaatttacttttggtaacattagggaataccttattaatgaaaagggggtaatttttaagttcttaaatgnnnnnnnnnnnnnnnnccnnnnnnnnnnnnnnagggcccgaaaaattggaaaaccccttttttttccattttcctttcaaaaacaaaac

SEQ ID NO: 8650 - DNA, 884 bp, Diabrotica virgifera
  misc_feature (213)..(247): n is a, c, g, or t
agcattaaaggcaaaatttttattcaaaaacgtcttaagtgacttactgtgagtttctgcaaataccaaaaatgagtaaaagtgcaacgttaccaggtctcgagaaatattcccaggcagcagacacatcagccccagagagggctttgaggtacactcatcccagctcaaagttgacacttgctcaaagacaattttatgaacgaaatggannnnnnnnnnnnnnnnnnnnnnnnnnnnnnnnnnnaatagaagttttgaatcagagatttattgatatttgtgaagatcgtgccgatgatatgcaatgtttcgttatcaaagacccagtactaaggaaaaaaggtttaaagggagaggcggtcatgaacaagcttcaagattttgtctttgatccagttttgagtcgttactgtatggaaaagagcttagtagatgctgtggaaaatataatcggaccaaatataacagttgctcattccatgcttatcaacaagcctccagatacagatccagatatatcaagacatcctatgcatcaggatcttcattactttccctttagaccagctgacaaaattgttgcttcctggacagcaatgcagagagtggacgaaaataatggatgccttttcgtagtacctggatcccacattgataatcctttgttaccacatatatatcctgagggtaaaaataatgccatgtaccacggagtacaaaataaggaccatctacccaaacagtttgtggtattagataaaggggatactgtgttcttccatcctttactggtgcacgggtctggagtaaatcgcacaaaaggttatagacgagctatatcatgccatttttgcggataccaattgcgaatttattgacgt

SEQ ID NO: 8651 - DNA, 101 bp, Diabrotica virgifera
  misc_feature (8)..(70): n is a, c, g, or t
  misc_feature (72)..(92): n is a, c, g, or t
aaagcttnnnnnnnnnnnnnnnnnnnnnnnnnnnnnnnnnnnnnnnnnnnnnnnnnnnnnnnnnnnnnnncnnnnnnnnnnnnnnnnnnnnntaatttatt

SEQ ID NO: 8652 - DNA, 859 bp, Diabrotica virgifera
  misc_feature (643)..(643): n is a, c, g, or t
aaacagaaaatattaatgtaaagtaaatattaacataagaagactacttagatcataatagtaaatactttgccggaggggtttgccactgtacagcgagattggatggtcaagttgttgtaataactggtgcaaattcaggcattggcaaagctttagggctggaattagctcagcgaggtgctactctggttcttccttgcagaaatattaataaaggattggaggccaagaagtacattcttaaatattcaaacagtaaaaatatcaaaatatttgtcaaggaattagatctctgtaaaatctcgagtattgttaagtttgcagaaactttgaaaacagaatttactgagatctatgctttagtaaataacgcaggagttttttatcaccctcaagatttgacagaagatggatttgaaattactcttcaaaccaactatttaggtccatttatcttgacgcatcatctgttggacttgctcaaaagatcagtacatgcgaggatagtgaatatttcttcagaagcacatcgactcgtcaatgtgtatgatttaaatgcagtaacgaaatgccaaacagaatttagagacaactttattgcctacggagtgtccaaattagcgatcaatttatttactanagaattatcacaaaaattattgagtaccaacgtaataattaacgccgcaaatccaggaaacgtcgaaacttcaattttcagaaacttccctcccttgagcaacccatggttgtatgctcttcagtggccaatacgaatattagtcatcaaaaatcccaaacaaggagcgcacacccctctccatcttcttttaacgtctaatagaacgacagggca

SEQ ID NO: 8653 - DNA, 729 bp, Diabrotica virgifera
taacgacccatcatgagaatggtacgttatgttgaagctattgaagatgtcccatctggtaacatctgtggatttaatcaaaaactttagacaatatcttacttaaacatccaacatacccatcgtacgggctcccacgcatataaagaaattactaaagagcaaccacacacaagaatcgacactcaactatcccaaaaacactggagtagattaggctttttttcttttaccaagccttccagagccaaatcgtcatccgcgtctacgctctacttatatcacccgaagtagcattacctctatctgattcttattcatcatagaagaacccactataaaacctattagagaaacatgtttcaggtgctactgctaaacctgcatcccaaattaacacatataacacataaataaccacaaaacagttccgtcaaccatgaaaccaaagaaacagatacttatatatcatcaaattctatcccgtcacccattcttaacagaaaaaaccctctaccccccaccaaaagactacccaccgatctaacacagctggtactccaaaatatactcctcttttacctccccctcccacgatcaccaaagataacacgccagcttcctttcctcccagtccctcaacccaaaagcatttttcactcgccgtaactcatcacttataatttatataatttaacgctaacactccgccccacactgctcacgccc

SEQ ID NO: 8654 - DNA, 893 bp, Diabrotica virgifera
  misc_feature (197)..(209): n is a, c, g, or t
  misc_feature (211)..(224): n is a, c, g, or t
  misc_feature (243)..(314): n is a, c, g, or t
  misc_feature (316)..(340): n is a, c, g, or t
  misc_feature (342)..(401): n is a, c, g, or t
  misc_feature (405)..(463): n is a, c, g, or t
  misc_feature (465)..(561): n is a, c, g, or t
  misc_feature (573)..(672): n is a, c, g, or t
  misc_feature (674)..(690): n is a, c, g, or t
  misc_feature (697)..(722): n is a, c, g, or t
  misc_feature (744)..(789): n is a, c, g, or t
  misc_feature (792)..(805): n is a, c, g, or t
  misc_feature (807)..(858): n is a, c, g, or t
  misc_feature (863)..(891): n is a, c, g, or t
gtctacttaatggtaacaaaacgtaaaaatgttacaatggtaaaaatcaataaaatacggtatacttacagataaactccgttataattgaaataacatgaaatatatatgaacagaacacatcttaattacgaatcaatttctactttatcaatttctaccttataaatgattttagtaatttttactttgattgnnnnnnnnnnnnngnnnnnnnnnnnnnngtaatgaaatgctattcannnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnngnnnnnnnnnnnnnnnnnnnnnnnnnnnnnnnnnnnnnnnnnnnnnnnnnnnnnnnnnnnntatnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnncgtagtnnnnnnnnnnnnnnnnnnnnnnnnnnataaatgaaggctctcatcatnnnnnnnnnnnnnnnnnnnnnnnnnnnnnnnnnnnnnnnnnnnnnnacnnnnnnnnnnnnnncnnnnnnnnnnnnnnnnnnnnnnnnnnnnnnnnnnnnnnnnnnnnnnnnnnnnatacnnnnnnnnnnnnnnnnnnnnnnnnnnnnnca

SEQ ID NO: 8655 - DNA, 1036 bp, Diabrotica virgifera
  misc_feature (178)..(201): n is a, c, g, or t
  misc_feature (214)..(231): n is a, c, g, or t
  misc_feature (265)..(287): n is a, c, g, or t
  misc_feature (513)..(533): n is a, c, g, or t
  misc_feature (550)..(550): n is a, c, g, or t
  misc_feature (614)..(633): n is a, c, g, or t
  misc_feature (699)..(741): n is a, c, g, or t
  misc_feature (750)..(750): n is a, c, g, or t
  misc_feature (893)..(913): n is a, c, g, or t
  misc_feature (915)..(927): n is a, c, g, or t
gaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacagngggtagttttagcaaactcctcaattgatattgtacttcatggatacctattatgttgttgcannnnnnnnnnnnnnnnnnnntataggagctgtatttgctaattatagcgggatttatccaatgatttcctttatttacaggtatannnnnnnnnnnnnnnnnnnnnnnnnnnnnnnnnnnnnnnnnnntttattggnggaaatttaaccttcttcccctcacattttttaggaataataggaatacctcgacgatattcagattatcctgatgtatttatatttatgaatattgtatcttctattggatcactaatttctttaattgggggattattccnnnnnnnnnnnnnnnnnnnnngnnnnnnnnnnnnnaccgaaaaagattaagaccctttaagattaacttcttcaatttgaatgactacaatttaaccctcccagtgaacaacgaaaattcttgaatttgccaatattaatcttc

SEQ ID NO: 8656 - DNA, 107 bp, Diabrotica virgifera
  misc_feature (9)..(9): n is a, c, g, or t
  misc_feature (18)..(18): n is a, c, g, or t
  misc_feature (28)..(106): n is a, c, g, or t
aaagcttanatttttttnaaagacgagnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8657 - DNA, 551 bp, Diabrotica virgifera
  misc_feature (2)..(548): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngct

SEQ ID NO: 8658 - DNA, 325 bp, Diabrotica virgifera
  misc_feature (2)..(18): n is a, c, g, or t
gnnnnnnnnnnnnnnnnngatactagatagagactgcagagaaaccaatatatttttataacagaaaaacatcattgtggcgaccctggcaaccaggtatgattaccgaataattatatacttattattttccaatctaagagagctaacaaattaacccttgttattgtaacctacatatcattatagactcttctttggacagcaaggtcatgcttgtttatcgaaaactagccttttaataaataaatgaaacttatttattacccatatttatacttgaagtatgtttagcgtcttaacagtagatagtttgacggatgaa

SEQ ID NO: 8659 - DNA, 322 bp, Diabrotica virgifera
tcttcgcgtccgaataattttttggtcagcagagagtgccaacagtgacaatgctctcgacaagacgtgagcgagaactctctagtggaagatatgtacttagtaatgtaccagactgtctttttgtgatataatatagatgcatttattgtatttcgaggatatcggatgaaaattgacacttttatcagcactgatcttgtcattgatgacagccaaagaaggggaatcgtcatcgtatgaccagtattttaacaaatgtgctggcaacgacaagctattcatggagtaaggagaagtagtctttcctaaaaaagcggac

SEQ ID NO: 8660 - DNA, 486 bp, Diabrotica virgifera
  misc_feature (245)..(296): n is a, c, g, or t
ataaaatcataggaatttatttggtttcgtacaaaattactagcaaatattagtttttttaccctaatttactgtgttattggattcgtattgattataatagacatatctgttgctgggccgttgccttgcacgtagtctcacttaataataataatagtcatcattctctactattgcaaaagagataatgtgttgttgtcttgacagctgttaaataaccttgataacttgtttggaatggnnnnnnnnnnnnnnnnnnnnnnnnnnnnnnnnnnnnnnnnnnnnnnnnnnnntaatctcttcccattttatttgttattatctcttaccatcacactaaatattgttagtcttgtgcataaccttccttctctatattgatctacttccaatcgtcaactaggagtaacacacccgtattttcccattttctgatatgttcttgtttattgtatatattttattatttctatcctttgtatc

SEQ ID NO: 8661 - DNA, 779 bp, Diabrotica virgifera
  misc_feature (2)..(45): n is a, c, g, or t
  misc_feature (53)..(165): n is a, c, g, or t
  misc_feature (175)..(551): n is a, c, g, or t
  misc_feature (553)..(729): n is a, c, g, or t
  misc_feature (733)..(733): n is a, c, g, or t
  misc_feature (741)..(741): n is a, c, g, or t
  misc_feature (745)..(746): n is a, c, g, or t
cnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtanaagcttanattnnttttaaagacgagaaacccctatagagttttat

SEQ ID NO: 8662 - DNA, 867 bp, Diabrotica virgifera
  misc_feature (822)..(822): n is a, c, g, or t
  misc_feature (846)..(846): n is a, c, g, or t
cggacgcgtgggcttgttgaaaagattggggaatgctcttgcacacaataatccagatctccaaaagtggatccagaaccaaaaatcattgtacaatggtctaccttgtagtttaagcgatataagatattctaatgagaatataggatataggaataaatgtgaattcacagttggaattgatgaggaaacgaatctgtcgactgtaggatttaggataggaagctacgttaatgggactactggtgttggaccagtagatggtcttgtccacattcctgaatcaatgaaagttgctgttaaagtgtttcagaattttgtgagatcttccgatctaagtgtttttaatccagaactacatacaggtcattttcgtcaattaatggcgagatcagcaccaaaccaactaatgttagtagtcggaatacatcctcaagacttggacgaagaaaaattaaacaagttcaaacaagatctcgttgaatttttcagcaagggagatggaaaggatgcaaatgtgacatcgttatattatcagaaaattgttaaaaaaaaccacaataatgacataactccatcagaacatctctggggcgagactcatatctacgagaccattttaggattgaaatttaaaatatctccagaagcttttttccaagtcaattctaaaggagccgaagttttatatcagtcggctatggaattatctgaaccattagaagattcaactgtttctcgatgtgtgctgtggtaccggtactataggtttatgcttttccaagaaatgcaaacaagttttggggatagaaataatacctncagctatagacgatgccaaagaanatgcagctattaacaaaattg

SEQ ID NO: 8663 - DNA, 317 bp, Diabrotica virgifera
  misc_feature (4)..(96): n is a, c, g, or t
  misc_feature (98)..(124): n is a, c, g, or t
  misc_feature (128)..(172): n is a, c, g, or t
  misc_feature (177)..(274): n is a, c, g, or t
gagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnngttnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttagggaaaaacagcggaaatttttatttggggaaggttcc

SEQ ID NO: 8664 - DNA, 81 bp, Diabrotica virgifera
  misc_feature (3)..(41): n is a, c, g, or t
  misc_feature (43)..(64): n is a, c, g, or t
ccnnnnnnnnnnnnnnnnnnnnnnnnnnnnnnnnnnnnnnnannnnnnnnnnnnnnnnnnnnnnaagaaagaccctataag

SEQ ID NO: 8665 - DNA, 110 bp, Diabrotica virgifera
cccaaaacggtttccaagtttcagtcaacacttactgtattttaatccgttatgtaattttattgtatattatcaaatacatttggatttggaataaaaagatacacttg

SEQ ID NO: 8666 - DNA, 544 bp, Diabrotica virgifera
acagatttgaaatactgactaggatcgaacccacctgataccgatatatctcattggaaatagaaggcgcgggtcacggtcttggtaaacttcgatagcctattataatcattttgatatgaaactttataatctcggaagtccaagagatatcgattgccacctttgactataaagggtacgggcttaggaagtctctggcataatccctcgaatgtgtatcttcgctccattacccgctcgtgtaagtgtgtctaccaaatgtccgaacctgcggttcctctcgtactaagaaggattactatcgctagcgacagagtgcatcaggaagagtgcaactaccctgtcacacgacggtctaaacccagctcacattccctgtctatgatgtgaacaatccgaggcttggggaattctgcttcgcgatgataggaagagccgacatcgatggaccaagaagcgatatccctatgaacgcttggccgccacaagtcaggtattccctgggtcagcttgtctgacacctcgttggcttgaaactctt

SEQ ID NO: 8667 - DNA, 418 bp, Diabrotica virgifera
  misc_feature (9)..(26): n is a, c, g, or t
aaatccccnnnnnnnnnnnnnnnnnngagagattttacaagagaagaatatctttttttcacgagcgacaagacgcttacttattgagagataaacactatcgtcgtgacaagattattttattataaggagacgaatttgttgttggggccgcgtcgagcaggtagtcttaattaataataatatgttaatcaatctctaaccttgcagaactgcgagtgtgctgatgtattgactgaaagctatctaacctaaataatttgtaaggaaaggatagtcagtctcgcatatcgataactgctcaagatatgacgtcaagttatttaatatctacacaataaacttctaattatatactatcaccacactagctgttgttgggcttgagcataatcttccaactttaattggatataat

SEQ ID NO: 8668 - DNA, 242 bp, Diabrotica virgifera
  misc_feature (15)..(33): n is a, c, g, or t
  misc_feature (92)..(112): n is a, c, g, or t
aaataaaggtgtcannnnnnnnnnnnnnnnnnntattattagggtttatatatattgctttagtagatattatttatgaattagtgatgagnnnnnnnnnnnnnnnnnnnnngagaccacctttattctcttgtaccactgttgcatcatcggagtatctaattacataatacatatatattatctattactctactttaattagagactgcgtaagttaattagtttttcattgatatgat

SEQ ID NO: 8669 - DNA, 969 bp, Diabrotica virgifera
  misc_feature (81)..(81): n is a, c, g, or t
  misc_feature (412)..(429): n is a, c, g, or t
  misc_feature (754)..(754): n is a, c, g, or t
  misc_feature (902)..(929): n is a, c, g, or t
gcttctttattgtagagtatgacctctttgagtttttgatcaattttaaaatacacacttccagaatttgattatacactncttggtcaaaaaaatccagatactggatcgtttctggcaattgttacctctgtttaatctctatccctaaaatgtcccataaatattctaatggattcatgtcgggaattcacgtgggtcaatccaaaacgggaattccaacaatagtattcgccccctcccttaacgaagtcccttgcattaagagccaagatatggctgaggtacatcttcagggtacaaggtttctccccatgtaataatctgacgcgctcgagtgactgcaaaaatccctgcttgggctcccctaccgtaatgtttacttcctccgcattaaaactactataccctnnnnnnnnnnnnnnnnnntttaaaatgcaaatgaacgagtttttttgaccaggagtgtagtaatcactattatagttaagaagaaccatgactaatgatatttagtatttacgatattctttacgtaaatttattgttaaatgataatcttaacaaactacaaaatgtgatcgattaaacacacaaaatccatactagttcttcctagctatcacgtacattatctacatagataaacaatcatatatattttttcaagtgtttttgtggtactttctgcgtttacttcactgtgtcattaatatcatacgagcagaatgattctgcgctttgtgcaatattngtcagtttgtgtaagaatattatgagcgaggtgatgtatatcccatacctaatttatgagtatatttttattcgatgagtactacaaaagtttttatttctgttgtaactttatttgtggggtggatagggcctgaaaacctccagannnnnnnnnnnnnnnnnnnnnnnnnnnnggaggtttgaaataaaaccaggcttaatttttcttttttt

SEQ ID NO: 8670 - DNA, 325 bp, Diabrotica virgifera
  misc_feature (3)..(122): n is a, c, g, or t
  misc_feature (134)..(147): n is a, c, g, or t
  misc_feature (150)..(192): n is a, c, g, or t
  misc_feature (200)..(278): n is a, c, g, or t
  misc_feature (280)..(294): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggtttcnnnnnnnnnnnnnnggnnnnnnnnnnnnnnnnnnnnnnnnnnnnnnnnnnnnnnnnnnnctggcggnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnncccttagggaatccccgcggaattttttttt

SEQ ID NO: 8671 - DNA, 846 bp, Diabrotica virgifera
  misc_feature (41)..(74): n is a, c, g, or t
  misc_feature (494)..(528): n is a, c, g, or t
atttgtacactagaatattttttatctaggccacgtaaggnnnnnnnnnnnnnnnnnnnnnnnnnnnnnnnnnngtgtttatacgtatttattttgtccttgatatggagcttatttctcaccaatatgtttacaataatgcagtcaaaacaacaatatgtactcaaaaatgctttaagaatcaaaatgtattaatagggcttttcatcgattgtcatttgtttcgagcgtctgtcatgggtcacataatattaatatatcttagtcatacgtctttggtttgtgtcatttatatataccaataatgtatgacgtagatatattaatgttatgtgacacatgataacgagcgatccacaattattgggaccaaagctagccgtgcaaaaaattaagtatgtcttgttttaatctgaatttatatcattattttatcaattaattttgattaacattataaaacataacaaatcagtaaaaacctttaacacagnnnnnnnnnnnnnnnnnnnnnnnnnnnnnnnnnnnataagtaacaataataaataaaatcaaacaagatgctgttatatgtccaccaccaacatctttacataacctaacttttcttgataagttgacgtacactgcaaagttgacgtaaactggaaagtatatttgaattaagaatagtcatgcactgtatagctatctctgtcgttcagagccacgtatggtgacaataattttggatcacacgttagcttaacaaatgactgtgaatgaaaagccctataccttacagataaaacaaattgtgatttcttatggtcatctcatataccagtggcaagtcacactgttttt

SEQ ID NO: 8672 - DNA, 899 bp, Diabrotica virgifera
  misc_feature (69)..(86): n is a, c, g, or t
  misc_feature (163)..(181): n is a, c, g, or t
  misc_feature (360)..(407): n is a, c, g, or t
  misc_feature (861)..(861): n is a, c, g, or t
gtattctcaacaaatgtgaatgtgaatgtgaaaatgaaaatcagagtacattgtagtatgtatgtatgnnnnnnnnnnnnnnnnnncataataatggacgcttacgacatttttaaaaagttaaccagaggtgcgaagttttctagaaacttcaataaggagnnnnnnnnnnnnnnnnnnnctgtgagtagtgttgtaaaacatgaaactccaccagccgtaaaaattgagaaagtacttacagtcagtcaagacaatccttccattacattaataagtggattaagtacagaaaacagagccaaaaaacgcaaatttaaggatgaagaacacatactaaagggtttggagcaggaaaannnnnnnnnnnnnnnnnnnnnnnnnnnnnnnnnnnnnnnnnnnnnnnnagttccagaaccctgtaaatcatttcaagattttaatgttgattctgacattattgacaatctaaaaaaatgtgggtatgaggaacctaccccaattcaaaaacaggcagtacccttaatgctaaaggaaagacagattttagcttgtgctccaacaggttctggaaaaacagcagcatttttagttcctataattcattcacttcgtggaccacaacgtcagggtttccgggctttaatcttatgccctacaagagaattggcgcagcagacgcagagagaatgtgatcggcttgctgagggccgagaatttcgtgtacatgttattagcaaaataaaaaaggctttgagtcagtataatccaagtggttcccagaaatatgatattttggtgacaactcctaaccgttttgtgctttttgttaaacaagaccccccagcaatatctttgaanaatgtcgaatggcttgtcatcgatgaggccgataactc

SEQ ID NO: 8673 - DNA, 158 bp, Diabrotica virgifera
  misc_feature (22)..(55): n is a, c, g, or t
ctaatctaacagaactatagcnnnnnnnnnnnnnnnnnnnnnnnnnnnnnnnnnnaaaaaagaagtatagaactgttgcggaatgacttgacagtcattgcttaaacacaactgcttgatttataacttctagaaatataatttttccccattttgat

SEQ ID NO: 8674 - DNA, 464 bp, Diabrotica virgifera
  misc_feature (2)..(34): n is a, c, g, or t
  misc_feature (255)..(277): n is a, c, g, or t
tnnnnnnnnnnnnnnnnnnnnnnnnnnnnnnnnngaattgattgtcattcttaactatatctatcttatttagatatgagttatatttatttaatatctacacattaaatttataatatactattatcacccatattaaaaatatttagggttgggcttgatcttacaattctaatttgatttcaattcaattgtgaagtaggaattaagattttcatattgtcatatatgacaatatgtcattgtttattctgnnnnnnnnnnnnnnnnnnnnnnngtgtgcttcatatttctatatccaatctcaattatttatgttcactaatgatgataacatgactgttcctaacttgtgctcttaaccgttatgtataggcttcaatatctttattctccacacatttttcccacctgaggattaaaaaacatgacattttcgtatccaaacatcccagtccccgcct

SEQ ID NO: 8675 - DNA, 529 bp, Diabrotica virgifera
tccatcttgatcacatcttgcaaggttgaaacaataactaatatgaagaatgtttgacattgttcgagagtcatgaccgccgaaagtgaatgaagttgtctggagataaaagaacacttgaatgtgcatgacagacatatgtttgaaaataaagagaagttcttctataatactcgaagtaagaagaggcattctcgatagtcataataactcatacctataataagatttctattaatgaaaagggcagggtgttgctggtagaaagaagtgttgtttaaagacttcttggtacgctacatataaagaaaatatttcggaagaagcgatgatcctagcatatagagacataagcgaccgcgacaacgctaagattcattatatgattaagaaccaacgccccagatgcagactaggatttctcaattgggtatctcttctgatgtcaataaccattattgatactgatgatattgctctacaatatatcctaccccgtgcagcacaacggcctaaacacctgacactg

SEQ ID NO: 8676 - DNA, 738 bp, Diabrotica virgifera
  misc_feature (164)..(182): n is a, c, g, or t
ccggaactccccggcccccccctcccgcccatttatctcaacataatgaatatagtttttgagaaaatgacaaactaattacattgtatgatgtatgtataatattgagagaaaatatcttattattgtacacatacattttttttttagtacctcgcgtatgnnnnnnnnnnnnnnnnnnncttatatattgattatttacaaatagaaaagaccgagagaattgtagtatttattgaaacaccaccattctaaataattgttaaggaacgaactgtcattcgtgactatcctatcacctacattattaagaggttaattaacttaatatataaacaatatacgcataattaaggatgattatcacatacaaatggattgtagtaggggatgatcttccacttcagaaatgattacaatatactgttgaggtacaacaagtattaaaccctgtcatatattacaagatgttattgttgattcctgacattattagtcaatctaatattatgtgggtatgatagtacctaccccaatttaaattattgaagttccactaatgatgatggtatgacagatattagattgtgttccaactcgcactgtataggcagcatcatttgaagtccctaaaattcattcccccccgtggaccacaacgatggggttttccgagcaaaaatcttatgcccctctcgcccaaatgtgtccgtatcaaaggcccagagaatgttgacc

SEQ ID NO: 8677 - DNA, 716 bp, Diabrotica virgifera
  misc_feature (2)..(626): n is a, c, g, or t
  misc_feature (633)..(634): n is a, c, g, or t
  misc_feature (646)..(707): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattnntaattggggtgnnnnnnnnnnnnnnnnnnnnnnnnnnnnnnnnnnnnnnnnnnnnnnnnnnnnnnnnnnnnnncaatttttt

SEQ ID NO: 8678 - DNA, 813 bp, Diabrotica virgifera
  misc_feature (12)..(33): n is a, c, g, or t
  misc_feature (273)..(338): n is a, c, g, or t
gtcgcgagcggnnnnnnnnnnnnnnnnnnnnnntgctcttgcggcgacgtaggttatcgcttgtctggccttagccttaaactcgagttacacacatcatcggatatttttcaaatattctattttgcacacctttcttattcctatgattattttgatgtattttcattttactgattatgccgcccccttgtgatgccgcctgatgcgactgcctcaccgcatcatagcatcacacggccctggtttcagaaacccatcactggttaacannnnnnnnnnnnnnnnnnnnnnnnnnnnnnnnnnnnnnnnnnnnnnnnnnnnnnnnnnnnnnnnnnagttatattatttacagatgaatacataccagcaacacttagaaataatgtcagaacggtgatagtaacagccaaaggaacaaaaatattaaatatggagatgagaataaatatttacaaaataaacgttacaaaattcaaagggaaaaacattgataaagttcggaccatatgcttttttcttctctgtatagactgtttataattataaagggtttactttatgcaatttacttttagccttttatgtaacaccttgtattctttagaaaatcaatgtatctatctaatctatgctaatctacaccaaatactatgtacactgatgtacacgtcttatctcttttagaaacaatatcactcaaaatacgtgtaaaaatgtcatattttcaaacaaacgagcccacttttgtccttaccacgtttaaaaaatagatatttgctaataactacataaactataattttagggaaa

SEQ ID NO: 8679 - DNA, 676 bp, Diabrotica virgifera
  misc_feature (93)..(121): n is a, c, g, or t
  misc_feature (144)..(199): n is a, c, g, or t
  misc_feature (227)..(250): n is a, c, g, or t
  misc_feature (263)..(308): n is a, c, g, or t
  misc_feature (314)..(346): n is a, c, g, or t
  misc_feature (348)..(380): n is a, c, g, or t
  misc_feature (428)..(446): n is a, c, g, or t
cccctcacgccccctatttatcaaatataattatatatttccccttaaaacgtcagaaaaactgtatttaatgatagatagttagtacttgcnnnnnnnnnnnnnnnnnnnnnnnnnnnnncaaattattttttgcacctcgcnnnnnnnnnnnnnnnnnnnnnnnnnnnnnnnnnnnnnnnnnnnnnnnnnnnnnnnnctaacaaattaacacttttattgtaacnnnnnnnnnnnnnnnnnnnnnnnnggaacgaaacgcnnnnnnnnnnnnnnnnnnnnnnnnnnnnnnnnnnnnnnnnnnnnnncattcnnnnnnnnnnnnnnnnnnnnnnnnnnnnnnnnncnnnnnnnnnnnnnnnnnnnnnnnnnnnnnnnnnccaaacccaactttattaaaattcactttttaaataaaaatcaggacnnnnnnnnnnnnnnnnnnnccatatgtcattatttattcttacatattattattcttcttttttataaactttttattaccctactcatctccattatttaaattcactaacgatgataatattactatcaacaccttgcatacttagtccaaatatataggtttcacaacggaattccccaccattctttcccccccgttcatcacaaacatgccgttttgtattcaacatcaagcctcgcctgcccc

SEQ ID NO: 8680 - DNA, 195 bp, Diabrotica virgifera
atcatataggaattcggcaggatttgtgtcacctgttcataataaaactggctttatgtattaaagatgaagtatgacctgccccttgatattgttgaatgtgttaagatttttttgtgtatatcgtaagtttagttatttttattttttgtgttattgttacgactacataaatctaaattatttgtgtttact

SEQ ID NO: 8681 - DNA, 465 bp, Diabrotica virgifera
  misc_feature (218)..(253): n is a, c, g, or t
  misc_feature (282)..(302): n is a, c, g, or t
gcgtgttaaatatagaaaccatcctggctcacaccgcaataaactcaaatcatgtaaaatgttaacaaactaacataattaataaatattatcataaaccatttataaactataaaccaatatctaggacacatccattatcatcaattataacccacaaataaaattacactaatatccgtaacataaaattattactataaaatcaaataatcagnnnnnnnnnnnnnnnnnnnnnnnnnnnnnnnnnnnnaacaatacttatgtttatttattaccacnnnnnnnnnnnnnnnnnnnnntacaaattaaaaccataacatttgtttaacacaatataaaattacaataaggaattctcttatttaaacaaagaaatgatccattacttatgattaaaattcttcatttttatagatactatatatcttaaatagacaaaccaaacaacgttctctacaccag

SEQ ID NO: 8682 - DNA, 838 bp, Diabrotica virgifera
  misc_feature (803)..(803): n is a, c, g, or t
aattgcctttgattggtcagtcatgtgttagagaacaacatacatcgacatggaagatcggctaaataatattaaaaactatttcaaaaaaaaatctaacgattccgagtttgttcaaaggtttggcggagtgccacagattgggttccggatttcgttttgtgaaagtactaaggaacttaaagtgaaagttataggtgctaggcaactgcctactgactacgggaatgttaaaccacaagggtacttagtcaaggtaaccttctacccaagtaaacaaaaattcgaaacaaaaacagcgaaagactcatggccaacgataaacgaagaattttcctgtatactcctaccagtaaaaagaatcgacgacttctttaagggccagtttatttcctttactgtatacgccactctcggaaaagaagaagaggagcaaaggcagaaggaaaagcctaaaagtatattaaaacggtacttttcgtttagtgatggcgaagaaattatatcgttaaggaacaatagttttagaagatctggctctcagagaagaagtagttataataatagtttgagcaacagaaggactgtaggagctgtgacttacaatttagataggaaattatttactcagaaacttaggacaggcgagattagcacgccagatatttggagaaatattaccgagattactagtggaatacaaacgcaaccgagggatggaccaaaaggtagcatagaactgactttacaatatggcgtaagtgaagatggaaccaacgaggtagtcgaaagtacagttaccnaatttagatgcagtttacaacaatgcagctcatga

SEQ ID NO: 8683 - DNA, 847 bp, Diabrotica virgifera
  misc_feature (13)..(202): n is a, c, g, or t
  misc_feature (204)..(676): n is a, c, g, or t
  misc_feature (679)..(712): n is a, c, g, or t
  misc_feature (717)..(761): n is a, c, g, or t
  misc_feature (780)..(780): n is a, c, g, or t
cctttgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnnataannnnnnnnnnnnnnnnnnnnnnnnnnnnnnnnnnnnnnnnnnnnntacagcgtattttattggnagagtcaatcgataataaagatgcgacctcgatggtggataaagtttataattggtgtaacagctat

SEQ ID NO: 8684 - DNA, 879 bp, Diabrotica virgifera
  misc_feature (16)..(40): n is a, c, g, or t
  misc_feature (103)..(122): n is a, c, g, or t
  misc_feature (151)..(173): n is a, c, g, or t
  misc_feature (278)..(317): n is a, c, g, or t
  misc_feature (418)..(441): n is a, c, g, or t
  misc_feature (657)..(680): n is a, c, g, or t
  misc_feature (693)..(710): n is a, c, g, or t
  misc_feature (740)..(740): n is a, c, g, or t
  misc_feature (746)..(764): n is a, c, g, or t
  misc_feature (813)..(813): n is a, c, g, or t
taaagatattggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattatttctcatattgttanggcagnnnnnnnnnnnnnnnnnnntttggtactttaggaataatttatgctataatagcaattggcttattangttttattgtttgcgctcaccatatatttacaggtggaaatggatggtgatacccgagcttattta

SEQ ID NO: 8685 - DNA, 382 bp, Diabrotica virgifera
  misc_feature (151)..(170): n is a, c, g, or t
cccccgccggagtgatctttaaaagtcatatatattttccgccggtagacatggagttttcctattgagagttaaatagtatggtcgtggaggatatagtatagatcgcagatgattttattgatggggggttgcagagcatgtagtatgnnnnnnnnnnnnnnnnnnnngtatccactaccctagcaaaagtgagagtgtgatgtgctattgatggatgtctatttaaaatcaatattttgtatggaaaggatagtcagtcttaaatatagataaatgtttaatatatgaattatagtaatttagtatctttgcattttctttataataaggttttattatcaatattaaatatttttggggatgtgcatgatcttacaac

SEQ ID NO: 8686 - DNA, 682 bp, Diabrotica virgifera
  misc_feature (142)..(157): n is a, c, g, or t
  misc_feature (159)..(175): n is a, c, g, or t
atctctatttatttcagaataatagaccaccttttatgagaagttcttagatattatactgaatgattgatagtgaagactgatctagattgttttatttatgtaaacaaatatgttattttttatcaacatgtgacttttnnnnnnnnnnnnnnnngnnnnnnnnnnnnnnnnnccgaacttatactgattatccgagctaattatctaatgataaaaaactatttaatctaataatcatgtattgaattgtattactacttatatgatatagactgtattatatacattctactgaattaatatgttattcttacatccataatgatccatttgtactacaatattattaaaaatctttacgtatgagcttaagctcacttcttcattttgactcttgctttcaatacatgtcaccattattcatgttcgtactatcttctatgtgactacttattttaatatataataagtctgatttttaatgaatatatgaatcttatactttttccatctatgtaaatttatgactgattatatgagtgttatcttcatctggaatactccatgagactatatacagtatattatcaggtatactccctcatccatatgtctgactggtgatgccgccatggcatgtagtattactattctagactcatctgcccactgattacta

SEQ ID NO: 8687 - DNA, 628 bp, Diabrotica virgifera
  misc_feature (38)..(74): n is a, c, g, or t
  misc_feature (212)..(239): n is a, c, g, or t
  misc_feature (285)..(303): n is a, c, g, or t
  misc_feature (310)..(336): n is a, c, g, or t
  misc_feature (338)..(365): n is a, c, g, or t
  misc_feature (370)..(384): n is a, c, g, or t
  misc_feature (386)..(401): n is a, c, g, or t
  misc_feature (452)..(481): n is a, c, g, or t
  misc_feature (528)..(547): n is a, c, g, or t
tacttggagaaactaacatcgttgacaaccatggcggnnnnnnnnnnnnnnnnnnnnnnnnnnnnnnnnnnnnngggcgaaacaccagctgccgctcctgcccccgccgaaacctgttcctcctcagagagtcaggcaggattaccaaataatcatataataatgattatcgaacgattttagagatgcgagttaagatttttattgattgnnnnnnnnnnnnnnnnnnnnnnnnnnnnggaaaggatagtcgttcttaaatatatctaatttattaagaaatgnnnnnnnnnnnnnnnnnnnctatacnnnnnnnnnnnnnnnnnnnnnnnnnnncnnnnnnnnnnnnnnnnnnnnnnnnnnnngagcnnnnnnnnnnnnnnngnnnnnnnnnnnnnnnngaattaggaataaggattaacatattttaatatatgataatatgtatttgnnnnnnnnnnnnnnnnnnnnnnnnnnnnnnctgtatgatttatattactacataaatttaaatcatttaagttgacnnnnnnnnnnnnnnnnnnnntttataaattgtatatttagtggatatgcataggctcagtaacggaattcgcgacacgttctttctcctgtgtattaaaac

SEQ ID NO: 8688 - DNA, 940 bp, Diabrotica virgifera
  misc_feature (121)..(142): n is a, c, g, or t
  misc_feature (282)..(330): n is a, c, g, or t
  misc_feature (493)..(511): n is a, c, g, or t
  misc_feature (728)..(728): n is a, c, g, or t
  misc_feature (794)..(811): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcatagattattcctanagtaccaaaagcttctttttttcttctctcttgcctaacaatatgagaaattaatccaaatcctgnnnnnnnnnnnnnnnnnnctgcaggatgaccaaaaatcaaaataaatgttgatagagaattggatcccctccaccagctggatcaaaaatgatgtatttaaatttcgatctgttaataatattgtaatagctccagctaaaactggt

SEQ ID NO: 8689 - DNA, 620 bp, Diabrotica virgifera
  misc_feature (513)..(530): n is a, c, g, or t
  misc_feature (589)..(606): n is a, c, g, or t
cccacgcgtccgataggaaatcaaaaataaattgtatataaatttatcaccgtttattaaaagtaaaaaataacacttgttacttgttttattaattttaaagtcatatttataaacatggagtacattgagaaaaccgcaaaggattataagaaatgctgtgatgtagatatggattcaaagttgaacctattaaataagtctattgacgaaatgttgacgagattagaagaattccagacaatgatgtcatttgtggaacaggacagaaaagattacaatgatattttaacttcagttccaaattacaaagatgaatttgataccttatgcaatagaatagatacagtggataaattgactagtcatattaaatctaacttagatgtattggaatctgaaatcgaaaaagcagaaagtagtttaggatgtagcgagaaaacaactaaagttactcaaatttttacaccattgtttaagaaaaatgtagataagaagcaatcaacacagggnnnnnnnnnnnnnnnnnntgaagattattttgattagcatagtgtattttaaaattttctatatttgtgtacactannnnnnnnnnnnnnnnnnaataatatattgtt

SEQ ID NO: 8690 - DNA, 231 bp, Diabrotica virgifera
  misc_feature (39)..(76): n is a, c, g, or t
  misc_feature (96)..(109): n is a, c, g, or t
  misc_feature (112)..(134): n is a, c, g, or t
  misc_feature (142)..(164): n is a, c, g, or t
  misc_feature (194)..(225): n is a, c, g, or t
cccacgcgtccgagaataaattaccttaggcataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8691 - DNA, 807 bp, Diabrotica virgifera
  misc_feature (240)..(260): n is a, c, g, or t
atctcggcagataacggtaataaagtccaccaaaattgtggagttcttgttcaaaatactgtaatattgatagtgaagacttatcttgcttggcatgaaaatgtagtcagtttggcattttttatcgataaattacatttcaataataaataaagacgtttaaaaaaattaattacagtacatatactgattatccgtgctaattatcttactatacaaaacgttaaattcaaataatcnnnnnnnnnnnnnnnnnnnnncatattgtattgactgtattatatacattctactggaaaagtatgtttttctttcatccgaagtgatccttttggactactaaattgcaaagactctttacatagtactaaaagctcacttcagcagcttgtctcttgctttcgagtcatgtcaccagtattcagggctgaacaagcttctttgtgacttctccagctaatttgtattatgtctgcattttattgattatatgtatcataaactttttccatctatgtaagtttatgccaagctttatgtgtgttgccttcatctgaaatactccatgattctgctaacatagtttttcaattactccctcatccataggctgaaaggtgctgccgcgtttgcaggtacataagctattctacactcatcatcaagtgagttcactatttctacgtctgaatgagtgagcgactactcatgataaaaaatactttcctatactcatattccattcatgatataacctatcttgaggatgtcacaatctattatattatcattcagactctgccgtct

SEQ ID NO: 8692 - DNA, 446 bp, Diabrotica virgifera
  misc_feature (2)..(194): n is a, c, g, or t
  misc_feature (213)..(213): n is a, c, g, or t
  misc_feature (216)..(247): n is a, c, g, or t
  misc_feature (250)..(273): n is a, c, g, or t
  misc_feature (276)..(315): n is a, c, g, or t
  misc_feature (319)..(417): n is a, c, g, or t
  misc_feature (419)..(419): n is a, c, g, or t
  misc_feature (421)..(421): n is a, c, g, or t
  misc_feature (426)..(444): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagctggaaatgagggntgnnnnnnnnnnnnnnnnnnnnnnnnnnnnnnnntannnnnnnnnnnnnnnnnnnnnnnngcnnnnnnnnnnnnnnnnnnnnnnnnnnnnnnnnnnnnnnnntatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantnataannnnnnnnnnnnnnnnnnnga

SEQ ID NO: 8693 - DNA, 874 bp, Diabrotica virgifera
  misc_feature (20)..(20): n is a, c, g, or t
  misc_feature (45)..(80): n is a, c, g, or t
  misc_feature (82)..(270): n is a, c, g, or t
  misc_feature (272)..(347): n is a, c, g, or t
  misc_feature (364)..(391): n is a, c, g, or t
  misc_feature (479)..(480): n is a, c, g, or t
  misc_feature (483)..(483): n is a, c, g, or t
  misc_feature (494)..(497): n is a, c, g, or t
  misc_feature (502)..(520): n is a, c, g, or t
  misc_feature (530)..(559): n is a, c, g, or t
  misc_feature (618)..(669): n is a, c, g, or t
  misc_feature (695)..(726): n is a, c, g, or t
  misc_feature (753)..(770): n is a, c, g, or t
  misc_feature (791)..(834): n is a, c, g, or t
  misc_feature (838)..(859): n is a, c, g, or t
cccctcgcggccgcgcgaancaacaaaaacaagaaaagagccccnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnctcccattaatattagnnnnnnnnnnnnnnnnnnnnnnnnnnnncctccttattaaaattccctttttaaataaaaattccccctaaaaattttcatatttcaccccatgttattatttacctcctccccannagnacctccccccnnnntatgnnnnnnnnnnnnnnnnnnncctctccacnnnnnnnnnnnnnnnnnnnnnnnnnnnnnntcacccccaaattgtatatttcccacccatatataggttcaataaaggaattcgctacnnnnnnnnnnnnnnnnnnnnnnnnnnnnnnnnnnnnnnnnnnnnnnnnnnnncctccctctgcccactgatccacccnnnnnnnnnnnnnnnnnnnnnnnnnnnnnnnncagcataatcaccccccccttttatcnnnnnnnnnnnnnnnnnngttggatgacaaaaaaaactnnnnnnnnnnnnnnnnnnnnnnnnnnnnnnnnnnnnnnnnnnnnaacnnnnnnnnnnnnnnnnnnnnnnaaaaacccccactac

SEQ ID NO: 8694 - DNA, 541 bp, Diabrotica virgifera
cggcccggaatccccggggcgcccccccccgccccgcgagaatcttagatagaaaaccatgcttaccccagcgatagacatccgtacgaatgcagacgtaggttcataatcagtgggcatatttaggacttacttactccgagatcgcacctattgaatttattatatcctgacgaataaatttaaataaatcaaccttaatagataatagcgcggatccatcccaagaacgtagtagtacaggaagttgataacctatggttgtccaaatccataatttgattaagtactgagctctcggatatcacatcattcactagtgtgtttcacttataagtaggttgatagactttagtgcgaccagtggaggggtccatcatgctattattacccggattaagcgcacgttccagagtctatattcgtattctgatctggactttgcccgaggtagttcttgatgatccagcatttgggattcgtaatagtgccaatttccatcatgtacacaggtaactcaactgtattatagtgttgttta

SEQ ID NO: 8695 - DNA, 853 bp, Diabrotica virgifera
  misc_feature (558)..(588): n is a, c, g, or t
  misc_feature (788)..(788): n is a, c, g, or t
  misc_feature (822)..(822): n is a, c, g, or t
ttttgcgtccgcaggccaatctgaaggtggaggtcaaacaggaggctggcctgaacaaaatggtggatggcctggtcaaactagtggaattagacaaccaagtggaatgcgacaaccagttgaaacgggacaaccaggtacaataggtcaaccaggtggatacggccagccaagtggaacaaaccaaccaggtggaatcgggcaacctggaggatatggacaaccaggtggaacaggacaaccaattgaaacgggacaaccaggtgtaataggtcaaccaggaggatatggacaaccaaatggggcaagacaaccaggtggaatcggacaaccaggaggatacgggcaaccagctggagcaggacaaccaattgaaacgggacaaccaggtgtattaggtcaaccaggaggatatggacaaccaaatggggcaagacaaccaggtggaatcggacaaccaggaggatacgggcaaccagctggaacaggacaaccagttggaacgggacaaccgggtataataggtcaaccaggaggatatggaccaccaagtggaannnnnnnnnnnnnnnnnnnnnnnnnnnnnnnagggtatagacaacctggcagccctggacaatcaggtggaatagcaccaccaggtaaaatagaacaaacaggtggaattcaacaaccaggaggaatagggcaatcgggcggttacccaggaaggcctggcgaaataccacaaacaaatggatggcctggacaaactggaggtattccacagtttaccacaggaaggtggnctagtgaaacaactggtcagaccgggaccaacgnacaaagaggtcctggtcaagttggttggagt

SEQ ID NO: 8696 - DNA, 427 bp, Diabrotica virgifera
  misc_feature (17)..(34): n is a, c, g, or t
  misc_feature (36)..(72): n is a, c, g, or t
  misc_feature (74)..(90): n is a, c, g, or t
catttattttcgaatannnnnnnnnnnnnnnnnntnnnnnnnnnnnnnnnnnnnnnnnnnnnnnnnnnnnnnannnnnnnnnnnnnnnnngatttctccctggtcgcggctattctccttccacaccatctcgaacatctagatcctaaaggagttgccactttaaatctcgaaaccagtgtggtcattctcttcattacctccttactcgtagttactatacacatcattgtccaaacaatgacccgagttgggctcgctactgcaacgctgttcctaccgttaccggtatactccactattacaaaaactctactccgggtcaccagtggccttcctttacttcctgatatgcgtgatcaccgacagtaggacggcctgactcctgatgtcaacactgacgatgcttatgactcaatggatgagc

SEQ ID NO: 8697 - DNA, 468 bp, Diabrotica virgifera
cggacgcgtgggtttttaatgaggatgttcttttgttatctcttaatcccctcttccatggaaggtaaaagaaaaatctgcccagcatactagatggttttggttgcccaaaaactgatcccatcaagaggtggaagagacactgggtaacgcagcgcaacctatcaacatctcaatacaggttgatccgaccgattattacggaattaccttgcgataaaaatttacccctccctcataaatacacatgtaccatcagtacaactagatggggacctgcatcgaatcctgtacatttacttaaaacaaacctcttagatgcgaatatttgactagtctctgaggatagaagcggcttgaaccccgatagtacgattgtataattcataaacttctaacctatcgaccatatgagtagtcagagagctgaacatcccgatccctgtagagattcactttactgagtaa

SEQ ID NO: 8698 - DNA, 405 bp, Diabrotica virgifera
tggattcatataataatatatgctaaaggatgattggtggagtttatgactaaatataagatgaccttcaggaaggattctttgtgtatgacggtagaatggggtgcgactgttgaacacgttcatattatgtagttaatgaaaggctcgagaatatggcatgaagtggcatggaaaagacggctaaatcctttaatgtgatcatgggcagtgaggtatcaaatatctgaagtaccactagtaaatgtggaatcttggtatttgtttgttaaatccatatagaatatgatgcggatatatcaacaagaaatagaacaaagaaggaagatatgagtataataatagtaggagaaaagacaaattatattgtgaaatataatagttgttattttatagcacatgata

SEQ ID NO: 8699 - DNA, 248 bp, Diabrotica virgifera
  misc_feature (6)..(197): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttagggataacagcgtaattttattggaggagtcaaatcgataataa

SEQ ID NO: 8700 - DNA, 775 bp, Diabrotica virgifera
  misc_feature (3)..(228): n is a, c, g, or t
  misc_feature (230)..(528): n is a, c, g, or t
  misc_feature (537)..(585): n is a, c, g, or t
  misc_feature (677)..(706): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttagcnnnnnnnnnnnnnnnnnnnnnnnnnnnnnnnnnnnnnnnnnnnnnnnnnctgattaataacatgactttttgtatgaaatatacaggcccgcccgcccgccgaatgatttgaatgcgcgcgcgattttagaccgggcgagnnnnnnnnnnnnnnnnnnnnnnnnnnnnnntgctggccggaaggctggttggaacaaaaccgaccttgattaatttattcaaaactaatttttatttta

SEQ ID NO: 8701 - DNA, 354 bp, Diabrotica virgifera
aaggtcttcatttcttgcctgcgtatatttggtctgaagaataccaaatgaatgtaatgtcagaacactttaaggcattcgattatttaagaagccagggattcttcgtaggggagtttatatggaatttcgctgattttaagacagctcaaacttacacgagagtgggaggtaacaaaaaaggaattttcaccagaaatcgacaaccaaaagcgagcgcattccatttaaggcgaagatattggggactagctaaagaatataaccccaatgtaactttaccaaatgatctgaacgcaccctacactatccgagaagcccctcctcatactgaactgtgatttaattatacat

SEQ ID NO: 8702 - DNA, 467 bp, Diabrotica virgifera
cgctgctatacatgattgttggtctaactactgatttaacgactgccgtttttactttttccggtatctcttttttcccaaaaatgaatgttttgtagtgggtcgcccaaatacttgttcttacaagatgtctaagaataatatgcaaaatatactgatagtattaatattttaaaaaaagtgaacataaacattaatagtcaattactctgcatcattattaaattctttaccttaaataatgactagatataggcttacataaacatggacatctaacgacaccggaacatttacacataccaaaacacttaaaagcgcttataggactactaccagaacgaaaacaacaacgtgactaccgagagaacgattgtatgattatagaccttaacccacacggagccaatgactatttaggaagcaagccacttcttgacgcctgttgtcaagaatgataataaata

SEQ ID NO: 8703 - DNA, 170 bp, Diabrotica virgifera
  misc_feature (16)..(16): n is a, c, g, or t
  misc_feature (19)..(20): n is a, c, g, or t
  misc_feature (145)..(164): n is a, c, g, or t
cccttagaaaccgagnagnncgagagcgcgagcaggcgccctctttttaaaccaagggccaaggccaaaagacagaaaacaaaaaaagggaaggaaggaacaagaccacgagacaccccccccacacagagacaccaagagaagnnnnnnnnnnnnnnnnnnnngggagg

SEQ ID NO: 8704 - DNA, 637 bp, Diabrotica virgifera
  misc_feature (38)..(56): n is a, c, g, or t
  misc_feature (58)..(72): n is a, c, g, or t
  misc_feature (83)..(99): n is a, c, g, or t
  misc_feature (101)..(114): n is a, c, g, or t
  misc_feature (127)..(140): n is a, c, g, or t
  misc_feature (142)..(154): n is a, c, g, or t
  misc_feature (288)..(317): n is a, c, g, or t
  misc_feature (319)..(366): n is a, c, g, or t
  misc_feature (527)..(568): n is a, c, g, or t
  misc_feature (570)..(586): n is a, c, g, or t
gactcagggattcttaattaataattatatctttatannnnnnnnnnnnnnnnnnngnnnnnnnnnnnnnnncttattgttcnnnnnnnnnnnnnnnnncnnnnnnnnnnnnnncatggtattcgcnnnnnnnnnnnnnngnnnnnnnnnnnnntaacttaaatttatttattaagaatagatttctaatgagctatgtttatattattaagatgaaaaatttatagggctgagcttagaaataagattttattaagatttaagttttaaataaagattaggattagnnnnnnnnnnnnnnnnnnnnnnnnnnnnnncnnnnnnnnnnnnnnnnnnnnnnnnnnnnnnnnnnnnnnnnnnnnnnnntgtaaattctacttatttaagtttagtagtgatgataatattactattataaaattgtatatttagcaacattatataggttcagtaaaggaatgcggcaacattttttttccccgtttattaggaccatgtcttgtttgaatcaaatataaacgtctccnnnnnnnnnnnnnnnnnnnnnnnnnnnnnnnnnnnnnnnnnnannnnnnnnnnnnnnnnnctttacttttctttattgtcccccgcaatgaagggctgggctgaaaaacaa

SEQ ID NO: 8705 - DNA, 311 bp, Diabrotica virgifera
gtaacgtcgaccataagtcaaaaccgactcattttttccttttctcatattagaagaccctatgaaatctgaaaaaaaatgacaacatttgtactgattctccttacgactttgcgttgcagagaatgtatgcctcatactatgtcgtattgcattccaccaatctactgatctgttcctactgagatggatgacatccgttcacttgaatgtgatattcagcaaagtgacgcctacacagagaaggtacattacagactacttggcgcaacctgtcacatgcactgaccatcttctctagatacaccaac

SEQ ID NO: 8706 - DNA, 808 bp, Diabrotica virgifera
  misc_feature (563)..(608): n is a, c, g, or t
  misc_feature (610)..(675): n is a, c, g, or t
  misc_feature (733)..(733): n is a, c, g, or t
  misc_feature (735)..(762): n is a, c, g, or t
  misc_feature (769)..(769): n is a, c, g, or t
  misc_feature (772)..(788): n is a, c, g, or t
  misc_feature (791)..(807): n is a, c, g, or t
attcaggacttacacataatgagcatgtagaccaattagctaaaaattccctcatccatggaacagtaacgaaatatcagccctgcattctagatgcttttgcttgtttaagaactgaacagatgaagagctggaaaagacactgggaaaggtactgtaacatatcaacaacacaatacagtttgatacaaccgattatttcggaaaaaccttggtataaaaatttcaccctccctcgcaaatacacatccaccatcagtagaattagatttggacatgcatgttatcctgcacatttatttaaaataaacatattagattcgaatatttgtcaagactctgaggttaaaagtgacttgaaccacatattttttgaatgcaaaaagcataaacacctaaccaaacacctaattaaaagaattatagaccagaacatcccactccctgtaaatattctctttattctgtcactgaataaaaagaaaatttttgactgtttggtatctttcttgtcagatagtaaaatactattgtaattaattataggtatttgtaaaatatgnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnactaagaggatttaaaccctccgcgggtttgaacccgggttgacatccctatcgtagntnnnnnnnnnnnnnnnnnnnnnnnnnnnngaactanaannnnnnnnnnnnnnnnngcnnnnnnnnnnnnnnnnng

SEQ ID NO: 8707 - DNA, 276 bp, Diabrotica virgifera
  misc_feature (2)..(164): n is a, c, g, or t
  misc_feature (179)..(264): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaattggggggnnnnnnnnnnnnnnnnnnnnnnnnnnnnnnnnnnnnnnnnnnnnnnnnnnnnnnnnnnnnnnnnnnnnnnnnnnnnnnnnnnnnnncccttaggggaa

SEQ ID NO: 8708 - DNA, 395 bp, Diabrotica virgifera
  misc_feature (2)..(33): n is a, c, g, or t
cnnnnnnnnnnnnnnnnnnnnnnnnnnnnnnnnaacgttacattcgtgagggaatatagttatagctgttacaagaagcgcccgagttatctgcggcagtcgtgtgagcctcggcttgccttgtgacttgtgtaattggcgacgatattatccggattgaagcgattggaggatatggatttgttagaggttatgttgccacactgcatctttttgtgcaccaggcaaccatgttcgtgaataaaccgaacaattccagttggagaagtgccttgagttgaagccgtacaccccagcgttatcgccagtgcaacgggtaactgacgccgatagagtatccgcacctaccgccgccccgcttcgaggatcgatctcagagctcgacgtccgaagaa

SEQ ID NO: 8709 - DNA, 836 bp, Diabrotica virgifera
ctacgaacaaacctattgttttgcttttgcctgcgtgcattcttgttcattaatcattaatttgttagtttattgttcattttgtattttttatacctactacattgtaaacacagcacatgcacatccccccttattaattatttatctgtgattgtaaatactgcaggaatagggaatgttaaggtggaaaagtggagaacattcacagcagttaaaataattattgtttatgatattttatacaataaatatgtaaatcggatcaccatctggatttcaaataaacaccgtattgtactgggaccactaccaggtgttttattatcattgaatcaatgtactaaataattctgtatatttcaaatatattcattcagtttatatgtcagctatggattttaaagttgaaattaaggatgagcctgtcgaatatatccaaaaggatacagagagccagctatccacatccatagatctggaaaacttcaaaaatgaaaaagaagataaatcagaaatgggactaaacgctgaaatcaaggaagagttttcagacagttgtcaagtatatacaaaggatcagctgtttacatcgccagatcttaaagacttggttaatgaagcagatgaagataactcaggtttccaaaatatagaccgccatatagggtttgatttagaaacaacaaaactggtgttaagggatctagcaagtttgcacgccgtgtctttggcactcagattgagaaaaccagaagtattcgagaaagtgattaagccgtactgcgttcctttgaaactatgaacgatgatgattttttgcctgtcttaaaagg

SEQ ID NO: 8710 - DNA, 529 bp, Diabrotica virgifera
  misc_feature (470)..(470): n is a, c, g, or t
atttatagtaaaaatatataaacaataaatatgatggaactggaacgacaaaacaaatttgaaatcatttgcaagaatttattatgtgggggtgtagctggaatgctttcaaagactacagtagctcctttggatagagttaaaattcttttacaagcacacaataggcatcacgaaagtcacggggtggttggaggtttaagacacgtcatcaataaagagggaccattagctctttacaaaggaaatggagcccaaatggtacggatttttccatatgcagctattcagtttacttcgtttgaggtatacaaaaaatacctagatggagtgtttggagaaacgtcacatatagataaattcttagccggcgcagcagccggattaacttctgttttttgtacttatcccttagatactattagggctcgattagcatttcaggtcagtggtgagcacatctataccgnggatagctcacgcggctttctaccatctttaaagaagaaagtggcgccagagctctcta

SEQ ID NO: 8711 - DNA, 107 bp, Diabrotica virgifera
  misc_feature (7)..(96): n is a, c, g, or t
aaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgagggg

SEQ ID NO: 8712 - DNA, 795 bp, Diabrotica virgifera
  misc_feature (738)..(759): n is a, c, g, or t
acgcgtttatctcgtatagtagcgaagatagaaactttgtggtacgattggtctcaatgctagaagactatgcaccttatctaaaactgtgtgtgtacgaaagggattttaatgtaggacatttcatatcagaatgtgttttagcgtgtatttccgatagcagaaaaattgttttagtcgttagtgacaattacgctaaatctcaatggtgccgatgggagagtcatatcgcagaacatcatcggctgttctttgaagacggaaatggtgatttcgtggatgatacgatagttgttatcaaactggggaccgttaataaaagcaatatgactccaatgttaaaatttttgttaaagaccaggatttacttgcagtgggagcatgatgataacaaacagaaattattttggaataaattgagaactacacttgctgcctctaaatttgaacaaatcacacaagtcactcacatgtaaataattgtatattacctaaatacttccttcaaacttgaaaagagtcaacttgattattgactacaacttaaaaacttttttatcagggtatatttaatcttttacttccagcaggtacatattatgcagttacatcatattcatttattagtttcttcatttttccatattgttcgcatttttgttaagatctgtcaacactgcacataattacgaactgaaaactagaaccagtgatcttcagagtcgtttttgactttgnnnnnnnnnnnnnnnnnnnnnntacattttgtgtatcataataaataagttgtatttt

SEQ ID NO: 8713 - DNA, 792 bp, Diabrotica virgifera
  misc_feature (317)..(337): n is a, c, g, or t
  misc_feature (679)..(680): n is a, c, g, or t
  misc_feature (695)..(695): n is a, c, g, or t
  misc_feature (697)..(698): n is a, c, g, or t
ccttctgggtccggtaaattagagtcagaccaggtttttatcgcatgtaaatcagaagttatagttgcatgaaaagatgcaatagttgagttgctccaagtgatactggtatcatcagcaaaaagaaagatttttccatcgatttttaaattagtgatgtcatttataaaggtagtataggacccaatactaaacctagtggtactaaagatacaatgtttttgagactagagtcggtattatttgctctaactagttgttcctattattcaagtaagattggaaccaattcgaagaaatacctcgaattccatagnnnnnnnnnnnnnnnnnnnnnatatcgtgatttacacaatcaaaagctttggcatagtcacagaaaacagtggcagtataaagattattgtttagtgcttggtaaacctcatgaagcacagaaaacattgcatcagtggtacatttattagttaaaaagccgaactgattttgggataagatgttgttatcaatgagaaaggacataaggataatatacgacaggatgtggcgaactttgtgaaaaggcacgggttgattggtaagcccggtatataatgactgtttgcctgtctagcaacaatattattacagcgatattgtttaagaataaggatataatacattaaggagaatcacttannatcgacaccaggttngnngaattcgaacatcgaaatgactcttttttaggtgtccgaatttttttgaccagagtgtattttttattttagaggtttttttgttatatttttc

SEQ ID NO: 8714 - DNA, 846 bp, Diabrotica virgifera
  misc_feature (408)..(435): n is a, c, g, or t
  misc_feature (760)..(775): n is a, c, g, or t
tgcaagcatgttggtctattaacgtaaacccgtgattttagataactccaaagaaaaaatctaacgggttgaggtcaggagaacgagctggccactctaggaatcctctacgtccaatccattgatttggaaaattcatatccaaaaaatccctaacccgtcgatcatagtggggaggcgctccatcttgttgaaaccaaaaattttgtggtaactggccattctgttgaagtgcaggaataatttggttatttagtaaatttaaatacttgtccccattcaaatttccatctatgaaaaaacggcttattagtctattttgaacaattcccatccaaacatttaacttttgtggatgttgggtatgtgcttcaataatccaacgaggattctcattcgaccaatacnnnnnnnnnnnnnnnnnnnnnnnnnnnnttaagcaaaaagttgcctcatcggaaaacaccgcattacttgcaaaatgttcgtcattgttacaaatgtccaacattcgttcgcaaaactctagccgtcggtcaaaatcatcatctgacaattcttgaaccaattgtatcttatacggatgatatttttccattttcaatattctccttacagaacgttgacttattccatggtttagtgccaaatttgttgtggaagtttgaggtgattcctctaaatcaattgcaatattttgtttaataacttcgttcgttgcagtccgtggtctttccagtttttgggcaatttttgactnnnnnnnnnnnnnnnnacgtttcaatgttttagtaaccgttgacgtgatataggattttcttcaggatgcaattcattaaaaatata

SEQ ID NO: 8715 - DNA, 266 bp, Diabrotica virgifera
  misc_feature (2)..(44): n is a, c, g, or t
  misc_feature (50)..(72): n is a, c, g, or t
gnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 8716 - DNA, 563 bp, Diabrotica virgifera
ccgtttctctttcccgacttttatctggcacttttagcatgatatgttattgttttcagttatgtgtttagtattatacagtgtataattgaccgtaagtggtttatacaatcatttttttatcttattacgaaaatgtcagcttatgaactattatctgttccctccttttttattccctaaaatgttgagatcccgctatttgaggaggaggaggaatagataaaaatcatcctcttggagaacttctacattttcactccatgtcctcctgataatgtgtctgaactagatgattgaaaagtcgccacttctgagatgttattcttcacttgtaaatacagaagtgcacgaccacatatttgttctgttcagaatatcatcatatcctgttgagctgcttacaactgaactatattaaaagcggtccaaagatgtgatcatatactgattgaatggagtgtttgatacgacaggtgtgcagattatgatcgagtacacctacaccgtaaagatgtctgtcctctatattaacgtaatattagtgttttccatctgcaaac

SEQ ID NO: 8717 - DNA, 576 bp, Diabrotica virgifera
  misc_feature (364)..(381): n is a, c, g, or t
  misc_feature (395)..(414): n is a, c, g, or t
agcacctcctagtgaacacgtcgccaatgtgaatcgcgtaacggtaggcatgtgatcgtgtcctcgcgactatgagccccgcgtccgcaggcaatttgtaaataaaacaataaattattatttgtacgttgtccttctaacataattaaagatcacttatagatctattattttcaaattgactgtagctaagaaattaaaatttttcttgataaataaatatactaaatactctttttggagtggaatgctattcgttattgaacaaagctgatggaagacgaaggaaagtagattttactcatgagccgcatatataaagttacatattattatattatgaacatttaatattttgaggagnnnnnnnnnnnnnnnnnncttattagcatggnnnnnnnnnnnnnnnnnnnncgattttaaaatgcatctttgagaatatgatattacttatgtgtatatgatatcatttgaaacctttatagatgggattatgagcaatataaaactagattatctgaattaagtagacaataataagactatctatcaagtaattgtatatttactaaaaat

SEQ ID NO: 8718 - DNA, 186 bp, Diabrotica virgifera
ctacttaagtaacgaattttgtatttattatttcttgttatattaagtagtgatatgattttttagcaaataaaaatgcctcttagttgtaccagttgtaatactgtgttggaaattgacagttaaatgaattcagttaattataaatgaattcagtgacgtttaataaaatgtatgtttagtagc

SEQ ID NO: 8719 - DNA, 560 bp, Diabrotica virgifera
  misc_feature (333)..(353): n is a, c, g, or t
cgaatgtttcgcgaaatgaagattcgatcaaataactgaaaaatgggtgttcaataattttcggaaatgtatcgaatggcaccaggcaggaccacccactatacccctggaggtggatggggggtaactttaaagtgttaaatggaaatcacctgtttttattgcagatttggattccttacgtaagcaacttttatttgggacattttttcgaattggggatggatggcgctataatcgggaaaacgatttatcgtgataccatcagtatgttatagaagcggtctaatatctcgagaaatacacttccaaatgaaaagccaaggagtgcannnnnnnnnnnnnnnnnnnnnctgtcgaataacaccaaacatgatcctgggagtggacccaacaatgtttgatgtcattcgataggtttttgaaaaatattgagtacgtgttttttggtttttcatttggaggtgtatttctcggaccgtttctataatttacctatggtacaggtttgtacacctattaagaatgactgaagaacgttgatctaaacaaatatttca

SEQ ID NO: 8720 - DNA, 341 bp, Diabrotica virgifera
  misc_feature (2)..(24): n is a, c, g, or t
  misc_feature (27)..(52): n is a, c, g, or t
  misc_feature (60)..(118): n is a, c, g, or t
  misc_feature (122)..(188): n is a, c, g, or t
  misc_feature (287)..(304): n is a, c, g, or t
  misc_feature (312)..(332): n is a, c, g, or t
tnnnnnnnnnnnnnnnnnnnnnnngcnnnnnnnnnnnnnnnnnnnnnnnnnntatagagnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnngataaattacttagggaaaacggtaatttttattggaaagttcatccataaaagatgggcacccccgggtgggtttaaaagtatttattggggggcgcnnnnnnnnnnnnnnnnnngtgcgccnnnnnnnnnnnnnnnnnnnnnggtggttaa

SEQ ID NO: 8721 - DNA, 311 bp, Diabrotica virgifera
  misc_feature (2)..(156): n is a, c, g, or t
  misc_feature (158)..(310): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8722 - DNA, 924 bp, Diabrotica virgifera
  misc_feature (274)..(300): n is a, c, g, or t
  misc_feature (537)..(555): n is a, c, g, or t
  misc_feature (776)..(776): n is a, c, g, or t
gagaatacaaaataaaatgtaaagactgaaatagttttgtacacacttatgacaacagttttcggaaggagagaaggaacagtacaattttacataacatcaatcaaaaactatagacaaatgaaccttttagaagatctagagataactaaagaaatgaaacttaatcctgatttttgcttgaatacacaaatcaatcttaattacaactataaacctttgttcagactcttgtgggagactctggaggaagaagtttgacctcatgcaatcnnnnnnnnnnnnnnnnnnnnnnnnnnnctttactaaagcatcatttaaaacaatatttgtaataaatcatttggcagcttattctttaaaaatcacatttcacgaaattcattgttaatttattttccatcttcctaaaaaacttcaccatcaagtttctttacatcatgtattaattttcaaaaccgattcgagtttggtttgtggaggataacttgtcaattggtttatcctagaccttaagtctcttttcaatatgtattnnnnnnnnnnnnnnnnnnncagatttatgtaactacagactttgttgaaaagttgttcaatccaattgctaaaaatgtcatatgtcaactgtcactttatatgagaaaatgtgaagacaccttaacgagcacaccctttctacatcgactgtcattaaaaatcctccatgcgaggcgaccattctgctatctgacaccgcagtattcaaatggtaaggtctttttgaccttaccatgatncaatattcgttttatatataatgtaattttcgtgtgaaagtcctttgtgctcgttcttgatgtttaactttctggatacaaaataaccacagcaaatttaacattttttaacagacagacaaggtttttcccaccaataaaaactaca

SEQ ID NO: 8723 - DNA, 579 bp, Diabrotica virgifera
  misc_feature (91)..(108): n is a, c, g, or t
  misc_feature (143)..(217): n is a, c, g, or t
  misc_feature (265)..(285): n is a, c, g, or t
  misc_feature (330)..(352): n is a, c, g, or t
  misc_feature (545)..(558): n is a, c, g, or t
  misc_feature (560)..(573): n is a, c, g, or t
cggacgcgtgggttatggcggacgaaaaagatgtggtcgaaaaaacgattgccgaagacttggtgggtaccaagtataaattggaaggagnnnnnnnnnnnnnnnnnncagaaaaagctatatactatgagcgtgagcggctnnnnnnnnnnnnnnnnnnnnnnnnnnnnnnnnnnnnnnnnnnnnnnnnnnnnnnnnnnnnnnnnnnnnnnnnnnnaaagatatataatttttctatctctcagaaagagaagtgacacaatcnnnnnnnnnnnnnnnnnnnnnagacataatcaataattattaataaataccataaggataataagnnnnnnnnnnnnnnnnnnnnnnntaaaattttactgaggagccaactgacataagattatatagatctatatatgttatacaaaagaagaataaaaaatttcatagattagtaataaataagatatatttcaaaataccataactgtaattcttaatgaatataatattattatagaaatttacaatatatacatttaatagtgaagaatgtatgnnnnnnnnnnnnnngnnnnnnnnnnnnnngtatat

SEQ ID NO: 8724 - DNA, 495 bp, Diabrotica virgifera
  misc_feature (452)..(492): n is a, c, g, or t
gagaagtgcatccaacaagatgaaaaccataatcgctttcttggcaattttagcagtatcattagcagctagtctcgatcatctcgagcctaaacacattcccataattcgtcaagaaaacgaagtcagcgtcgatggaaactaccgttcttctttcgaaactggaaacggaatcgtcatccaagaacaaggtgttcaaaaaaacgctggtagccaagatgcagcatccgaagtacatggatcagctgaatggcaaagccccgaaggtattccagtagtcctcaagtatgtagccaatgaattcggataccaacccgaaggtaaccttctcccaactccaccaacagacaccaacacacccccaccaataccagaagcaatccttaggtctctcgaatggaacgctgctcatccagaagaaaatgaagaataccaaagaccaaaacatcagnnnnnnnnnnnnnnnnnnnnnnnnnnnnnnnnnnnnnnnnnatg

SEQ ID NO: 8725 - DNA, 509 bp, Diabrotica virgifera
  misc_feature (2)..(22): n is a, c, g, or t
  misc_feature (221)..(241): n is a, c, g, or t
annnnnnnnnnnnnnnnnnnnnggattcttgtactggtggttcgtatccctcaggcctgtcgactttagaaccagcttcaccagtggagtcaccagcaccacctttgcctccatcaatgtttgccacccgccagggcggcaagactttggttaaccgtacccaaggaaccaaaattgcctctgaaggtttgaaattcagagtttttgaagtgtctttagcnnnnnnnnnnnnnnnnnnnnncgccgaaaggtctttcagaaagttccgttggatagctgaagatgttcaaggtagaaatgttttatcaaatttcctcggtatggattaaaccactgacaagctgaggtccatggttaagaaatagacaaaccttaattgaagcatctgctgatgtcaagacatcagatggatatttacttagggagttctgcataggctttaccaacagagatgaaattgctcaaaggaaaacatgctatgcaacaacatatacaaattggagatatcc

SEQ ID NO: 8726 - DNA, 302 bp, Diabrotica virgifera
  misc_feature (6)..(36): n is a, c, g, or t
  misc_feature (38)..(53): n is a, c, g, or t
  misc_feature (55)..(79): n is a, c, g, or t
  misc_feature (89)..(89): n is a, c, g, or t
  misc_feature (259)..(292): n is a, c, g, or t
aaatannnnnnnnnnnnnnnnnnnnnnnnnnnnnnntnnnnnnnnnnnnnnnncnnnnnnnnnnnnnnnnnnnnnnnnnaccttagggnatacagccgtatttttattggagagttcaaatcgataataaaagattgcgacctccatgttgggataaaggttttaatgggggtagagctattatatttaaacttgttcaactttttaaaatttacatggactggggtttaaaacggggggggggcccggttgggtttcnnnnnnnnnnnnnnnnnnnnnnnnnnnnnnnnnncaaaggagcc

SEQ ID NO: 8727 - DNA, 116 bp, Diabrotica virgifera
  misc_feature (4)..(4): n is a, c, g, or t
  misc_feature (8)..(103): n is a, c, g, or t
  misc_feature (108)..(108): n is a, c, g, or t
attnaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataanttttttga

SEQ ID NO: 8728 - DNA, 665 bp, Diabrotica virgifera
  misc_feature (384)..(412): n is a, c, g, or t
  misc_feature (415)..(443): n is a, c, g, or t
gttgttgtcaacttttgtactaaagcaagttagcttaaatcgacctattttgggcccaggaatttaaggttgaactatggcccattttttatcttaaccattttaacacccagtatattttatagtacttccagtttaacttttcccatgcacgaaattattcacgaactactttttatactaggtctatttttaacgcacagaaactaatatcgcaaaattaaaccgcttttccatagaaatcacgataagttaaacaaggataaaaaatatggaatgtttttgatagcttatgaattttgaggtttctaattttcaatgacagtgacagtttattgatttatttgcatttattgtttatttggttttataaatgaataaagnnnnnnnnnnnnnnnnnnnnnnnnnnnnnggnnnnnnnnnnnnnnnnnnnnnnnnnnnnntttcagttaaataaaggaagagttgcaataccgacttttgggttcccagacaaagatgagtattactaatatcgtagtatgttgatactccgttggctaaactaagacacagctggctagtgcgtttagtaagtaattttgtcaatttggtaaaattggcaaaaaaataaatactaaatagttaataataactaaatagttagtaacttttctaattttggc

SEQ ID NO: 8729 - DNA, 236 bp, Diabrotica virgifera
  misc_feature (2)..(228): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttt

SEQ ID NO: 8730 - DNA, 989 bp, Diabrotica virgifera
  misc_feature (814)..(814): n is a, c, g, or t
catatttctaacatatttggcaaactagtggacttaaaaatgagaaattttgtttgtgaactcgaacaatttaataaaccatacgttcatattaaagataaagatgctgtcaataaaaaaattagcaatttaattaatggaggtatgaataaattacaattagtttcagattttgataaaactataaccaaacagcatgaaaatggaaagagacaccgaagcagtttcaatatgttctatgattgtccttcactcacaacagaatacatagatgcagccaatgccttagataagatatacgcaccgcgtgaaatagatcccacaattcctagagacgaaaaaaataaagttgatgaatgaatggtggacattatcggagaaaatattaaaaggtttagttgttcctccagaagaaattgaaaatatatgtgcgattgttggaccgtctatgagggatgggaccaaagaattttttgaatttctcgaatcaaaaaaagttcccatattggtgttttccgctggactcggagacactgttgtagccgtacttaagcactgtgaagtttatttatctaatgtagaggttgtatctaactttttaaaatatgattcggaaggtagaatagaaggcttcaaggatcttcttatacacgtgtacaacaagaatgaagtggctatcaaagacacagagttttaccacaaaatagccgacagagagaatgttattttaatgggcgactctttaggagatgctaacatggttggtggtttagacaacatacatgaaagttttaaaaattggattcctttatgnaaaggatgacgaaagcgtacagattacttggatacttcgatatagttttgtagacgaccaacgatggatatacaagagctatatagctttaattgttccaaagatgaaagcctggggatacgtataaatgttaggcgaatatttattcatttttctgaataaatgatttattttt

SEQ ID NO: 8731 - DNA, 1198 bp, Diabrotica virgifera
  misc_feature (529)..(549): n is a, c, g, or t
  misc_feature (645)..(664): n is a, c, g, or t
  misc_feature (787)..(809): n is a, c, g, or t
  misc_feature (849)..(867): n is a, c, g, or t
  misc_feature (904)..(923): n is a, c, g, or t
  misc_feature (979)..(1004): n is a, c, g, or t
  misc_feature (1053)..(1079): n is a, c, g, or t
  misc_feature (1081)..(1100): n is a, c, g, or t
  misc_feature (1129)..(1162): n is a, c, g, or t
gccctctctagtactagttctagtattttattgtgaccttccaaagtttcactataaattagaatatcatctatatacaaacagactccttgtatgtctccgactatttcattcattactttatgaaaaatctcaggagcgcagcttataccataaggtaatcttgtaaatctaaaccttccaaagggtgtattaaatgtgcatagcttagaactctctaaatctaattgtatcatccaaaaccctgattgtgcatctaacgttgaaaaatattttgcttttgctaattttgacctaatctcattaaatgttggtatgggataatgacatctttttaaagccttgtttaaattacgaggatccagacaaactctcaaacttttattatttttttcgactaagaactattgaatttacccattcactcgcttcattgactttttctataaccctcgtagacaacattctgtttaattcttcttttaatttatcatgtaaagaaaaaggtattcttcttggcggttctatnnnnnnnnnnnnnnnnnnnnnaacttctaagtgacatatattaggtagacaacctagaccagtaaaaacttctttatttttctctatgatagactcatgacttactagactaactcnnnnnnnnnnnnnnnnnnnngacaagtatctagaccccaaattgtttgacactccaaattcacaaaaatgaactcaatactttctaacctattctccatttcacataacaaatttactttttctgctacaggtatcacatcgnnnnnnnnnnnnnnnnnnnnnnnacatgtaagtactaattctaatttttctactttaacctcnnnnnnnnnnnnnnnnnnncataacattagcttggggcactggaatctaaataacnnnnnnnnnnnnnnnnnnnngattcggactacaatttgacccaatttggaataaaaattggttctgaactaattgnnnnnnnnnnnnnnnnnnnnnnnnnncaatttctcccttaataaaaagggggtgggttccggaaattttttctcnnnnnnnnnnnnnnnnnnnnnnnnnnncnnnnnnnnnnnnnnnnnnnncatttctttggcaaaaaaggacccctggnnnnnnnnnnnnnnnnnnnnnnnnnnnnnnnnnncataatcagggggcgtgggagaattttttttttttt

SEQ ID NO: 8732 - DNA, 827 bp, Diabrotica virgifera
  misc_feature (96)..(131): n is a, c, g, or t
  misc_feature (156)..(187): n is a, c, g, or t
  misc_feature (201)..(246): n is a, c, g, or t
  misc_feature (277)..(289): n is a, c, g, or t
  misc_feature (291)..(378): n is a, c, g, or t
  misc_feature (400)..(428): n is a, c, g, or t
  misc_feature (442)..(455): n is a, c, g, or t
  misc_feature (458)..(479): n is a, c, g, or t
  misc_feature (490)..(509): n is a, c, g, or t
  misc_feature (797)..(826): n is a, c, g, or t
agtgagtgtaaaggcagactacagtgattacttacgtattgaataaactcgtttatatttattttatcaatacgaccatcattccgatagaacatnnnnnnnnnnnnnnnnnnnnnnnnnnnnnnnnnnnnccgtcacgcttgtgtatcatggacnnnnnnnnnnnnnnnnnnnnnnnnnnnnnnnncaaattaaaagaannnnnnnnnnnnnnnnnnnnnnnnnnnnnnnnnnnnnnnnnnnnnncttgtgtgatgaaatgttattcgttgttgtnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaagtaagaatttattgnnnnnnnnnnnnnnnnnnnnnnnnnnnnntataagagttctgnnnnnnnnnnnnnngannnnnnnnnnnnnnnnnnnnnncattgttatcnnnnnnnnnnnnnnnnnnnngataaatataaggttatttcagttcagaatgatgataataatacaattaaaaaatatgcgatattcagtataaaaatataagtataaaaaaggaaatccgcgaaattgttatcttctgtttgttaaatccatgttttttttgtatgatttataaagttatcgcctgcccggtgattaccttgcatgggcgaggtattttgatcgagctaaggtatcatatagattaagttttatattgaaagtgagatgtatgggtagaatggaggaaatgttggtcttgtttattcnnnnnnnnnnnnnnnnnnnnnnnnnnnnnng

SEQ ID NO: 8733 - DNA, 480 bp, Diabrotica virgifera
  misc_feature (7)..(34): n is a, c, g, or t
  misc_feature (38)..(66): n is a, c, g, or t
  misc_feature (102)..(126): n is a, c, g, or t
  misc_feature (129)..(203): n is a, c, g, or t
  misc_feature (209)..(298): n is a, c, g, or t
  misc_feature (338)..(359): n is a, c, g, or t
  misc_feature (412)..(430): n is a, c, g, or t
  misc_feature (439)..(457): n is a, c, g, or t
taatcannnnnnnnnnnnnnnnnnnnnnnnnnnngagnnnnnnnnnnnnnnnnnnnnnnnnnnnnnctacttataaagcattttattttttagttaacaagnnnnnnnnnnnnnnnnnnnnnnnnnacnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttagggataaccgcggaattttttatttgaaaagtcnnnnnnnnnnnnnnnnnnnnnncccccccccagtgttgggattaaagggttttaaaattggggggaaaacccccnnnnnnnnnnnnnnnnnnngtttcccgnnnnnnnnnnnnnnnnnnncattgatttccgagtttttaaaa

SEQ ID NO: 8734 - DNA, 355 bp, Diabrotica virgifera
  misc_feature (6)..(153): n is a, c, g, or t
  misc_feature (155)..(155): n is a, c, g, or t
  misc_feature (192)..(192): n is a, c, g, or t
  misc_feature (321)..(350): n is a, c, g, or t
agcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanttttgatcccattttttgatatagataaataccttangatacagcgtattttattgagagtcaatcgatataagatgcgactcgatgtgataagttataatgtgtacagtaattataagctgtcgctttaaaattactgatcgggtaaacgggggggccggtgggnnnnnnnnnnnnnnnnnnnnnnnnnnnnnnagggc

SEQ ID NO: 8735 - DNA, 90 bp, Diabrotica virgifera
  misc_feature (5)..(87): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnnncga

SEQ ID NO: 8736 - DNA, 897 bp, Diabrotica virgifera
  misc_feature (126)..(145): n is a, c, g, or t
ataaaatataaaataaactatggtggttgatctttatgctttattgctaaataaatatgtgatcaatgctgagattcctcaaggaaacaacaatatgatagtgttttctccttaaccaaatctggnnnnnnnnnnnnnnnnnnnncaagtcatttaatcactgaaaaagtcatattacgcttaaaagcataacttttgtttcgtctacttttaacatgatcttagaaaataagttttgagaggttatgaagtgactttgtggaaaatatatttagttatgtaggtagtcttcagatttaggataaaagttttgtacttaacaatttgtgcatgaataatctctaaaatattactacttcaatgaatactgactgtatctgccattagcaatacattaaatatattataaacgtgtttagttatgtttataaactacctgcatgcaagttattacatgcagattagatacatgtagacatccgtttgtagatgcttgtctccaggatcttcttggtcttccctatttcctgcgtttggtggggatccactgtaacattctctttggccatctttgatcattcatcctttcgacatggccataccatgtcagacttttgcatcctatagattcaggatgtcattatctgtacctatacactctctggtttcagcaatccttactctatctcttctagtgatttggcaacatctacgccaataatttatttccattgctttctatgatacttttgtatatcctcatttttgtgtttcgagtgatgtgattcttcagagtgatgtgattcttcagttgacgtattgctgaattacctttgaccattctagtagctatttcttttgtacatattccaatcatcgtttgtaatgcttacatat

SEQ ID NO: 8737 - DNA, 647 bp, Diabrotica virgifera
  misc_feature (92)..(115): n is a, c, g, or t
  misc_feature (142)..(180): n is a, c, g, or t
  misc_feature (188)..(213): n is a, c, g, or t
  misc_feature (218)..(236): n is a, c, g, or t
  misc_feature (287)..(305): n is a, c, g, or t
  misc_feature (309)..(346): n is a, c, g, or t
  misc_feature (380)..(405): n is a, c, g, or t
  misc_feature (480)..(501): n is a, c, g, or t
  misc_feature (526)..(547): n is a, c, g, or t
  misc_feature (603)..(621): n is a, c, g, or t
gctggcttagaaagaggtgaacaaggtgaactaaacgaatttaatgtctggactagagaagctggcagtggtcaattggccatttcagatgnnnnnnnnnnnnnnnnnnnnnnnntcttctgtaccccgcgactcggggagnnnnnnnnnnnnnnnnnnnnnnnnnnnnnnnnnnnnnnntaagaggnnnnnnnnnnnnnnnnnnnnnnnnnnatagnnnnnnnnnnnnnnnnnnnttgtaaggaacggcaattggtttctatatataactaattgttaaagaaacnnnnnnnnnnnnnnnnnnnccgnnnnnnnnnnnnnnnnnnnnnnnnnnnnnnnnnnnnnnatataattttagggatgagtttaagaatgaaatnnnnnnnnnnnnnnnnnnnnnnnnnngaatgaggaccaacgattttctgtgtttcatagtatgaaattagtaatttttatatatcattatattcatttccnnnnnnnnnnnnnnnnnnnnnnccaattatatcactcaaattttggnnnnnnnnnnnnnnnnnnnnnnggaatatgtacatgtagtaaaaagatttatgtaaaataacggaattcgggaacccnnnnnnnnnnnnnnnnnnntaaacatgcctgttcgcattaagtca

SEQ ID NO: 8738 - DNA, 138 bp, Diabrotica virgifera
  misc_feature (7)..(56): n is a, c, g, or t
  misc_feature (83)..(128): n is a, c, g, or t
tgatgcnnnnnnnnnnnnnnnnnnnnnnnnnnnnnnnnnnnnnnnnnnnnnnnnnngaaagcttgcatgaaggggtggatgtnnnnnnnnnnnnnnnnnnnnnnnnnnnnnnnnnnnnnnnnnnnnnngttaaaaagc

SEQ ID NO: 8739 - DNA, 535 bp, Diabrotica virgifera
  misc_feature (13)..(45): n is a, c, g, or t
  misc_feature (167)..(194): n is a, c, g, or t
  misc_feature (339)..(360): n is a, c, g, or t
cccttcgcgtccnnnnnnnnnnnnnnnnnnnnnnnnnnnnnnnnnttttatgctaagagaacaaattatttttgctatgttgataattcactgaggacagagaagataatattttctatattatacagaaataaccctgttccctggcggcccagcggatatgaggnnnnnnnnnnnnnnnnnnnnnnnnnnnnattttcaatctcagaaagagccataaaattaattattgttagtgcattataaatattttttctgccttgtagagagagccgtgttatatctctttctaagtatatctaaataaagaaaaaatcacttactattaatacattaccnnnnnnnnnnnnnnnnnnnnnnactataatataaacataaaacttatgctgaggaataacctgacatttaaaattatacctctatacaagtcctaaataaggagcatcgatccaatagcatacctagttttaaataagatattatcaaattctatataatagtattcctattgtatataaacctattatcaaaatat

SEQ ID NO: 8740 - DNA, 857 bp, Diabrotica virgifera
  misc_feature (471)..(489): n is a, c, g, or t
  misc_feature (730)..(730): n is a, c, g, or t
  misc_feature (753)..(753): n is a, c, g, or t
atcaaacatcagatattttaggtcatgattggaattggagttattattctcttatttactttcatttacttttattggttatcatggataaatacaaaatacatgcgaaaaattccaggtcctaagccaaatatattttttggaaatttattgatatttgccttcgtaccatcttacatgtatttggacatttttatgaggtttatacaagaatatggcaaattattcaaagtttatgatggaccatttagtgtggtcttggttgccacagacgaaaaattcgtggaacacatattaagttcaacggaatatattgataaagctgctcaatatgattatctaaaaggatggttaggcgatggattattagttagtacaggcacaaaatggaaacagagaagacgtatgcttaccccagcttttcacttttcaattctagaaaactttattgacgttttcgacagcgtaggnnnnnnnnnnnnnnnnnnncttcaaagggaagttggtaaaaatagtgtcgatataagtgaacttgtatctctctacacactggatgttatatgtgaggctgccatggggacaaaattgaatgcgcaaacggattcaacatcttcatatgtaagaagtacaaaatcgatgtgctgcataattatgaatcggattttatctcctttagatccttcgttgtatcctttcactttaaactattttctttgaaagagagcattanaggtacttcacgcatacactgancatgttatcgagaaaaaatatgggagaaacgcaaaaagagatattgtattgatacaacacgagcattggcattaggaaaaactggcgttttagatttactctta

SEQ ID NO: 8741 - DNA, 452 bp, Diabrotica virgifera
  misc_feature (5)..(30): n is a, c, g, or t
  misc_feature (36)..(54): n is a, c, g, or t
  misc_feature (128)..(188): n is a, c, g, or t
  misc_feature (214)..(245): n is a, c, g, or t
  misc_feature (278)..(304): n is a, c, g, or t
  misc_feature (325)..(361): n is a, c, g, or t
ggaannnnnnnnnnnnnnnnnnnnnnnnnnctgggnnnnnnnnnnnnnnnnnnngggaagatatatggaaaaaaacccgctggttcccttggtttgttttcctaaagggggtttaaaaaaatggaacnnnnnnnnnnnnnnnnnnnnnnnnnnnnnnnnnnnnnnnnnnnnnnnnnnnnnnnnnnnnnaagtttcaaaatcacaaggggtaatnnnnnnnnnnnnnnnnnnnnnnnnnnnnnnnncctttgggacaaaaaaagtctaaaattaagtgnnnnnnnnnnnnnnnnnnnnnnnnnnngggggtttaaaggaaaaaggnnnnnnnnnnnnnnnnnnnnnnnnnnnnnnnnnnnnnggtatttatggaagagggttgggtttacttttagggggggaaaatggggtaaggggctttaataaaaaaaaccctttttatttaccctggg

SEQ ID NO: 8742 - DNA, 753 bp, Diabrotica virgifera
  misc_feature (120)..(145): n is a, c, g, or t
  misc_feature (273)..(303): n is a, c, g, or t
  misc_feature (605)..(625): n is a, c, g, or t
  misc_feature (660)..(752): n is a, c, g, or t
gacgataggtgattatgaaattgtgaagatatccgattctcaaggatcccagattgacctccgggaaccccggaagatccacaagatcatgtcaacggccactcacaactgacttgctcnnnnnnnnnnnnnnnnnnnnnnnnnnccaggggcgctaaacacgagcttatagcccctgggaggtgttcacatccagggcgtcgaatgtttttatgatcttgctgatcctttccgtcttctgcgcggttcgaacatgactaatcttctatattnnnnnnnnnnnnnnnnnnnnnnnnnnnnnnngtgaagcctccaccacaaatatccagtaggttcagagaagttaatactagcaattgtctctatatctccatgagactttcaatgtgctcctatattttgttatctctttttccacgacttgctcttctaatatagtgatttcaattataataaatctaggaatgttggaaagtactggaatccaaaacatcaccccttttcccccctctcctcgctcccttcaggcccctctctccgccctctctttctctgccctctttcatcttgtactatggttttccatcgctcacctctcaactagnnnnnnnnnnnnnnnnnnnnnactgcactccacactcccctcctctctcctcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 8743 - DNA, 691 bp, Diabrotica virgifera
  misc_feature (18)..(54): n is a, c, g, or t
  misc_feature (90)..(110): n is a, c, g, or t
  misc_feature (127)..(233): n is a, c, g, or t
  misc_feature (235)..(256): n is a, c, g, or t
  misc_feature (279)..(298): n is a, c, g, or t
  misc_feature (310)..(327): n is a, c, g, or t
  misc_feature (368)..(385): n is a, c, g, or t
  misc_feature (444)..(464): n is a, c, g, or t
  misc_feature (513)..(531): n is a, c, g, or t
  misc_feature (611)..(636): n is a, c, g, or t
gggaggagcagcataaannnnnnnnnnnnnnnnnnnnnnnnnnnnnnnnnnnnnatgatgattaataatcttcttatttaaaagtatagnnnnnnnnnnnnnnnnnnnnncattatttttattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncgcctgttcattaaaaacacgcnnnnnnnnnnnnnnnnnnnngtcctcgccccnnnnnnnnnnnnnnnnnngtggcccgcggtattttgaccgcgctaacggagcataatcnnnnnnnnnnnnnnnnnngaacgctgggaatgaaggggtcggcacgaacaaaaaaactgccctttattttacttctnnnnnnnnnnnnnnnnnnnnngttaaaaagcgttaaattttttttacaagaccgaaaagaccctaatcgnnnnnnnnnnnnnnnnnnnacataagtttcttttagcatttaatcttattcatctaacaaaatttactttcattggggggggattaaaaaataacattnnnnnnnnnnnnnnnnnnnnnnnnnncttaaaaaatcttctttgaccccctttttttttgcttccaaacaaaaaatttccc

SEQ ID NO: 8744 - DNA, 456 bp, Diabrotica virgifera
agaatatatcttttattgaccgtgaaaaaagatgtcatgtaatgacttgcaagttttattgagagaaaatatgttattttcataattaaagattttatcgtcgatgaaccttgtaatacaagtgaataatcctcaataattgcatatttattattttctaggttaacccatctatatagttatcattttaaatgtacacataccattacaaataatggactcgtactgtcgtggcattcttctttcaattatgatgaaattctttaagaaacgcaatgatatttacatataagtcatatatatataatgtaataattttatgttcttaatattgaacactttcacgagatgagttcacaataacattttatgctaattcaaccttaacttgaaatttcagatgtacacatttcatctcctggaacatgtcattagtcgtcactgattataataatt

SEQ ID NO: 8745 - DNA, 262 bp, Diabrotica virgifera
  misc_feature (2)..(62): n is a, c, g, or t
  misc_feature (64)..(149): n is a, c, g, or t
  misc_feature (162)..(228): n is a, c, g, or t
  misc_feature (233)..(259): n is a, c, g, or t
gnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnaaccccatagagnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnncaa

SEQ ID NO: 8746 - DNA, 896 bp, Diabrotica virgifera
taaatctaaatcgaaaaaaagtgtaccatttttaaattatcgtaccaaatatcgcaaaaatagtaaaatatgttcgtaaagtaacatatgtacgaggattcatgcacctacgaacattttaaccctcaaaaactcgatcgagtcgtagtgaagtgacgacaaaggtcgatggtcgatcagaaaattaatggtgaggtgaagcccatttcacatgaaaaaaatgttgtaaccaagtgatttcgtgttttaaacccatttttattcgttttacactgattttatgttatttgaagtgtaccaggtgtcataaatgactactacaagtgcgaaaatactgtgatcactcaatcggaagaagggtatagcaagaaatgtgatatatttatagaattgttaaaaaatcggacggaaaatatgagtggccgcccgagaaccacttctttcgcagaaggtaacaagcaagcattgaatccacctttaggagacatgaaaattagcagtggaggttatataggtaaagatggaagtaaagtgacgactgtagtggccaggcctggtcaagggcctgacagacctcaggaagtatcctacaccgacaccaaagtaattggaaatggcagttttggggttgtgtaccaggctaagttgtgtgacactttcgagttagtagctattaagaaagtcctgcaagacaagaggtttaaaaacagagagttacaaattatgcagaagttagaacattgcaatatagtgaaacttacatactacttttactctagcggagacaagaaggatgaagtgtatctccatttggttctggagtactccctggaacggtgtataaagtggcgaggcattacagtaaggctaaacatacgataccaatcatccacata

SEQ ID NO: 8747 - DNA, 304 bp, Diabrotica virgifera
  misc_feature (34)..(90): n is a, c, g, or t
  misc_feature (175)..(187): n is a, c, g, or t
  misc_feature (189)..(212): n is a, c, g, or t
  misc_feature (214)..(236): n is a, c, g, or t
  misc_feature (260)..(277): n is a, c, g, or t
caccttggggatcaggggatgaataaataacaannnnnnnnnnnnnnnnnnnnnnnnnnnnnnnnnnnnnnnnnnnnnnnnnnnnnnnnngaaaagaattataaataatgatgtccgtattgaagggaagggcattgttttttctatatctaattaattatgaattaaatagatnnnnnnnnnnnnnannnnnnnnnnnnnnnnnnnnnnnncnnnnnnnnnnnnnnnnnnnnnnntatgattgaggtgagtattaaggnnnnnnnnnnnnnnnnnngcttgtttacaagtcatgattagggaa

SEQ ID NO: 8748 - DNA, 475 bp, Diabrotica virgifera
caaagttggtattgttcttcgcatccactgccctgtgcgacttatctgcgtgcatttgtagccattaatcgctgttatacagacctatctgaatgactgtcgtgtaactgacctaggaaactgtatcactagcatgatgcaaatccttacgctctataaaacaattgtagattactccatctgaagacagagtatccctattatgatttctttttttacttatcttactgggacacaggaaatcatataaatgacagggatctggtgagagaaaaacatgctgtatcaagaaaaccaggtatgccgaatggaaaagaaagacaaccaagatctaatgttgcttacactttgcaagataaactgcctgatgaccgagagattcctgatataactgttgaggaagacaacaggacacataagtgtatttgggattgagtatccctacttttgtatacttgcattttgaagaaatatt

SEQ ID NO: 8749 - DNA, 880 bp, Diabrotica virgifera
  misc_feature (111)..(129): n is a, c, g, or t
  misc_feature (339)..(357): n is a, c, g, or t
  misc_feature (554)..(579): n is a, c, g, or t
  misc_feature (852)..(852): n is a, c, g, or t
taattttgtaaaagatcattttttgatcaggcaagtttcgatttaaaatttgcctagtagttgtagagacattctgctctagtatttcacgttcaagggtcagtaagatcnnnnnnnnnnnnnnnnnnncaaaactcttgtgacattgcaagactgtgaactgtgtattttttgtaacctagtgctctaaaaataatggaaaagaaagttaagatagtaaccttcataaaaagaaaattagtttataaaggttactcctacaactcagtgagaaatggtcctgatggcaaaatttattggcggtgtgatgaatcatttaccaaatgtggtggtactgtnnnnnnnnnnnnnnnnnnnaaggttcttcagggaaaaccacacaatcatgctcctacgccgacccaagttgcagttaaggctgtaacacataggattagggaagaagttgcatccactagctctacaacacaggatgtggttagcagtgctctaagaagaatggaaaacaaagttaagcaggcaaccttcatatccacgaaaaggggtaaaagaannnnnnnnnnnnnnnnnnnnnnnnnnaacacaacaagaaatggtgctaatggcaaaatttattggcgatgtgatgcatcatttaccaaatgttgtggtagtgtaataactgatgctgcaagtaatgttcttccgggacaaccacacaatcattctccctcgccaaccaaaattgcagtgaaggctgtaagacatagaattagggaaacagctgcatccagcagctttacagcacaggatgtagttagcagtgccttaacagggatatcagacgaagtaaaggtacttctcccgaagctnaaaaattacgaaagtcaggtactgcaac

SEQ ID NO: 8750 - DNA, 71 bp, Diabrotica virgifera
  misc_feature (13)..(13): n is a, c, g, or t
  misc_feature (16)..(70): n is a, c, g, or t
ggaatggaggggntgnnnnnnnnnnnnnnnnnnnnnnnnnnnnnnnnnnnnnnnnnnnnnnnnnnnnnnng

SEQ ID NO: 8751 - DNA, 535 bp, Diabrotica virgifera
  misc_feature (267)..(291): n is a, c, g, or t
cggacgcgtgggttcgtgcttttgcttctttcactatgttttctccttccgtccattgtcctatttcgtggttcatccagggtcttctttcgttttcatttattacttttggtcccagaatgttgcgcattatttttctttcaaatactttcagctgttcttcttcttttaacgttagggtgttggtttctatggcatacattaccactggccttatggtggtagtcttatatatttgcatctttgtatttctgcttaattttttannnnnnnnnnnnnnnnnnnnnnnnnggtaagctctatttgctgcttgtagtttctgtttcaggtctattctttcattatctctactaatcatcgttcccaagtatttgaatgtatctacttcctcaaatctgtaattatctattatcatttgtgttagtcttgttttcttgaatctgctggcgttcatgtactttgttttttccatatttacgacgatccctcttcattttgtgctgctgtcgatcccgtagatggagtcgacgatgga

SEQ ID NO: 8752 - DNA, 777 bp, Diabrotica virgifera
  misc_feature (328)..(349): n is a, c, g, or t
ctaacacgcgtagttatcaggaggcactccaggctttaaatgagcttcaaactaatgcggactatattaaaaatgtagtaaatcagccaaggaatgcatctaatattccagaggttattaaattcttaggcaggactggtttgtctgtaactgatctagaccgactgtctgtcatccatgtgactggcactaatgggaaaggaagtacatgtgcctatactgaaaaaatattgagaagtcatggttgtacaactggatttttttcatcaccacatcttcttgatgtacgagaacgaattagaataaatggaaagcctatatccaaaannnnnnnnnnnnnnnnnnnnnngaaactttataatttgctcaacaaacagaaggactatcccgcagatatgccactatatttccgtttcatgacgctattagcttttcacatatttttggatcataaagtggatgttgctattttagaggtggggattggtggagaatatgattgtacaaatgttataagaaaaacgtcagtggtggggataactcctttagattttgaccatatggctttattaggtaatacattggaatcaattgcttggaacaaagcaggaattatgaaggcaggatgttcagcaattacagtatagcaacctccgaacgcattcaaagtttttgaagaacgaagtgtaaagaaaaattgttctcttactgtcgtggagagtgattactataatgcaactaattccgatataccattgcatggtcgacaaactaatg

SEQ ID NO: 8753 - DNA, 114 bp, Diabrotica virgifera
  misc_feature (6)..(7): n is a, c, g, or t
  misc_feature (21)..(21): n is a, c, g, or t
  misc_feature (31)..(67): n is a, c, g, or t
  misc_feature (75)..(77): n is a, c, g, or t
  misc_feature (84)..(103): n is a, c, g, or t
  misc_feature (112)..(112): n is a, c, g, or t
ttatannattattaataagtntttttagtannnnnnnnnnnnnnnnnnnnnnnnnnnnnnnnnnnnngtgattannnaataatnnnnnnnnnnnnnnnnnnnnttatataanta

SEQ ID NO: 8754 - DNA, 85 bp, Diabrotica virgifera
  misc_feature (2)..(84): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 8755 - DNA, 915 bp, Diabrotica virgifera
  misc_feature (669)..(688): n is a, c, g, or t
  misc_feature (717)..(823): n is a, c, g, or t
  misc_feature (868)..(893): n is a, c, g, or t
ggcaaaatatggtatgccactgttctgactcctttataaaggaaaatttatttatggcctttatttccgaaacctcgtgtggagattctcgacggtgatcccagcatgatcatcggcaaacagacgaatcgcagccccagaagataacaataccagtcaatagatgccagcagtcgcaacttgaggacctgaagctccaaccccgcttgtggagtaggtcgtttttcttttcccaaaccccccaggactcaggtgcttgacggttacggacccgttgcgacaattggcagatccgttccctctcctcgcccagtccgactgattagtaatcgaacttggtgtatcaaagtagtaccctggctcagtgtcaaattggtagcgtccctactcatgccccgatcattttctaacgtgccactcctcccgatgacccttaccctccaagatactatcaccgtgactcacgtgttctgctatcctatatcctgaatagtttgtttcccagaaataggggacttacatgatacaagttccatacagctggcacgcatagtaccccagctaatctccccgtacgcccctgtcctgcccaactcagtactcgcaccccactatttatctatgcctattatcgtataaagctagacgtcccctactcgttctcatctnnnnnnnnnnnnnnnnnnnnttcaactggcacgccctccccccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttttactcccctctccctccccccctccaatcccctctcannnnnnnnnnnnnnnnnnnnnnnnnncctcttccctcacccccccccc

SEQ ID NO: 8756 - DNA, 486 bp, Diabrotica virgifera
  misc_feature (365)..(391): n is a, c, g, or t
ccccccgcccgggggaggatgacatatatttgccaggatttgaaatgaatttatcacatcagtcatacgatcatgaattaggttgggaagataaaactagtcgacgtgttcttattagttactgctaagggattgtgagatactatgtagaagaaagtacaatatggagtgatgagcatgctaataactgggaaagatatgagatataacgcctaagatgcgaaactatgtggtggtatcgtcaagctataaggagcagggctgctaactctatttttcactgtgtggagatattcggatggtttctgggtctgtgtaccttcataccatgacccacaagacggctggaaccactgtagcttatnnnnnnnnnnnnnnnnnnnnnnnnnnngaacggcggggttgaggtgttgggtatgataaagatggacccagaagcggacgcaatatcactcaaagtgaaaaatggaggacaagactctaatc

SEQ ID NO: 8757 - DNA, 757 bp, Diabrotica virgifera
  misc_feature (193)..(221): n is a, c, g, or t
  misc_feature (309)..(328): n is a, c, g, or t
  misc_feature (347)..(375): n is a, c, g, or t
  misc_feature (692)..(711): n is a, c, g, or t
cttcccgcgtccgcgatttgccccaatatttttgtccgacacttatatttcttgatttagaatataattacttataatctcctatttttgtcggaaaaatggttgtaaataaaaaaagaatgtgtgtgtactttgtacgcacgtaagaagttatacttctactacatattatgtgatttttaaggcaataccnnnnnnnnnnnnnnnnnnnnnnnnnnnnngcacacaaacacattgaaaaatgccacaaagaaaaaatgatttctgaacgataataattgttggcaaaaattttaaatacgcattttnnnnnnnnnnnnnnnnnnnncaaatatacttacaatcannnnnnnnnnnnnnnnnnnnnnnnnnnnncttgcatcgggaatcgaacccatgactttcggggcgctttgattcgtaatcgaagcctagactcactcgtccaattccacattatttgtcatgtggaaaaatagggcaactgaacgttttactgtttgacagttgttttgaatataattaaattatgtagtttaaattttgtggaagaaaatattaaaatataacaaaacagtaagaaaacaatatattagatgaagattggtagaacttttgttggtaatcaaattaagtatgtaaatcaaagcattacatacctactagataaataaatctacgccaaaaaatcnnnnnnnnnnnnnnnnnnnnggacctaatttgtgatttctctctaaaatccccattcttgagaaat

SEQ ID NO: 8758 - DNA, 211 bp, Diabrotica virgifera
  misc_feature (76)..(89): n is a, c, g, or t
  misc_feature (92)..(114): n is a, c, g, or t
  misc_feature (122)..(144): n is a, c, g, or t
  misc_feature (174)..(205): n is a, c, g, or t
taccttagggataacagcgtaattttattgggagagttcaaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8759 - DNA, 1321 bp, Diabrotica virgifera
  misc_feature (2)..(22): n is a, c, g, or t
  misc_feature (196)..(216): n is a, c, g, or t
  misc_feature (415)..(435): n is a, c, g, or t
  misc_feature (599)..(622): n is a, c, g, or t
  misc_feature (685)..(704): n is a, c, g, or t
  misc_feature (727)..(746): n is a, c, g, or t
  misc_feature (957)..(989): n is a, c, g, or t
  misc_feature (991)..(1003): n is a, c, g, or t
  misc_feature (1099)..(1126): n is a, c, g, or t
  misc_feature (1146)..(1234): n is a, c, g, or t
  misc_feature (1237)..(1287): n is a, c, g, or t
  misc_feature (1289)..(1302): n is a, c, g, or t
gnnnnnnnnnnnnnnnnnnnnnatacttaagttgtttgggttttactcacggtttggatttgtttatggagtgtaggttatactactctagtagattaatagcagtgttgtaagtgatactattgtttgcagaaattatatattttgtcattaaaatatttggatcatgtttttgagtcaggtactgtcataatgnnnnnnnnnnnnnnnnnnnnntaagaatctattagttaagtcatgatcaagtaaatgtgattgcttacagtgactcatgcggcggtcagaataagaataaaaatataagcaaattattcatacacattgttcgcactacacatattgaaaatattgaccacaaattttttgaacctggtctcacctatatggagtgtgatcggagtttcgctctaatagnnnnnnnnnnnnnnnnnnnnnctgagatatttgtacctgatcactggtgttacttaaaagtgttcaaaaaaatttgttgttattaaaatgacatattttgtgtccctttcaaatttaaataatttcattaaagataagaaggatagcgaagatcttgtgatcaaatggagagacattaagtggtnnnnnnnnnnnnnnnnnnnnnnnnaccaattttcttttaacagtactttagacgaagactcagaaaaatacaataagaatgttggannnnnnnnnnnnnnnnnnnnttggaacttcttggagatcaagnnnnnnnnnnnnnnnnnnnntatcaaaatgtggaatatttacaaccagctgctagattccatacccccccatttaccaaagccgcaaaaacacaatgaaaaaagccagcacccgctggttgagtctttgcaaagaagatgccaatgacgaccaagacggggtacataagaattttttttggtcaaattataagtaacttttaatgttattaccgaagtaaaatttgggggnnnnnnnnnnnnnnnnnnnnnnnnnnnnnnnnngnnnnnnnnnnnnntttggtttgtttcctttttatggaataataaaagtcattttttggttttaagggaaaaaattattttaaggggcccttttttttggccaaaagggnnnnnnnnnnnnnnnnnnnnnnnnnnnnccccccacaaaaaaaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnnnnnnnnnnnnncnnnnnnnnnnnnnngtgggggcttttttttttt

SEQ ID NO: 8760 - DNA, 411 bp, Diabrotica virgifera
aaagataaagaaatttaaataggagtgagtaaacaacagtaaagtttcagaaattaaagattttctcaatatgcaataggaactataaatgcataatttttcgctttataatttgtggataatcagagtttttaatgttataggactaacctaaaaagttttcttttatttgtatgctataaatggtcaacgatatcgtgttgtagacgatgtaaaattaatgaaattaatacttatatagttacaagatataaaactatcataaccatgacttagcaactttatagaacatacttaggaattacatttcttctaaatgctaagtattatcattgtggctcctgataatattcttaatgatttatgcttcgcttaccttatacgaatatctattcatgattatgatattat

SEQ ID NO: 8761 - DNA, 339 bp, Diabrotica virgifera
  misc_feature (2)..(25): n is a, c, g, or t
  misc_feature (28)..(85): n is a, c, g, or t
  misc_feature (103)..(104): n is a, c, g, or t
  misc_feature (112)..(130): n is a, c, g, or t
  misc_feature (253)..(323): n is a, c, g, or t
gnnnnnnnnnnnnnnnnnnnnnnnnctnnnnnnnnnnnnnnnnnnnnnnnnnnnnnnnnnnnnnnnnnnnnnnnnnnnnnnnnnngaataatttaccttaggnnatacaggnnnnnnnnnnnnnnnnnnngtcaatcgataataaaatgggggccccccagggggggttaaagtttataaattgggggagcagatattttttataaaatgggggtgccctttttaaatttttaatggggtgggggtgtgaaannnnnnnnnnnnnnnnnnnnnnnnnnnnnnnnnnnnnnnnnnnnnnnnnnnnnnnnnnnnnnnnnnnnnnnagaaggggggccccac

SEQ ID NO: 8762 - DNA, 886 bp, Diabrotica virgifera
  misc_feature (15)..(85): n is a, c, g, or t
  misc_feature (805)..(805): n is a, c, g, or t
ctatcctatgtcctnnnnnnnnnnnnnnnnnnnnnnnnnnnnnnnnnnnnnnnnnnnnnnnnnnnnnnnnnnnnnnnnnnnnnnngattctggccatattaattagaaataaaattaaaacaaaagtggaaaattgtctaggtgaatatcaagcgggttttagagcacaaagatcggtaatagaccaaatttttgcaatgaaacaaattttatctagctcatatgaattcaacctagcattaaatatgttatttattgattttaaacaggcatacgataccataaaaagaagtaaagtatatgaaacactagaatattttgaatttccaccaaaaatagtaagattgactaaatgcatacttagtgacactaaaagtaaagttatgatagaaggacgggtttcggatagctttatcaccaatagaggcctgcgacaaggtgacccgttatcaacagatttcttcaatttaattttagagaagattatacgagaatgcaatatctatactaaaggcacagtttatcatcacaggcatcaatgtgtagcatacgcagatgatattaccttaataacaaggagacctgcagaattaagagaaatcttcaatagactagaaagaacagccaaggaatatggtttagaaataaacgaagagaaaacgaaatatatggtgatgaagggaaatgaaaatcatctgggacagtcctttaagatacaaagccccagtaaaagatataacttcgaaattgccggccaattcgattacttgggagtaacactaacaaataggaacgaagagaaccnagaaatagcaaaaagaatggcgaaaagtagtaagagtgctggaagtctaaataagatactgaggtcgaagataatatccag

SEQ ID NO: 8763 - DNA, 158 bp, Diabrotica virgifera
  misc_feature (2)..(48): n is a, c, g, or t
  misc_feature (50)..(86): n is a, c, g, or t
cnnnnnnnnnnnnnnnnnnnnnnnnnnnnnnnnnnnnnnnnnnnnnnngnnnnnnnnnnnnnnnnnnnnnnnnnnnnnnnnnnnnngtgtagattatgtaaatttagtaatgttgataatattagcagtagacaatggtttatttagtgagtatatat

SEQ ID NO: 8764 - DNA, 826 bp, Diabrotica virgifera
  misc_feature (537)..(555): n is a, c, g, or t
catatttgattctataaaaatgaccagtattaaatttactgagcaagcatattgcaagatgatattgcatgcttctaaatatcctcactgtactgtaaatggtattcttttaactaaatcatcccccaataataaggaagttgaatttgttgattgtgtacctctatttcacgtgtgcataaatttaacaccgatggcagaaatagcattaatgcaaattgatgaatatgcttcaaaaaagaacttgactatagcaggatattatgtagcccccgagaatcccagggataccagttttgacaaaatgtacaatcgaatatctgataagattgcctcaaattgtagtccttcttatgttgtcattgtgaacagcacagccaataccattcaaagaggtaaaatagctttaaaagtaggtcagtacaatgacggtagtttaaagcagtgtgatgacatcagtgtatcagatgatgccatgaatgtgtgcatatctggacttaatgactcattgtatgaaaaattagtagattttgatannnnnnnnnnnnnnnnnnnattagactggaccaatagtgaattgaataaggagattcattcttttttatgaggacagctagcttaggttaattgattttttcttcacaaaaatatttaaatagattctaaatacacattcctatacaggtatgcctttattgcaaagttcaacaaatttgacctctgctagtaccatctgtcattttatttatgttttgtagatatgtaaaagtttgcaatttatatgttgttgaaatatcattttaaatacagtaatgatttatatgtt

SEQ ID NO: 8765 - DNA, 198 bp, Diabrotica virgifera
  misc_feature (180)..(197): n is a, c, g, or t
ctcccagtcatccagtcttaaaaaacatatgcgaggccatactgggggagagaccatattcttgttccgtatgtaaaaaaggtttctcccagtcatccagtcttaaaaaacatattatgcgaacgcattatcggtgagagaccgaatccttgttccaaatgtaagaaagagtattgctcnnnnnnnnnnnnnnnnnng

SEQ ID NO: 8766 - DNA, 555 bp, Diabrotica virgifera
  misc_feature (7)..(27): n is a, c, g, or t
  misc_feature (41)..(80): n is a, c, g, or t
  misc_feature (86)..(207): n is a, c, g, or t
  misc_feature (210)..(232): n is a, c, g, or t
  misc_feature (234)..(304): n is a, c, g, or t
  misc_feature (311)..(328): n is a, c, g, or t
  misc_feature (395)..(414): n is a, c, g, or t
  misc_feature (456)..(473): n is a, c, g, or t
  misc_feature (482)..(530): n is a, c, g, or t
taatcannnnnnnnnnnnnnnnnnnnnggaatgaaaggggnnnnnnnnnnnnnnnnnnnnnnnnnnnnnnnnnnnnnnnnctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnaaacagnnnnnnnnnnnnnnnnnngtccaatcgaaaataaaaaatgggacccccaatggtggaataaaagtttataattggggtaacagcnnnnnnnnnnnnnnnnnnnntccctttttttaaaattttactgtgtttttgaatttaaaaannnnnnnnnnnnnnnnnngcgtgtggnnnnnnnnnnnnnnnnnnnnnnnnnnnnnnnnnnnnnnnnnnnnnnnnnccaaaagagaggcccccaacaaaaa

SEQ ID NO: 8767 - DNA, 669 bp, Diabrotica virgifera
gagaatggcaatatccgccgttccgccattattgccagtattttttgaacacctggaggatgacaaggatccggacattgcacttcctttcccggtctgagtccccatcggaacccacgtattatttcccctgcgcctcgagatctgctatgcatcatgagattccctacagacaatttcatcccgcttctcatcctccatccgctcctacccggccaaccggtctcgttgatgctccttttccccgaggcatatgaggtggaacccctcggtctgatgatgttttgttcggactcatgtgcttctgtgttcgcatgattattccaaccgggccgtgtcgccattgattgcaacgcgttctgatcaatcgacgacatcatgtttgggtgtccggtgatgctggtaacggtgagtcttttccaatcctgatctgatattctgtcttggacctctacacagtctcgttatcgctggctgaagactttccacattactcgtgcttaactgataacgctctgatccctatcttggaatcagggcttgaattgacctgcatattgataactagagtcttcagtcttcctgtgctgtctaacgaaaatattgaatttaggatacgcatcgaccattttcgtctatagattgtgtactatattagcaaggcctact

SEQ ID NO: 8768 - DNA, 252 bp, Diabrotica virgifera
gaagcccacccccatatggagactcatcaagcgcaaagcaggagattgccctcccgatgacgacgactgaggagtcctggctcctcctacctctctacgtgaaaagcaactgatgaaagagattattgctgaagtggtagatcaacgaccgggtgtgattaatttgtaattagtggcagttacaagaaaaggagtacatgacatttaaggtgcactttactgctaaaaaataaccaagttaaaagcaagaag

SEQ ID NO: 8769 - DNA, 578 bp, Diabrotica virgifera
  misc_feature (33)..(55): n is a, c, g, or t
gaaagctattagattatttatttcgcataatcnnnnnnnnnnnnnnnnnnnnnnngtaatgataaggctttctaatcttttagctttttaataaagttaggaaagactacatatttattggctctggtatgaggatgacctccgggcacatcacgccggtgtagataatcacataacaaattgtgaccgcgatgatcgaaatatgtttagggacttattgaaatgtttaagtgtactgttgtatatagagcgtcctgctgaaaccacctaccaagaccctcaggctgtgccagaatttttccattatgcctggccctacttcctgctgttcatgttaatcgaaataatagttttatatatggaaaatgagccgatatgtagacttattgatggactaaccagtatttctcatggcttaatacaacactccggaatattattatatagagtgcgtgagagtcattagtattatcacatacatcaacatctttgcctcataattcttccttggatcaattcgatgacatgggatttagcagcacgaggagtagactttggttactactggggccatatag

SEQ ID NO: 8770 - DNA, 200 bp, Diabrotica virgifera
  misc_feature (7)..(30): n is a, c, g, or t
  misc_feature (40)..(40): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (141)..(141): n is a, c, g, or t
  misc_feature (167)..(192): n is a, c, g, or t
taacagnnnnnnnnnnnnnnnnnnnnnnnntcgataatanagattgcgacctcgatgttggattanagtttataattggnnnnnnnnnnnnnnnnnnnnnnntgttcgannnnnnnnnnnnnnnnnnnnnnagttaaaccnggtgtgagccaggttggtttctatcnnnnnnnnnnnnnnnnnnnnnnnnnngaaaggac

SEQ ID NO: 8771 - DNA, 774 bp, Diabrotica virgifera
  misc_feature (10)..(11): n is a, c, g, or t
  misc_feature (34)..(35): n is a, c, g, or t
  misc_feature (40)..(40): n is a, c, g, or t
  misc_feature (42)..(43): n is a, c, g, or t
  misc_feature (52)..(54): n is a, c, g, or t
  misc_feature (70)..(70): n is a, c, g, or t
  misc_feature (76)..(77): n is a, c, g, or t
  misc_feature (505)..(521): n is a, c, g, or t
agggaaagcnntggtacgcctgggcaggtaccgnngtccngnngaattcccnnngggtcgcaccctacangcgtcnncggtcagcattcacgagaaaaagcttgtcgtcgctagacatagttcctcagtatctttaatttagaactgtaatgcctatgacactattagcttcaagatcattgaagagatagatgatctgtacttccgactatgagaagaggaggtatctaccgactctcacccgattatatggattatatcatgaaatcaaaatggtctcttctcacctcttcttcgacattcctttgtgaccgcatggacaccctaaatgctctcaaaatgtgccgtacaacttctcaggaggacaaatgcacaaatggatatagctgtgactgaaattctcactcctatccgacaagatatccttattggcaaacctatattcagatccgattgattcccccaccatggatatatctaggaagtactgaagctctaccccatnnnnnnnnnnnnnnnnnaacatgcttgatgatgtgacaggccgctcacgtgacaacgatcaccttgatgacctactcattggatacttagatgaaaaacgtgtctagatcttagatgctgacatcttatgagctctggctttacttgatgaaggcgacactgattgcaaactcgttgccattgatgaccacgatccgttggcagatgacatcattgtgattctcgacgaagaactgcatttcccaggtcttctgctcgcttctgtcgaat

SEQ ID NO: 8772 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8773 - DNA, 144 bp, Diabrotica virgifera
  misc_feature (2)..(139): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgg

SEQ ID NO: 8774 - DNA, 168 bp, Diabrotica virgifera
  misc_feature (8)..(167): n is a, c, g, or t
atgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 8775 - DNA, 1120 bp, Diabrotica virgifera
  misc_feature (107)..(128): n is a, c, g, or t
  misc_feature (187)..(207): n is a, c, g, or t
  misc_feature (225)..(252): n is a, c, g, or t
  misc_feature (594)..(613): n is a, c, g, or t
  misc_feature (628)..(645): n is a, c, g, or t
  misc_feature (882)..(900): n is a, c, g, or t
  misc_feature (970)..(988): n is a, c, g, or t
  misc_feature (1005)..(1024): n is a, c, g, or t
  misc_feature (1027)..(1042): n is a, c, g, or t
  misc_feature (1046)..(1074): n is a, c, g, or t
  misc_feature (1098)..(1115): n is a, c, g, or t
gtgattcttactattaacttgtacaaatacataatattgtttaaaataatcaagatttttaatctttcaaaacaatatggcggatatgcgcacgaagtaaaaaattnnnnnnnnnnnnnnnnnnnnnnctaaggtaactaaacctatcctaacccgaccaaatcttacttcaacctgctaacaaagnnnnnnnnnnnnnnnnnnnnnttattacgaataaaatgnnnnnnnnnnnnnnnnnnnnnnnnnnnncttattttgtataactatggcaacgctggttagactttgtgttagaaagtgatttcttgagtacatatgtgaaacggatgtcatttgtgtgatttcttgttgttttatggtgtataatggcggtggcttttaaaaataagacattttaaattgaaattacataaaaaagagcgttttccagacaataaaaagtattgtataataatcagtaactgaagcagaattcattgatataaatttcatatccgtagagattgtaccctcttactacactagtactctattttgaaataaactatggctttgaattttcaatttttggataatacatatgcaattgtnnnnnnnnnnnnnnnnnnnngagtaattcacgggnnnnnnnnnnnnnnnnnngtatgcatgcatcactacaagaagtgatatgtctgctatatactatcattgataatctaaactggtctaaactattctaatctcattttaaacttgttttatttggagttcaataatttttagatattggcaaggaacaaaaatgttattctgttttgaggggataatattaatttaaaaagcatattatttttcctcgaaatcaccttctccttattttggaaataaaaacctggnnnnnnnnnnnnnnnnnnncttttttatctccctcaactctttaaaacattaaaaggattggcccctccctggggggaccctttgttannnnnnnnnnnnnnnnnnnccttttttccaataatnnnnnnnnnnnnnnnnnnnnggnnnnnnnnnnnnnnnnttgnnnnnnnnnnnnnnnnnnnnnnnnnnnnncttaaaatccacattaattccctnnnnnnnnnnnnnnnnnngtgtt

SEQ ID NO: 8776 - DNA, 166 bp, Diabrotica virgifera
  misc_feature (4)..(153): n is a, c, g, or t
  misc_feature (155)..(155): n is a, c, g, or t
agcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantaattttttga

SEQ ID NO: 8777 - DNA, 1146 bp, Diabrotica virgifera
  misc_feature (2)..(50): n is a, c, g, or t
  misc_feature (52)..(657): n is a, c, g, or t
  misc_feature (666)..(666): n is a, c, g, or t
  misc_feature (671)..(728): n is a, c, g, or t
  misc_feature (733)..(733): n is a, c, g, or t
  misc_feature (761)..(830): n is a, c, g, or t
  misc_feature (835)..(887): n is a, c, g, or t
  misc_feature (932)..(948): n is a, c, g, or t
  misc_feature (951)..(968): n is a, c, g, or t
  misc_feature (995)..(1026): n is a, c, g, or t
  misc_feature (1091)..(1131): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgganagggnnnnnnnnnnnnnnnnnnnnnnnnnnnnnnnnnnnnnnnnnnnnnnnnnnnnnnnnnngcttnaattttttttaaagacgagagaccccannnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnccccccttttttggtaaaagaaaaaattccctttgagaacaccgnnnnnnnnnnnnnnnnnccnnnnnnnnnnnnnnnnnncccccccccggggggtgtaaatgttannnnnnnnnnnnnnnnnnnnnnnnnnnnnnnncgcccccctttttaaatttttttggccggggggggtaacacccgggggggggcccccgggggtgnnnnnnnnnnnnnnnnnnnnnnnnnnnnnnnnnnnnnnnnnagcggggccccccac

SEQ ID NO: 8778 - DNA, 83 bp, Diabrotica virgifera
  misc_feature (4)..(52): n is a, c, g, or t
  misc_feature (56)..(77): n is a, c, g, or t
gggnnnnnnnnnnnnnnnnnnnnnnnnnnnnnnnnnnnnnnnnnnnnnnnnnttannnnnnnnnnnnnnnnnnnnnncgagaa

SEQ ID NO: 8779 - DNA, 148 bp, Diabrotica virgifera
  misc_feature (2)..(39): n is a, c, g, or t
  misc_feature (41)..(41): n is a, c, g, or t
  misc_feature (43)..(43): n is a, c, g, or t
  misc_feature (45)..(71): n is a, c, g, or t
  misc_feature (85)..(85): n is a, c, g, or t
gnnnnnnnnnnnnnnnnnnnnnnnnnnnnnnnnnnnnnntnantnnnnnnnnnnnnnnnnnnnnnnnnnnngaataattacctanggatacagcgtaatttattggagagtcaatcgataataagatgcgactcgatgttggataaag

SEQ ID NO: 8780 - DNA, 942 bp, Diabrotica virgifera
  misc_feature (98)..(116): n is a, c, g, or t
  misc_feature (189)..(261): n is a, c, g, or t
  misc_feature (737)..(737): n is a, c, g, or t
  misc_feature (799)..(799): n is a, c, g, or t
  misc_feature (849)..(849): n is a, c, g, or t
  misc_feature (863)..(863): n is a, c, g, or t
  misc_feature (875)..(875): n is a, c, g, or t
  misc_feature (888)..(888): n is a, c, g, or t
ccaaaagatgtatttataaaccaaaatggttttgaagaaagctagcaaatattttatgaagcttggtgtagcaaaaagaagagtttcccaagtatctnnnnnnnnnnnnnnnnnnngtgtagtaggtttagaagtacatgctcaaattaattcagctagtaaactattctctggagcttccacaaaatnnnnnnnnnnnnnnnnnnnnnnnnnnnnnnnnnnnnnnnnnnnnnnnnnnnnnnnnnnnnnnnnnnnnnnnnngagatgtgtggaagctggggtacttacagcattaagtttaaattgtaaagtcaatccgatttcatattttgataggaagcactatttctatgccgatttacctactggttatcaaataactcaacaaaggcaacctctagcagtaggaggtcatttagaatttcaagtatttactccaggtgttcataaagctccttatactactaatgttaaaataaaacaactacagctagaacaggacagtgggaagagtcttcatgatgaacaaaggagttttgttgatttgaatagagcaggtgtacctctcatggaactcgtattcgatccagatcttaaagatggtgaagaggctgctgctctggtcaaagaactgatttcaattttacaaaggatacagacatgttcctgtaaaatggaagagggagccttgagagtggatgccaacgtttcgatacacaaagaatccgaaccattgngaacaagaacagagataaaaaatattgggtcagtgagaggagtagctggagcaatagttatngaatacaagacagataaagctgaaagaagctggtcaaactattgctaacngaacgagagcttgngatgcttctacnaagactacagtgncaatgagagataaagaagtacaacaggattataggtatatgcctgaacccaaat

SEQ ID NO: 8781 - DNA, 242 bp, Diabrotica virgifera
  misc_feature (2)..(171): n is a, c, g, or t
  misc_feature (173)..(236): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnttgggg

SEQ ID NO: 8782 - DNA, 636 bp, Diabrotica virgifera
  misc_feature (309)..(324): n is a, c, g, or t
  misc_feature (326)..(347): n is a, c, g, or t
  misc_feature (349)..(371): n is a, c, g, or t
  misc_feature (390)..(413): n is a, c, g, or t
  misc_feature (420)..(518): n is a, c, g, or t
  misc_feature (523)..(543): n is a, c, g, or t
  misc_feature (548)..(548): n is a, c, g, or t
ctctaatgggtcattccacgttagagcaacttaatttaggatacaatcaattgcaaatgatagacaaagaggcatttataggtatgcctgctttaagagaccttattctgaccaacaattctattgcagatacacgaagggctccgttttggaatctgcctgctttgaaagcgtgcatcttgtctaagattatttgagaaggttagaactaaggttttaataacctaagggcactgaaaggaatgaactgatacacattggtataaatttataaaaccaaaagaatttccttatactcctttattaacnnnnnnnnnnnnnnnngnnnnnnnnnnnnnnnnnnnnnngnnnnnnnnnnnnnnnnnnnnnnnttattatattctacctacnnnnnnnnnnnnnnnnnnnnnnnngattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgnnnnnnnnnnnnnnnnnnnnnctccnaaaattgcatattaagtctccctatataggtttaatactcgaatttgggaacattgttttcacctgtctctccctacgtgtctttttg

SEQ ID NO: 8783 - DNA, 308 bp, Diabrotica virgifera
  misc_feature (4)..(5): n is a, c, g, or t
  misc_feature (12)..(12): n is a, c, g, or t
  misc_feature (19)..(19): n is a, c, g, or t
  misc_feature (25)..(25): n is a, c, g, or t
  misc_feature (28)..(29): n is a, c, g, or t
  misc_feature (35)..(71): n is a, c, g, or t
  misc_feature (73)..(73): n is a, c, g, or t
  misc_feature (118)..(118): n is a, c, g, or t
  misc_feature (244)..(303): n is a, c, g, or t
attnnattatantataaanttattntanntggggnnnnnnnnnnnnnnnnnnnnnnnnnnnnnnnnnnnnnantataaatttttgatccattttttggatatagaataaataccttanggatacagcggattttattggggaggtcaatcgatataagatgcggacccaggtgggataaagttttaattggggagcagttattattaattctgtcggctttaaattttcttgttggaggtaacnnnnnnnnnnnnnnnnnnnnnnnnnnnnnnnnnnnnnnnnnnnnnnnnnnnnnnnnnnnncgccg

SEQ ID NO: 8784 - DNA, 820 bp, Diabrotica virgifera
  misc_feature (87)..(107): n is a, c, g, or t
  misc_feature (143)..(228): n is a, c, g, or t
  misc_feature (230)..(260): n is a, c, g, or t
  misc_feature (262)..(325): n is a, c, g, or t
  misc_feature (327)..(512): n is a, c, g, or t
  misc_feature (514)..(547): n is a, c, g, or t
  misc_feature (562)..(598): n is a, c, g, or t
  misc_feature (603)..(615): n is a, c, g, or t
  misc_feature (617)..(635): n is a, c, g, or t
  misc_feature (664)..(694): n is a, c, g, or t
  misc_feature (696)..(708): n is a, c, g, or t
  misc_feature (726)..(746): n is a, c, g, or t
  misc_feature (764)..(815): n is a, c, g, or t
gaagagtttcctcagtattagcttcggacttttcctgtttttaggaatagaatcaaagtcattagatgacaatattgtattgaagcnnnnnnnnnnnnnnnnnnnnnagaaaactttatctcttttgtacctatatgtatcgnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncattaaaaaattgcnnnnnnnnnnnnnnnnnnnnnnnnnnnnnnnnnnnnnacgcnnnnnnnnnnnnncnnnnnnnnnnnnnnnnnnncctctttgcattaaaatataaagcctccnnnnnnnnnnnnnnnnnnnnnnnnnnnnnnngnnnnnnnnnnnnnctaaggcaccaaaatccnnnnnnnnnnnnnnnnnnnnngtgggaaatgaacggttnnnnnnnnnnnnnnnnnnnnnnnnnnnnnnnnnnnnnnnnnnnnnnnnnnnncttaa

SEQ ID NO: 8785 - DNA, 803 bp, Diabrotica virgifera
  misc_feature (668)..(680): n is a, c, g, or t
  misc_feature (682)..(697): n is a, c, g, or t
  misc_feature (720)..(760): n is a, c, g, or t
  misc_feature (775)..(802): n is a, c, g, or t
ctaattcaaattcgtgtttattacatgataggatagtatcttattatattttgacaatcttacttttattataatgataggataatatatttatatgagctagaaaatgatatttttataacagatatgtgatattttgtacctcgacgtatcaagtattcatatatttcatgactatatgtttataattcccgaattgagctaacgttattgaataaactattcctagcccaatagatatttcagataatgtgtccgagatgcaatgatctgcattttcaattagatcaaaaatattgatacataaaaaaactttcctcattgatgtatttatattatcatgacgatatatgatatgttattaacagaagatatatatacgggtgagatcagatgtaacatttaattggaattgaactgtgaaatagatctaatccacattcatatgcaaatccatccttacgatgttatcttatatcttacatatgattatcttgtagttggaatagatctactcttaactgatatgataagagctattcagattgtacccaatgatagagaagatcatgatcacatagttgtatatatagtgagagtatatacgagtgatagaggaattgctgcacatattgttgctctgcttattacaaacatgactttctgcnnnnnnnnnnnnncnnnnnnnnnnnnnnnngttatttgaatggccgcggaatnnnnnnnnnnnnnnnnnnnnnnnnnnnnnnnnnnnnnnnnntggaaagctggaatnnnnnnnnnnnnnnnnnnnnnnnnnnnnc

SEQ ID NO: 8786 - DNA, 848 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (777)..(777): n is a, c, g, or t
  misc_feature (783)..(795): n is a, c, g, or t
  misc_feature (798)..(844): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttanaatatnnnnnnnnnnnnnccnnnnnnnnnnnnnnnnnnnnnnnnnnnnnnnnnnnnnnnnnnnnnnnctca

SEQ ID NO: 8787 - DNA, 143 bp, Diabrotica virgifera
  misc_feature (9)..(75): n is a, c, g, or t
  misc_feature (82)..(139): n is a, c, g, or t
attatttannnnnnnnnnnnnnnnnnnnnnnnnnnnnnnnnnnnnnnnnnnnnnnnnnnnnnnnnnnnnnnnnnnagggatnnnnnnnnnnnnnnnnnnnnnnnnnnnnnnnnnnnnnnnnnnnnnnnnnnnnnnnnnngtct

SEQ ID NO: 8788 - DNA, 907 bp, Diabrotica virgifera
  misc_feature (871)..(871): n is a, c, g, or t
cccacgcgtccgtaaataatagacgttaagtaatattctgttttggtttttggagaaatttcatgaggaataatgaaagtgacggtactgcagatagttgtatcagctctactgattgcaagtacgaaatgtcttcaacaagattcaataccaaataaaatttctcctgaagacgttaattttttggtagaaccgataccagaagcaaaacatgattcaccaccaccattttcttttgttaacaccgtcaaagaagttgagaatatgataatatcaaatccgaaacttccaagactaacaagaggcgaaataatcgatttgctggaaaatattacaaaagccgataacacttttacaattctgcaacaggcttccctgattccagaaaatcatagagcacctaaagctgttatgaaagtgttgccaataacgccagatgcagcaaatacaaataacgtggaagaactgtataccaaacgacctgtgacgcaaattgtcgattataatcatattggacaaggaagcgatgatagtgtttttatggacttcgatgtgcccaaggtgcagtttgatcctgttccagcaaatgaagagtacaagccaataactgtggaagaaaatttcaatggcaatccatttaacgtacctaaccctacgtataaaagaaaaacaaccacatctactactacaacttctactactgctgctaccacttcagatcctaccagacactactttgtagaacgaaaacctcaaggtcttagaaggaaaacgacgacaactactgcaacaactgtcagcccttcagtcagcacccacagacaaagaagtaggaaacctatgagacacagaactactacccgcaccacancacgtcatcccaatcataggtacgaagatgaacatg

SEQ ID NO: 8789 - DNA, 134 bp, Diabrotica virgifera
  misc_feature (3)..(26): n is a, c, g, or t
  misc_feature (29)..(94): n is a, c, g, or t
  misc_feature (98)..(132): n is a, c, g, or t
tgnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnttannnnnnnnnnnnnnnnnnnnnnnnnnnnnnnnnnngc

SEQ ID NO: 8790 - DNA, 765 bp, Diabrotica virgifera
  misc_feature (2)..(44): n is a, c, g, or t
  misc_feature (52)..(165): n is a, c, g, or t
  misc_feature (176)..(732): n is a, c, g, or t
  misc_feature (735)..(751): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnncgagagaccctata

SEQ ID NO: 8791 - DNA, 853 bp, Diabrotica virgifera
  misc_feature (787)..(787): n is a, c, g, or t
  misc_feature (832)..(833): n is a, c, g, or t
gtagtgctcctgtagctgtggtctcaaaccttaagttggttaaagagaacgagctggatttatacctaaagggtgctgtttggtccctagatggcaaggaagaagtagtgggtagtgacagtataagtattggagtgaaaaaagatttgcggtgtgcgcagtgtccatatagaactattaaagtaaaagatatagaaaacttggaatgtattaaatgtcctgttaatagtggagaaccttcatcaaaaaaacctaaactggatgacattccgactgaattattaaaaaatgatccacatgacaagtgcccaattcagttacctgtaggttcggactttatgggtaaatgtccctatctagaaaacaaactagcaacgtcggaaggttttgaaccaactgaagtggaatacgcaaagtgtccatttctccaaggagaaattatgaaatattccgaaaataatgctttggaacaatcgacttctgatgataagaatttattttgtgggttagtcattcacaaagatgctacttatgagggaatgttaacagcgaaaaagttaggagaaaagttagccaataatttaatagcaaaaggagcattggaagttatgtctaaagctcaagcaattatacacaatcaacagtcagttccaccagtaacttccagttagttgttttgttgctaatataatttatagtgtgctacacaaagtaagcggaatacttttttgaggtgcggtaattgtaccgaggaaaatgcttatctgcatagctaatttctcaaaanaaagaacggtccactaattttgtggagcactgtaggtaggactannacgtgtttttttattgggct

SEQ ID NO: 8792 - DNA, 623 bp, Diabrotica virgifera
  misc_feature (90)..(111): n is a, c, g, or t
gggagaattcaaaaatttggtagtaagatattcatacattttctacttcctacccctccccattttgtaaaggttcacgttttctcaccnnnnnnnnnnnnnnnnnnnnnnctagggagatcatattttgagatgggtactccaaatgagaacgaaaatgatagattccaatattataacaccttcgagttgttatattgataaaaaaatgctggaagagctggacaatcataaaatgatcattcattatggatattgtatatataaagctacttaaaccataatactcaattaaatccacgtttgtatataatttattctttaaaagatctaattataagaaatccaatatcttactaccaaatttttgaattctccctaaactaaccttccccgctaaagtaaacgtattgtaccctattattgacacgataaaattgtagcaataatatccattctaaattacttttatttatgcatttaaatgtttgtaaaacaattattgtaattactagattattttatctttccagcatcaaatgctggatcatttagcggacataccatatcagtaattaatacttaatttaaattacttagtaattcagtataaagatagtttc

SEQ ID NO: 8793 - DNA, 144 bp, Diabrotica virgifera
gaaaataaaacacttatgaaaggaaaattattatagaataattattactcattaataatttagttgtcctgcgctgttggtcagtttttaaatttttcttgtttcataactaccttatataatcgctttagcaacaaaatgata

SEQ ID NO: 8794 - DNA, 846 bp, Diabrotica virgifera
  misc_feature (55)..(71): n is a, c, g, or t
  misc_feature (73)..(94): n is a, c, g, or t
  misc_feature (108)..(140): n is a, c, g, or t
  misc_feature (154)..(176): n is a, c, g, or t
  misc_feature (188)..(224): n is a, c, g, or t
  misc_feature (255)..(314): n is a, c, g, or t
  misc_feature (318)..(352): n is a, c, g, or t
  misc_feature (376)..(573): n is a, c, g, or t
  misc_feature (583)..(607): n is a, c, g, or t
  misc_feature (667)..(691): n is a, c, g, or t
  misc_feature (760)..(785): n is a, c, g, or t
  misc_feature (787)..(787): n is a, c, g, or t
  misc_feature (798)..(798): n is a, c, g, or t
  misc_feature (821)..(823): n is a, c, g, or t
tcctatagggaagtggtacgcctgaggaccgccggattccgggcgacccgcgtcnnnnnnnnnnnnnnnnngnnnnnnnnnnnnnnnnnnnnnngtataatatattgnnnnnnnnnnnnnnnnnnnnnnnnnnnnnnnnngacctggatcgggnnnnnnnnnnnnnnnnnnnnnnncaattaaagagnnnnnnnnnnnnnnnnnnnnnnnnnnnnnnnnnnnnnatgaagtattcgtttatattctatttttagnnnnnnnnnnnnnnnnnnnnnnnnnnnnnnnnnnnnnnnnnnnnnnnnnnnnnnnnnnnntggnnnnnnnnnnnnnnnnnnnnnnnnnnnnnnnnnnngataaaattttctatttaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagtctcnnnnnnnnnnnnnnnnnnnnnnnnngcggtatttgaccgtgctaggtacataatcttagttttttttgaagtggatgagggttgnnnnnnnnnnnnnnnnnnnnnnnnngatttattttagtaaaagctaatttttaaaacagagacctataagttttaaattattatagtttttagnnnnnnnnnnnnnnnnnnnnnnnnnngngtgataaaatnaattactttttatatatatatannntatatttttgatccatttttttg

SEQ ID NO: 8795 - DNA, 75 bp, Diabrotica virgifera
  misc_feature (6)..(66): n is a, c, g, or t
ggggtnnnnnnnnnnnnnnnnnnnnnnnnnnnnnnnnnnnnnnnnnnnnnnnnnnnnnnnnnnnnncaatttttt

SEQ ID NO: 8796 - DNA, 885 bp, Diabrotica virgifera
  misc_feature (503)..(520): n is a, c, g, or t
  misc_feature (696)..(696): n is a, c, g, or t
  misc_feature (791)..(791): n is a, c, g, or t
  misc_feature (838)..(862): n is a, c, g, or t
  misc_feature (869)..(869): n is a, c, g, or t
aaaactaaagcaaaagcgatagcggttgttgcctcacctggtgaatcgtggtacaaacagaaatgtgagagttttaggttacgttctattttatagtaaatagtttattccgtccattagtttagtgcttaaagtgtaaaaataatctgccaaaatgactatgcaacagccttccgactattacgatcgcgaaaataacagatttattaggagagtgtaccagaaaaagcagggacttatattgggcagaaagggtccagaattagccaaaattggtctcttttacttaatcttctatggaatgttagcagctttggtagcagtatgcatgtgggtatttttccagactcttgatcctagaataccgaagtggcagctagatgaatcactaataggtaccaatccgggtttgggtttccgtcctatgcctgagaaaaacgaagaaagtacgttaatatggttccagggctccaacaagacgagctattcttactgggtcgagnnnnnnnnnnnnnnnnnngataagtactacgttcccagcaaaatagctaaaggaaatggccaaattaaaacatgctctcatcacgactatcctactagtggagaagtatgcgaagtcgatgtcagagattgggaagaatgcaacagggatcaattctttaattatcacaagaattctccatgtatttttattanattgaacaaaatatataactgggagccaatgtattacgatgatccatacgatttacctgaggaaatgccggataatctgaagcaacatataaggngtatcacaatactagagagttgagaaaacgtttgggtctcatgtcannnnnnnnnnnnnnnnnnnnnnnnntacttgngccccattacatacta

SEQ ID NO: 8797 - DNA, 607 bp, Diabrotica virgifera
  misc_feature (241)..(260): n is a, c, g, or t
  misc_feature (355)..(373): n is a, c, g, or t
  misc_feature (433)..(460): n is a, c, g, or t
  misc_feature (543)..(589): n is a, c, g, or t
  misc_feature (591)..(606): n is a, c, g, or t
cccacgcgtccgatttctattggtttgacagttgcttatagatttcgtttatataattaaatctacccgttaaagaataataagttaaacgggtagatttaattatctagctttaaatatattatctgaaactggttatttaatacttaagggtataagaggattaattttatttgtagtttttagtggaagattattttcttgattagtattttctactcctatttttatttgtcttccnnnnnnnnnnnnnnnnnnnnctttgatttttattatagttggagtttgattaggttatgagttagctaaatttaaaatttcttataatttattaaggttaaataatatttctagnnnnnnnnnnnnnnnnnnnatatgaaatataccttttttatctactttaggaattaattattatccaatttattttggnnnnnnnnnnnnnnnnnnnnnnnnnnnnggatgatttgaatattatggaagttcaggtgtaataaaacaattaaataatagaatatttttacagttattttctcttaatcnnnnnnnnnnnnnnnnnnnnnnnnnnnnnnnnnnnnnnnnnnnnnnncnnnnnnnnnnnnnnnnc

SEQ ID NO: 8798 - DNA, 732 bp, Diabrotica virgifera
  misc_feature (2)..(679): n is a, c, g, or t
  misc_feature (684)..(725): n is a, c, g, or t
  misc_feature (728)..(728): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcnnnnnnnnnnnnnnnnnnnnnnnnnnnnnnnnnnnnnnnnnntanatta

SEQ ID NO: 8799 - DNA, 938 bp, Diabrotica virgifera
  misc_feature (456)..(475): n is a, c, g, or t
  misc_feature (522)..(541): n is a, c, g, or t
  misc_feature (858)..(858): n is a, c, g, or t
caacggaaaacgtgacagaaatatatctagtgaataaaaggacaagttttgcaaagtttttatcgtataattttatggtttaccaattgtaatactaccccaataacgcaatggcatctatgagcagggaggaattaataaacagtatctattactcggacaaatactatgatgatgtgtttgaatataggcatgttgtacttcccaaagaaatggttagcgtagtacccaaaactcatttaatgtctgaagatgaatggcgaggtattggagttcaacaaagtaaaggatgggtgcattatatgattcatttaccagaacctcatattcttcttttcaagagacctataacaacacctccgccctcccaataagaaataagtcaaattttgtacaaacccattccctatttttaagttttcggatagtttattacagtaaaataccttcatctgnnnnnnnnnnnnnnnnnnnntgaaagtactaaaagaaaattaaatagtttttgattattcttgtagnnnnnnnnnnnnnnnnnnnntgtttgagtgctgaagagtaaagatatttaaatagaataacatgaattctaaacacaaaatggtgaagtctacatatgttagtaataactatattgtttcatctcacatattgcatgaagagttcctgcctgtgtcatatttttaatataaatgtcaaaggagctgtgaaacatattgttttttatgtcttcatataatatatctacaaaatactctatggtctttacgtagggaatttgtactcagtacttcatacaattttgaaaagtaatttgattcattatttgtatagaatagaattaattatcacatatangcaaattttggtatcgaatttgaaactcttaatttggttttgacaaattataggaaataacaaaaactgtacaatttgct

SEQ ID NO: 8800 - DNA, 433 bp, Diabrotica virgifera
  misc_feature (2)..(95): n is a, c, g, or t
  misc_feature (97)..(113): n is a, c, g, or t
  misc_feature (115)..(133): n is a, c, g, or t
  misc_feature (135)..(179): n is a, c, g, or t
  misc_feature (181)..(193): n is a, c, g, or t
  misc_feature (227)..(239): n is a, c, g, or t
  misc_feature (241)..(260): n is a, c, g, or t
  misc_feature (276)..(325): n is a, c, g, or t
  misc_feature (345)..(370): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnngnnnnnnnnnnnnnnnnnnntnnnnnnnnnnnnnnnnnnnnnnnnnnnnnnnnnnnnnnnnnnnnngnnnnnnnnnnnnnctagggagcataatcttagtttttttatgaaacnnnnnnnnnnnnngnnnnnnnnnnnnnnnnnnnnctttatttagtttatnnnnnnnnnnnnnnnnnnnnnnnnnnnnnnnnnnnnnnnnnnnnnnnnnncgaacaaaaaccctactaannnnnnnnnnnnnnnnnnnnnnnnnnggtcttttttaggatctaaatttaatttataatccaaaaattctattttatttgggcgggagt

SEQ ID NO: 8801 - DNA, 657 bp, Diabrotica virgifera
  misc_feature (113)..(138): n is a, c, g, or t
  misc_feature (145)..(181): n is a, c, g, or t
  misc_feature (183)..(195): n is a, c, g, or t
  misc_feature (197)..(212): n is a, c, g, or t
  misc_feature (214)..(243): n is a, c, g, or t
  misc_feature (249)..(287): n is a, c, g, or t
  misc_feature (331)..(348): n is a, c, g, or t
  misc_feature (480)..(498): n is a, c, g, or t
ggaaagctgggacgcccgccgggacccggcccggaattccccggccgcccccccctcccgccccgcatttatatttgatatactgaaatatttcttagtaaacgtcaagaacnnnnnnnnnnnnnnnnnnnnnnnnnngattggnnnnnnnnnnnnnnnnnnnnnnnnnnnnnnnnnnnnncnnnnnnnnnnnnncnnnnnnnnnnnnnnnncnnnnnnnnnnnnnnnnnnnnnnnnnnnnnncaaacnnnnnnnnnnnnnnnnnnnnnnnnnnnnnnnnnnnnnnnctacatagtctttttgtagtgaaatgctcttcccttttacatcnnnnnnnnnnnnnnnnnngtaaatcacattcatttattacccacatatttatccttacctatttttatattatgaacattaaatattcttaggcatgagcttacaaacaaaatttgtatcactatcgactttttgaataaccattacgcnnnnnnnnnnnnnnnnnnncaactatgctattactcatgtttagatattattatttggatcttttatagattatttattatcatatacacctgaggttatctaaatttagtgatgatgataagattaccattcagaaattgcatatttaggaaaaatatctagccttaataaaggact

SEQ ID NO: 8802 - DNA, 429 bp, Diabrotica virgifera
accatgtggatcaaggagagataaccaaacactatgttctgttagtattcatatcgaaataaataatgaaatgcatatttgcttacaacaagaaatatgcgtaattaactgatcggaacaggaatttggtacgccagtcatatacaactagtctaactactattaaaatgacatgatataatgagatatcaagatattaaaatctgtatataataatagtacgaaatattgaggggtataattacaatttatagctgaattgatttaatgtttaagtaaaaaagacgagatataatatagcatatgtaaaaacatgccatgtataaatatcaaaagtcgacaatgttgataatataaaaattcccgatatgatgtatagatttagaatttttgtatagattggagataattataatattattaaacacc

SEQ ID NO: 8803 - DNA, 868 bp, Diabrotica virgifera
  misc_feature (798)..(798): n is a, c, g, or t
gccagtagctactgggattttcccagtgattttgctattctttttactgttgacacagttgacacattagaaacggttgcaatcttaaaagcactatcagaattcaaaattgaccacaggtatgcgaatattattcgaaaaatatacgaaaatgcgacaacaactataagccatcattgcatgacggagaacacaaaaataggcagagaagtgcgacagggagatactgtatcgccaaaattattcatatcagtcatggagtacatatttcaacgattagagtgtgattcaaaaggtattgacatcgatggaaatctgttaaatcttctccgatggcattcttcttctaacagacgacttaaaagaagccagagttatgctagtacaactacagcaagtaacacagagggtcggtttaaaaataaactatcgaaaaacaaaaatgatgaccaatctcgtccccaatgatctaacagacattaagaaatcgcccatacaacttgtgtatttggatattcatatgtgtatttggatcacaaaaacgtgggattaacaatcatgttaattattgagaaaaataaagggttgggctgcattcagaaaaatgggagatgtgtttaaaacaaatatcccaatcaatttaaaaagaaaagctttcaaccagtgcgttctattatttcccatatgcggagcagaaaacttagctcacaaaaaaacatcgtaaaaagacattgcaaaattgtaaaggacacaatgtaaaatatagagatgaattgaagcgttcagagcaacagtggnctaactccaaaaaagaagttttgagataaatgcaacctttgcatgcgtatttccgttgtgcttatgggga

SEQ ID NO: 8804 - DNA, 75 bp, Diabrotica virgifera
gaaaccaacctggttcacaccggtataaaatcatattttgatttagataaataggagagaaaaaataatagggta

SEQ ID NO: 8805 - DNA, 84 bp, Diabrotica virgifera
  misc_feature (14)..(65): n is a, c, g, or t
ctacattatttacnnnnnnnnnnnnnnnnnnnnnnnnnnnnnnnnnnnnnnnnnnnnnnnnnnnnatatagggttaataaaggg

SEQ ID NO: 8806 - DNA, 112 bp, Diabrotica virgifera
  misc_feature (6)..(92): n is a, c, g, or t
  misc_feature (96)..(98): n is a, c, g, or t
  misc_feature (110)..(110): n is a, c, g, or t
ttagtnnnnnnnnnnnnnnnnnnnnnnnnnnnnnnnnnnnnnnnnnnnnnnnnnnnnnnnnnnnnnnnnnnnnnnnnnnnnnnnnnnnnnnntatnnnattatttattgngg

SEQ ID NO: 8807 - DNA, 122 bp, Diabrotica virgifera
gattgcttctgtatctataatatcataccttaagattttttagtaaaagtagataaatttttctttattgatagctgattagaaccgtgatgagatattttatttttatagtagtgacattt

SEQ ID NO: 8808 - DNA, 536 bp, Diabrotica virgifera
  misc_feature (37)..(56): n is a, c, g, or t
  misc_feature (305)..(323): n is a, c, g, or t
gtttttaaaatgaattgagaattacttttttcttacnnnnnnnnnnnnnnnnnnnncagtatccgtatttacctaaataatagattatatagttaatactgagatttaattatttaccaaatacgttatttaaataatcaattgtttaagtaagagaaacaggtggttgtctttgccacctcattgaatatgtatcttgaacctgatcctgaaattaaaagaaatgttattcacaacctgaaccaagaatatggtaaagctttactagatgttaacaaatgcctagaacttcggaataaactatnnnnnnnnnnnnnnnnnnnagaagaacagttagatatttccaattcaaagtttacaatcggtgccagcataaaagaaggtgaagtgtttcttcaaaatactgcagatgtagtaaataggtcgaaagatgtggtgtctgatataaagactgtcttataagaaataccagaagtttgaatagatatgaagatttttcttgataactggatccccttacaatgtacgctaagata

SEQ ID NO: 8809 - DNA, 311 bp, Diabrotica virgifera
ctatctaataacgcgatatttaagttttacccttcgtttaattaccattttaacttctttccggttggagtccagaaaaagtaacaatgccagttgaacgctgcagcaacaattaactatcaggttgtcatatgaagaaggcgaggcgcgaccagagaaacagggaccgccaccggacggcgaatctgctatccatatagctggtagtcgatgaggccgcatcttccccgatcctcgctggattcgctgccgtccattcggggaaaaagcgacgtgatctctaatccgatagacccgattgactaagcagc

SEQ ID NO: 8810 - DNA, 444 bp, Diabrotica virgifera
ggcccaccccccaaggagagtatgttttaccttttgggcatagcgcagtagcgaaagatttactgagagtcgggattcgcagaagttcgatttaagaatgaaatgcatttctttcgagtacccgtatatagtgagtgtctcacacttctatggacttgttgagtaaaaatctgttttcatattgatatgcatatctacttacatgagaaatatcggataaccatgaatcgtgatagtgtttggtagctctgttttgcagctagactagctaatttgagaatgatacttatattatgtattatgattatttattaggctgaaggtattgaaggtgcatattattggggccttaagttagattctttcggtggacttgtttcttgctagtgctaatttgcctagatcttatacggttatgtatgctctccccattgttaatatcac

SEQ ID NO: 8811 - DNA, 478 bp, Diabrotica virgifera
  misc_feature (90)..(108): n is a, c, g, or t
  misc_feature (303)..(322): n is a, c, g, or t
  misc_feature (324)..(337): n is a, c, g, or t
  misc_feature (339)..(351): n is a, c, g, or t
  misc_feature (382)..(409): n is a, c, g, or t
tcaagaactgagaaggaacaatggtttcaagacttgtgttagcgttggtatttcttataattttcgttgatgcagaatatgctatcatcnnnnnnnnnnnnnnnnnnngtattgcaccttatggatcttggagcgatcaggatatactaatatcatgctctgtttcgattatcatcgatttaaaaaaagataagcttttctgcttaataaagatacatgatattttatttacttggaatagtgttgtcatgttactctatatctaaatattttaaaaactataagaaatacattatataacgnnnnnnnnnnnnnnnnnnnncnnnnnnnnnnnnnncnnnnnnnnnnnnnggcgattaagcacgaacttaatgttgttatnnnnnnnnnnnnnnnnnnnnnnnnnnnnaaataatacgcatatgtaaaaatatgccattataaatattaatatatcttagatgttaattttataaaa

SEQ ID NO: 8812 - DNA, 460 bp, Diabrotica virgifera
tttatttattttatagtaataagagatttccctttaatactaccaataaatacgcatacatcatgagaaagtgttagagtacttacgtaactcatcctgtataagatacctaataattaacattgactcagacgaccgcctatacgtaaaccacagagcaccagagctacgggcggtatggtaggacctggaggataccgcgtagaaggaggtaacggtggatatggaggatatggaagcacagaggagtgggaagctataccattttatctatttttcgctatcctcgataatgtacccggtgaaaaatgatgaacagacgaagagataactcaaacaagaaagagaccgtggaaggaatagcggaaggtgctcaaccaccactatcctcgcgactccgagaggtatcgggatcgtatctgaatttatacgaatccattgctcacatgttcaccaacaa

SEQ ID NO: 8813 - DNA, 821 bp, Diabrotica virgifera
  misc_feature (2)..(44): n is a, c, g, or t
  misc_feature (52)..(783): n is a, c, g, or t
  misc_feature (786)..(817): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnnntata

SEQ ID NO: 8814 - DNA, 408 bp, Diabrotica virgifera
  misc_feature (80)..(101): n is a, c, g, or t
  misc_feature (152)..(170): n is a, c, g, or t
  misc_feature (241)..(259): n is a, c, g, or t
  misc_feature (266)..(284): n is a, c, g, or t
  misc_feature (286)..(300): n is a, c, g, or t
  misc_feature (372)..(394): n is a, c, g, or t
ataatggaataatttattatttgtaccttctttttcgtaccttgtggatcagggattattaattgatatgtacatattgnnnnnnnnnnnnnnnnnnnnnngttaaaaatatcgtcttatattggaaaataagtattttatagaaattttannnnnnnnnnnnnnnnnnnattcgagatatatctaatattttaagaaatacattatgttcattgattaactaattatttatcattatatnnnnnnnnnnnnnnnnnnntgaatgnnnnnnnnnnnnnnnnnnngnnnnnnnnnnnnnnngaaagtaatttttaaatacgaattacgataaaaaatgttacgtattttagtatatgttattatatattctgnnnnnnnnnnnnnnnnnnnnnnnctaaatgttatatg

SEQ ID NO: 8815 - DNA, 377 bp, Diabrotica virgifera
ctagttctagatcgacaagttgttcaacacgacaacactaacaaatatttgtacatatttttgaaaatctttaaattacttatattacacatcatgtttaaatttctaataattagtattgtcgtgacaattgtatacggtaaaccaggtggtttgggttacggaggatatggtggatctggaggatacggtggatatggaggatacggtggatatggaggatatggaggatatggtggatatggaggacacggaggacacgggggatatggaggatatggaggatatgtatgtaattgttgttataggtgtaaacaataaaagctaacactaaaaaaatagaatgaaggaaaagagtaaaaatgaataaagacgta

SEQ ID NO: 8816 - DNA, 516 bp, Diabrotica virgifera
  misc_feature (93)..(119): n is a, c, g, or t
cccacgcgtccgtattcatccaataagcaggctatagcgggagccatggatagttatgtttaatgatagggaatataagaaagggtgaaaatnnnnnnnnnnnnnnnnnnnnnnnnnnnttcttggcacctggagaatccagcatcgaaaatcaccaactatagacctattatcgtctcattacacagacgtagcaaatcagaatttgtattgaacaatagataatttaaatagtttttttgcaactggaaagccattcgctattcaaaacatgggagtgtttatgaagtaaagtagattcatttatttctcacatttttagactaacctatgattatatgatgaacatgtaatattcttgaagcatgagctgacacaacatcatatgtattatcactcggatgttgaataaacaagaacgagtgaaaagcttcatatgttccactatgctattacttatgcatagatgtaaataattgtattctcttatcgacgaattgtcatccatatactatg

SEQ ID NO: 8817 - DNA, 195 bp, Diabrotica virgifera
  misc_feature (39)..(161): n is a, c, g, or t
  misc_feature (169)..(191): n is a, c, g, or t
taatcatttagttttttattgaaagtggaatggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaattnnnnnnnnnnnnnnnnnnnnnnngggg

SEQ ID NO: 8818 - DNA, 871 bp, Diabrotica virgifera
atcatctttggatagtacagttagagcttttgatattatcagatatcgaaactttagaacattcacttcaaccagaccagtacagtttgcctgtgtagcagttgatagtagcggagaatttgtagcagcaggaggacaggacgtctttgagatatatctgtggtcagttaaaaccggtagattattggaaatattggcaggacatgaaggaccagtttcgagtttagtcttcagtccgaccctcacaagcaccgtgttggtgtctgtctcgtgggacaaaactatgaaaatatgggacgccatcgagaaaggctctgctcacgaaaccatcgaattgacagcagatggaatatgtactgctttcaagccagacggccaagaagtagcggtggccacactaaatggacagataacagttttcaatgtcaagacttccacacaagtttctttaattgaaggacgtaatgatttgggcagcggaatagcagagactgatttagtgactgcaaaacaaacgttaaaagccaagtctttcacgagtttgtgctggtctgcagatggagaatccttgatagctggcggacaatctaagaatgtttgtatctatagtgtctcggaaggactgatcgtaaaaaaattcgaaatcacacagaataggtcattagatgcagttgatgacttcataaatagaagaaaactaacagaattcgacaacatagccttagtagaagaaagagaagaaagggaaggaggaaacgtcagcttaaactccccggtgttcgtaaaggcgacatggctgccagaagtattaaaccagaagtacgagtattctctctgcagttctccccaactggtcaaacttgggcagctg

SEQ ID NO: 8819 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8820 - DNA, 636 bp, Diabrotica virgifera
  misc_feature (293)..(340): n is a, c, g, or t
  misc_feature (433)..(452): n is a, c, g, or t
ctctttgaaagaacgacaaactttattttatgcgagggctactatatcgtgagagagtatatgatttttatataccaaaacgacatttttacgtaccttgggcctctggagacatgaaaaaagaataatatatatatatttttctcattttgatgagctctagaactaaaatttttttcgtagaagaaatatattgtataatttttttgtgatgaaatgctattcgctcccaaagagatccacttttttacgaaataaaacaaatttatgaatcagctccagattcagagttnnnnnnnnnnnnnnnnnnnnnnnnnnnnnnnnnnnnnnnnnnnnnnnngcataaaatcttattaacattgacttgttacacaaaaatgacgaccaagaattctcatactttctcatatgcagttattaatttttatctacnnnnnnnnnnnnnnnnnnnnaaatcacctattacattatatatttcgataatatctactgagaaaagatgataatattagtatgagcgacttgtttatttagtaaaaagatataggtttactaaaggaaatcagcaacattttctccacctgtctattaaacccacgacttcttgtatcaaagacaaagtctcgcccgcccact

SEQ ID NO: 8821 - DNA, 89 bp, Diabrotica virgifera
  misc_feature (4)..(86): n is a, c, g, or t
gggnnnnnnnnnnnnnnnnnnnnnnnnnnnnnnnnnnnnnnnnnnnnnnnnnnnnnnnnnnnnnnnnnnnnnnnnnnnnnnnnnnngga

SEQ ID NO: 8822 - DNA, 796 bp, Diabrotica virgifera
  misc_feature (7)..(24): n is a, c, g, or t
  misc_feature (32)..(52): n is a, c, g, or t
  misc_feature (82)..(149): n is a, c, g, or t
  misc_feature (151)..(163): n is a, c, g, or t
  misc_feature (214)..(233): n is a, c, g, or t
  misc_feature (244)..(275): n is a, c, g, or t
  misc_feature (278)..(306): n is a, c, g, or t
  misc_feature (314)..(353): n is a, c, g, or t
  misc_feature (361)..(374): n is a, c, g, or t
  misc_feature (376)..(406): n is a, c, g, or t
  misc_feature (444)..(462): n is a, c, g, or t
  misc_feature (490)..(541): n is a, c, g, or t
  misc_feature (551)..(590): n is a, c, g, or t
  misc_feature (654)..(681): n is a, c, g, or t
  misc_feature (694)..(755): n is a, c, g, or t
  misc_feature (757)..(769): n is a, c, g, or t
  misc_feature (773)..(792): n is a, c, g, or t
gggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnnnnnnnnnnnnnnnnnnannnnnnnnnnnnntagnnnnnnnnnnnnnnnnnnnntaaa

SEQ ID NO: 8823 - DNA, 695 bp, Diabrotica virgifera
  misc_feature (257)..(285): n is a, c, g, or t
attaccaacgacttagatggtaataaattccgctcgttttatgctatgtaagtaatcatttaaggatatcataaaacgagcagaatttattaccaacgacttagatggaggggacaataaaattttagccattttatcaggtcaaggtatcctttactttctaaatacagaagaagacaaaattctaagccaattacaatgtgatatagaaataaacagatttgtatgtacccctaatggaactcatgccatatgtnnnnnnnnnnnnnnnnnnnnnnnnnnnnntaatatacaacaatatctttcaccccctgtggaaataagagtccaaaaagttcgtaaaaaatttctaatcaatcggaaacgaagtctcgccgaagttcagtttgttaaacaagaaatcgatagtatcctagacataaaaaaactgaagtttatactaaaggaatatggcgaatatccggagaattacagaataaaaatatgggaaaggttactggatcttccaaataatgtaggcagctacaacaatgttataaaccataaaaccattatagctttcgtagatttacataaaaaaatatccattggaggataaattatttttaaccagtctaaaaaagttactaagtaatttagtaacttggtgtccattttttgctaatgtcgaatacctgccagtattcgtctttccg

SEQ ID NO: 8824 - DNA, 761 bp, Diabrotica virgifera
  misc_feature (11)..(85): n is a, c, g, or t
  misc_feature (87)..(135): n is a, c, g, or t
  misc_feature (137)..(693): n is a, c, g, or t
  misc_feature (697)..(740): n is a, c, g, or t
cccaccgtccnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtannnnnnnnnnnnnnnnnnnnnnnnnnnnnnnnnnnnnnnnnnnngctggatggaagggttggatg

SEQ ID NO: 8825 - DNA, 118 bp, Diabrotica virgifera
  misc_feature (11)..(40): n is a, c, g, or t
  misc_feature (42)..(108): n is a, c, g, or t
gttttttagtnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnttttttttga

SEQ ID NO: 8826 - DNA, 202 bp, Diabrotica virgifera
accttgtgtagcctgtctgaggatgcgataggaaaagaataggcgaatctgtgagatcactgaggagatcgcttacgaccctacttggcgtgcgagacattgaatccacatagtgcttactgtggagctatgattggcaagcccagagaacgaggagggcgtaaggaagaaccaagttcaagtataccaaaaagctcttcga

SEQ ID NO: 8827 - DNA, 97 bp, Diabrotica virgifera
  misc_feature (15)..(15): n is a, c, g, or t
  misc_feature (18)..(74): n is a, c, g, or t
  misc_feature (77)..(94): n is a, c, g, or t
gctggatggaagggntgnnnnnnnnnnnnnnnnnnnnnnnnnnnnnnnnnnnnnnnnnnnnnnnnnnnnnnnnngcnnnnnnnnnnnnnnnnnncga

SEQ ID NO: 8828 - DNA, 86 bp, Diabrotica virgifera
  misc_feature (2)..(18): n is a, c, g, or t
  misc_feature (26)..(50): n is a, c, g, or t
  misc_feature (61)..(81): n is a, c, g, or t
gnnnnnnnnnnnnnnnnncgagaagnnnnnnnnnnnnnnnnnnnnnnnnnagttttttagnnnnnnnnnnnnnnnnnnnnnattta

SEQ ID NO: 8829 - DNA, 56 bp, Diabrotica virgifera
cccacgcgtccgtgcgattttatatccagaaaatatcaaatagctgctcttcaaag

SEQ ID NO: 8830 - DNA, 775 bp, Diabrotica virgifera
  misc_feature (455)..(455): n is a, c, g, or t
  misc_feature (723)..(744): n is a, c, g, or t
  misc_feature (749)..(749): n is a, c, g, or t
gagagcaatcaacaactggtgaagaccgacaaccctgtgcgtttattccccattagaaatgtattgccctatcttagccctactgcattttcggtgtgaatttctcattagattttaaatttgtgatttttgacgtcacgtggaatatttagtttccggaaggcgtcctaaaagattaaaatgcttatcggtttaaaatatctaatgaaatttggccatcgtaatccttaggtcgtaatccatcgtaatctttggaaagtatcgtataattagcagttagtcgaatcaagcggtactgttttcgtttccgctgcttgtttatgtgtttctgagaaggacaatacgaataattttgtgaaatttacgtttttccccaaggtaaaattgtatagttttcgaaacgacctttgtctctcgacaaagacttttagaaacgaccctcccctctactaggngatttttgttattcgttttgtaattattttagaatatttttagtcagtaaccagcaaacctcaattctgtaaacacatatttgcaccgtgcgcctcccctctatttagagtcacgtgacacactgttaaattttgtaagggcgttttaacatttgtgtcttatgtgattattttggttaacttgaatattttattttgtagtgataataaccgaatacaattgttaagaatcattagttattagtttatagtgtaatttacagtggcnnnnnnnnnnnnnnnnnnnnnntaatnaagatttattgacataaactgcgata

SEQ ID NO: 8831 - DNA, 445 bp, Diabrotica virgifera
  misc_feature (19)..(50): n is a, c, g, or t
  misc_feature (89)..(113): n is a, c, g, or t
catcaggtattatcattannnnnnnnnnnnnnnnnnnnnnnnnnnnnnnnaattcaatagatctatacgactaattcttttatcgtagnnnnnnnnnnnnnnnnnnnnnnnnnctgtgaaatgtttctccactttaaagatatcccaatgttctaagatatattctatattttatatactcaccgatatttctaaaattaataattttactttaatagaccttaaaaatcccccttgtaccccctttctgcttaaatcaccactaacattatcttttaccgcatgaattattactgtaatttctcatgctttctcttctgtaactattaatgaatacctcctgcgactcccatacttccttccaacaccctctcattatcttatacggacaatagctattgagaggatgtaagagtacattacgatgtcggactgaattccttta

SEQ ID NO: 8832 - DNA, 939 bp, Diabrotica virgifera
  misc_feature (704)..(704): n is a, c, g, or t
  misc_feature (739)..(739): n is a, c, g, or t
ccccactgttgatgaaactggaagggatcagaaaacaatgttgtcatccaaagtttcaacttgtactagaaccacaaaaagtacgaaagaccaccaaataaaaccatcagtgccttctgttctagaaggaatagaagtaataaaaaaatctaaaaaaccaatgcgttcaaaacatctccggcattctgatgttttagatcaagaagttgaccacggcaacgaaagtcaaccttcaacagttgtctctgccttaacacaacaaaatgcaaaagatctcttgcagtctgtaaaagcatcagcatttgatcgaacacgcgaatatggttctcaaaagagtatggtagagtccaaggaaagtgttctaggcaccaaggaaatcatatctgaagaattcgattcaaattatttgttaccacctacacgtaccgttttacctaaagcatcaacatgcaaaataaccgtttctgaaaccaagggtaacgtagataatgccatatctgaagaagagttatcgaagttatagatgtgaaggaaaaatcattagaacagcaacaaacattccccactgttgatgaaactgcaagagatcagaaaaaaatgttgtcgtccaaagtttcaacttctactaaaaccacaaaaaatgcgaaagaccaccaaataaaaccatctgtaccttctgttctagaagtaacagaagtaataanaaaatctaaaaaaccaatgcgttcaaaacatctancgcgttctgatgtttagatcaagaagtgaccacgacaacgaaagtcaacctttaacagttgtttctgccttaacacaacaaaatgcaaaagatctcttgcagtctgtaaaagcatcagcatttgatcgaacacgcgaatatggttctcaaaagagtatggtagagtccgaggaaagtgttctaggcaccaggaaatcata

SEQ ID NO: 8833 - DNA, 215 bp, Diabrotica virgifera
  misc_feature (146)..(146): n is a, c, g, or t
  misc_feature (174)..(192): n is a, c, g, or t
tgagatataaaaatattatttgtattgtaatataaatagtttatttaattaattgttaaggtattgattataaagtttatattattgtttaggaaatgtggtagatttatatttaggatttgagtatatgtatttatattatttgntattttgatgaattattgtgttgagagnnnnnnnnnnnnnnnnnnngtgaaaataagtattttttttta

SEQ ID NO: 8834 - DNA, 205 bp, Diabrotica virgifera
  misc_feature (15)..(66): n is a, c, g, or t
  misc_feature (81)..(128): n is a, c, g, or t
atttcagcgtatttnnnnnnnnnnnnnnnnnnnnnnnnnnnnnnnnnnnnnnnnnnnnnnnnnnnncattgtatttcagcnnnnnnnnnnnnnnnnnnnnnnnnnnnnnnnnnnnnnnnnnnnnnnnnctgtcctttattgttacgtaatattgtcattaataaatggtaagttcacagtgtactttgatatataattatgtaca

SEQ ID NO: 8835 - DNA, 939 bp, Diabrotica virgifera
  misc_feature (121)..(142): n is a, c, g, or t
  misc_feature (282)..(330): n is a, c, g, or t
  misc_feature (493)..(511): n is a, c, g, or t
  misc_feature (728)..(728): n is a, c, g, or t
  misc_feature (767)..(767): n is a, c, g, or t
  misc_feature (823)..(841): n is a, c, g, or t
  misc_feature (907)..(907): n is a, c, g, or t
  misc_feature (918)..(918): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctanagtaccaaaagcttctttttttcttctctcttgcctaancatatgagaaattaatccaaatcctggtaaaattaaaatatatacttcaggatgannnnnnnnnnnnnnnnnnngttgatagagaattggatcccctccaccagctggatcaaaaatgatgtatttaaatttcgatctgntaataatattngtatagctccagctaaaactg

SEQ ID NO: 8836 - DNA, 921 bp, Diabrotica virgifera
  misc_feature (10)..(29): n is a, c, g, or t
  misc_feature (132)..(151): n is a, c, g, or t
  misc_feature (838)..(838): n is a, c, g, or t
  misc_feature (890)..(890): n is a, c, g, or t
tgccaagggnnnnnnnnnnnnnnnnnnnngcaataaaatcgcaaatagtgttgtcagttttgtgggtaaatgtttcggactagacaaaataaactgtgtgtgatgtggtgaatttttgaatgcggaaaaccnnnnnnnnnnnnnnnnnnnnattcatcaaatagaggactaataagtacgtgaatctgtactaaaaggtgtagaccttcgtagaaaacaggatctattgtgggatttcccggaccatctacacgtgcgctgtaaaaatggaccacgacctttctacaacccaatccatacatccattcattcactcgtgtccgaatccaccttcaaaatcttgtaaaagacattaaaccttctccttcctcgacgctctccccattctcccttgtaatggcaaaggcatcatcgacacccaaagttagctttgtgtagtaccatgtacgtttccatagctcctacttgatgcatgtgtagtgcccgatctatttaacaaatccctagaacaatggaatcctcacggcttcttatatacactttgtggatgctgattttcccagaattatttacagtcttccacgaaggagaggcagcttatgcagtaaaacgtttcacagggttatatacgggtccatacttcgatcccaccacaactacgaatatcacaacccaactaggaacacacgcttacatcccctgcaaaatcaagcagttaggaaacaaatcggtgtcctggataaggaggcgagacgcccacattctcactgtagataggtacacttttatagcagatgataggttttcagccttttttgtagaagcgaccgatacgtgnacgctacaagtgaaatacgtacaagcccgagacgcaggacaatatgagtgtncagtcagcacagacccaaagatgagtcattt

SEQ ID NO: 8837 - DNA, 856 bp, Diabrotica virgifera
  misc_feature (722)..(722): n is a, c, g, or t
  misc_feature (768)..(768): n is a, c, g, or t
  misc_feature (781)..(781): n is a, c, g, or t
  misc_feature (830)..(830): n is a, c, g, or t
gtgatcttcatgttgtgatactctttatattgaatttaaaatgaaaaacaaagaggaggaagatccggtcgatcttatttttaaagatgcttctatgtgtagtaaatatgtaatttttatgtttttgtccttgggatttttagcggcttatagtggttgtgtttttacgtatgtgtttctagcgagggatgtcaaatacagatgtcttatagaagagtgcgaaccgtctccaaccgacacaatatacgaaccaaaatggctgaagcgtttagttccttacacgggatctgttccggatagttgtcaccgttatgcactgaggaacgattcttgctcgacagaggctacgtctggaaacaacgaaactttcagatgcgataagtttgtttatcaaactaaggatgtcaccttagtacacgattttgatttgaactgcgacgaaaatgcatggaaactaacaatggttggcacgatatcgatgacaggcgaactagtttgtttggcatacactggtttcatttctgataaatatggaagaaaaactttgttaattgcatcgactttaatgagcaccgtcgtaggagtaataaaatcattctcagtttcttacaacatgtacgtctttcttgaattcatagactctatattcggagccgctatgtattacggtgcctttatcttagcaatggagtttgtagcaccgagaaacagaaacatcgtanatatagtaatatgttccttatacgcatttggagggtgttacatggngataattgcttgnctgtttccttattggagaaacatgctacgagtactatattttcctaganttatctgcattttattcttctggact

SEQ ID NO: 8838 - DNA, 514 bp, Diabrotica virgifera
  misc_feature (33)..(51): n is a, c, g, or t
  misc_feature (90)..(117): n is a, c, g, or t
  misc_feature (288)..(317): n is a, c, g, or t
gtggagtataatgttttgaaaaagaactccgcnnnnnnnnnnnnnnnnnnnttgtaaatattatgcagcgctgactaacacctttacaannnnnnnnnnnnnnnnnnnnnnnnnnnntattttctccaccttcgctctcaaaggatccccaatcaataacatatatctttactattttcaaacttaaaacatctaaacaactaatctccttattctaagacatttattccaaattagtttattgcaaagctatgttcaccaaccctagatatagctaatcctgtaagnnnnnnnnnnnnnnnnnnnnnnnnnnnnnncttcgcaataaaaaaattttactatcataaacataaattccttctccgaaagagccctctgcacaaatctcgttaacactaccaccacttagtaccaatcacaactcacaatgtccatgctcaaaaacatgctactgatcatgaataactaccacaatcgcgcagtgtgctaagtctatcccccgcataatcccccc

SEQ ID NO: 8839 - DNA, 729 bp, Diabrotica virgifera
  misc_feature (286)..(305): n is a, c, g, or t
tctgccctgaaaaatgaagtagtactagctttcgcgatagatagtcattatcgagctaggacattctcatttccataccagatacatgactgagaatactcgagcctatagggtaaaaacagtgaagcagtatataactaaaaatcccatttagaagacatgtgctttttcctaccttttacgtaaaccaaacatctaaccaataatttctttctgaagaaagtatatttctattattaccaaagccccctaacgaaaaaatgaaccagaatatgttgccaacacnnnnnnnnnnnnnnnnnnnngttatactactgaccataaagaatcgtcagaaaccccctgctcggaagatgttattactatcgtcttgaacgctaaaaaacataacggaaaaacatcgtactatgtcacttgacattaatccgaaataggagccataataacgaactcagctaagaaacgcagctcactaaatatctatataaaacatatccaactgtgccactgactcatcccaccgacaactattttctttcatatcatctaacgctaaccaagtagacccttgccacgcttttccttctccctatcaaaaagtggccctatatgtgacggtagccgttgccactgccttccccccattctacctcgattggaccccacataccgatgtctagctagggcatgaaaaattccgttccggcaaaaaaaaaccggaaaaaacga

SEQ ID NO: 8840 - DNA, 127 bp, Diabrotica virgifera
  misc_feature (15)..(15): n is a, c, g, or t
  misc_feature (21)..(126): n is a, c, g, or t
aagaatttatttttnaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8841 - DNA, 431 bp, Diabrotica virgifera
gtgtatgtaaaaattataacatgagtgcggatgatgcagaaaagatggtgatcctccatgagagtctaccatgttcggctcgaggatagcaggcatagagcagacaattattaatgccaacatctttgacaccagagcatagtgtcctcggagaatttacagctaatgcctctgcttaccattaccgattctaaatgataaggggtacatttcttccaagaatcctgcgagtatatctaaccttagtgaaaagaatattgagaagtcgcttatacttcaacaagatattaggtcgatagctactatccaacatagaatacatcttatatctggcattcgcttcccaaggagaatctgtggctgatcttgaagactatctctaatgaagggaagaaggacgccaataaatgtataagctgtactatgatgag

SEQ ID NO: 8842 - DNA, 930 bp, Diabrotica virgifera
atgagaacataaaaacaattattagtgaaaatcaagaaaaaggggaagaacaaggcctgacagagtgacaggagaagcattggaaaaaatagtattaaagttaaagttgttgaaagaactgcacttggatccgaagaaatgtggatgaatcggtaacaactttaataatactttaataacgatgccttttgaatgtctttgtagaactcaaaagtgtgtaaaaagtgccttcaaactcaccattttaaccgtaatttttaaaaattaccccctggcccccggtccacctccccaaaaaaagttcatggcccctcccgaaaatcggtcctggatccgcccttggactatcacagcgccattataaatataataacataataatagatatttaacttgcaacaggaaacatgccacaaaaaacagtatcagaacctctataaatcagaggaattcactttctcaatcatccatctttcatatttaggcaaaatgcaaaattgtttaaaacagttgttatgaaatgaattttatataagatgaccgtaatttaagaacaatgcagaagacgagatccacattgaaattacaatacgaaaaattttgcgtgggtgttgcagaaccttcacacgctgtgacagaactcataaataatacagccaagtcaacgattgttttgctgagcttacgttttattgatatacgagtactattacattgctttggttctttattcagtgacgtactcttggtacctacttgtacggtaaatggacggaatgtgaaattaatttatataagtatttattgcaaagtaaaaatcaaaagaaaatatttcaattatattgtctttacgatcaaatgttgaaatgctgcaagcgcttatttatgtgtaattgtatccaattatacaatgccttttaataataaaaa

SEQ ID NO: 8843 - DNA, 165 bp, Diabrotica virgifera
  misc_feature (11)..(42): n is a, c, g, or t
  misc_feature (58)..(77): n is a, c, g, or t
  misc_feature (115)..(143): n is a, c, g, or t
cgccccctggnnnnnnnnnnnnnnnnnnnnnnnnnnnnnnnngtagggtagcataacnnnnnnnnnnnnnnnnnnnngctggaaggaggggggggatgaaaacaactggctttannnnnnnnnnnnnnnnnnnnnnnnnnnnngtgcaaaagcttaatttttttt

SEQ ID NO: 8844 - DNA, 61 bp, Diabrotica virgifera
  misc_feature (2)..(15): n is a, c, g, or t
  misc_feature (25)..(52): n is a, c, g, or t
gnnnnnnnnnnnnnnagacgagaannnnnnnnnnnnnnnnnnnnnnnnnnnngttttttag

SEQ ID NO: 8845 - DNA, 197 bp, Diabrotica virgifera
  misc_feature (7)..(44): n is a, c, g, or t
  misc_feature (78)..(100): n is a, c, g, or t
  misc_feature (108)..(130): n is a, c, g, or t
  misc_feature (160)..(191): n is a, c, g, or t
taacagnnnnnnnnnnnnnnnnnnnnnnnnnnnnnnnnnnnnnntgcgacctcgatgttggattaagtttatattggnnnnnnnnnnnnnnnnnnnnnnntgttcgannnnnnnnnnnnnnnnnnnnnnnagtttaaaccggtgtgagcccagttggttnnnnnnnnnnnnnnnnnnnnnnnnnnnnnnnngaaagg

SEQ ID NO: 8846 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
  misc_feature (204)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngaaaggaccannnnnnnnnnnnnnnnnnnnnnnnnnnnnnnnnat

SEQ ID NO: 8847 - DNA, 696 bp, Diabrotica virgifera
  misc_feature (2)..(390): n is a, c, g, or t
  misc_feature (394)..(394): n is a, c, g, or t
  misc_feature (412)..(412): n is a, c, g, or t
  misc_feature (428)..(428): n is a, c, g, or t
  misc_feature (509)..(526): n is a, c, g, or t
  misc_feature (536)..(553): n is a, c, g, or t
  misc_feature (561)..(579): n is a, c, g, or t
  misc_feature (619)..(673): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttantaaattttttgatcccanttttttttgatataangaataattacccttagggatacagcgtaattttttttgggagaggtccaatcgataataaagtggggcccccccgtggggnnnnnnnnnnnnnnnnnnggggtgggcnnnnnnnnnnnnnnnnnnggtccccnnnnnnnnnnnnnnnnnnngtttgggggggtaaccggggcggggggggcgcggggggcnnnnnnnnnnnnnnnnnnnnnnnnnnnnnnnnnnnnnnnnnnnnnnnnnnnnnnnggggggcgcgcccccgccacata

SEQ ID NO: 8848 - DNA, 803 bp, Diabrotica virgifera
  misc_feature (24)..(49): n is a, c, g, or t
  misc_feature (179)..(194): n is a, c, g, or t
  misc_feature (681)..(681): n is a, c, g, or t
gctaatttgtttgttgatgatacnnnnnnnnnnnnnnnnnnnnnnnnnngatattttcaatgatgatttggatttgttggaaataatagaacatggttttccgagacgggtatttgttcggcctaattatttccaaacaatggacaatttaactttctttagaacatttagattttacnnnnnnnnnnnnnnnnttatcttaactttaattgaagatcgtctggaatttcctgataacaggaacaatagccttagtccaatgaaccagttgctaacttgcctgagatattttgctagctcaggttttctgataactgttgcacaatttatgcacattgatgtagctacagccagcagaacgatagcaagagtatccagggagttagcaacattgtatccaagatttattaaaatgcctacaacccaaagagagatcctgacacaccaagaaaaattttactcgatgtttagatttccacgaattataggggcagttgatggaacccatataaggatacaatcacctggtggaaatgatgctgaagtgtttagaaacagaaaatcatttttttctctgaatgttcaagtggtctgtgatgcagatatgaaatttgaaaatgttgtagcaaggtggccaggatccacccatgatgctactatcttttacaactcacgactcanagccagcttcattgccaatgaatttagaaactgcatactaattggagacagtggatatccacttcaagagtactttatgactccattaaaatcagccaaatactagagcagaatcactatat

SEQ ID NO: 8849 - DNA, 537 bp, Diabrotica virgifera
  misc_feature (4)..(31): n is a, c, g, or t
  misc_feature (37)..(37): n is a, c, g, or t
  misc_feature (49)..(106): n is a, c, g, or t
  misc_feature (108)..(164): n is a, c, g, or t
  misc_feature (174)..(209): n is a, c, g, or t
  misc_feature (214)..(273): n is a, c, g, or t
  misc_feature (275)..(307): n is a, c, g, or t
  misc_feature (424)..(442): n is a, c, g, or t
  misc_feature (474)..(521): n is a, c, g, or t
aggnnnnnnnnnnnnnnnnnnnnnnnnnnnngctggnatgaagggttgnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnngttttttagnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnntaagggaaaacgcggaatttttttggggaggtccaatcgaaaataaaaattgggccccccccggtggggtataaagttttaattgggggggaaccctttttttttatctgggtgcannnnnnnnnnnnnnnnnnngttggtggtttaaacggggggggggccgcgcnnnnnnnnnnnnnnnnnnnnnnnnnnnnnnnnnnnnnnnnnnnnnnnngacgaggggggcccac

SEQ ID NO: 8850 - DNA, 790 bp, Diabrotica virgifera
  misc_feature (74)..(91): n is a, c, g, or t
cggacgcgtggggtttaaagtagatatatcatcaaaacggtgtcgctctttttctatctgagaccagtctcacnnnnnnnnnnnnnnnnnnccacgaatgtcccagtttatttagtgattgtcccagttttaaatgtaaggaccaaacatttgcaaaagacagttacaggaaaacagaaatatggaccaaaagtaggaaatagtaccaaagagattcatcaagtacgtacaacatatttggtgctgtttccccactcatggagtcccccagtcagtcaaatgtcttgaaatcaagtccttcgttagatatgaaaaaaatctcaagtaattctctagacaatgttgacaatgagaatggagtactgcctgatgttgttgcaacaaagatttttaaacaaggggaacagttcgaggagagttatttgtccacagcgatacaagtttttattccgtttttgattgctgggtttgggatggtgtttgctggtttggtcttggacaaaattcagcactggacagtatttgaacaaattacagaattagtaatattgatacctgcacttcttggtctaaaaggcaatttggaaatgactttagcatcaagattatccacacaagccaacttaggtcatatggatacaactaaacaaaaaataagtattattgttagaagcttaacattgatacagtgtcaagccataagtcgtggggtttctgggtggtctggtggcagttgaaatgggtgggcatcaagagccacgatgtccaataagaccacgtatatcttttt

SEQ ID NO: 8851 - DNA, 408 bp, Diabrotica virgifera
tatatagcaatataggccatatttaccataatattactatttatgctatgttatacataattgatatatatcctatgtttttattatatacctttccttggttttattatcctacataaatacttagatgtcttgatattattactattaaatattattgctgatgaccttaatgctcctcgtttataatgagaatctaaccttaatatcaatgaggcttaaagctgtgtgtattgtattctatgaaataatatacgtaaagaccttattatttatatttgtccttgctatttgattaagatcttgctacttattacttgcatactaactggacttccactttatacatacacactgttgccactgttatcactctatacactaatggtactattatttattcacatg

SEQ ID NO: 8852 - DNA, 459 bp, Diabrotica virgifera
  misc_feature (78)..(120): n is a, c, g, or t
  misc_feature (333)..(333): n is a, c, g, or t
cggacgcgtgggatgaaggccttgattgaccttaacgtttgcttttgcttatttctagctgcctaatccgaattgtgnnnnnnnnnnnnnnnnnnnnnnnnnnnnnnnnnnnnnnnnnnnccttgggtatcagggagaacctatgatcaggcaaatattcatgatctatgaattcgatttctcatctatgcaagatctctaagggagtctgaaaattgcttacactattggagagctggttgagcaggtggcgcgaccgccatgcgctcctacgcccgcccgggcctcatttggtgcactatttttcttcctaatgtaggtgaacaatggaangagccagaagaccgccaatctccctgaaaagccgcctgcaagcttatgttttccaatctggcctcacttagtcctctctcacgttacgctcatcgaaacaaaaattaaatctttttctaccgccaa

SEQ ID NO: 8853 - DNA, 360 bp, Diabrotica virgifera
  misc_feature (6)..(6): n is a, c, g, or t
  misc_feature (21)..(42): n is a, c, g, or t
  misc_feature (46)..(46): n is a, c, g, or t
  misc_feature (50)..(83): n is a, c, g, or t
  misc_feature (102)..(178): n is a, c, g, or t
  misc_feature (205)..(223): n is a, c, g, or t
  misc_feature (295)..(317): n is a, c, g, or t
  misc_feature (324)..(345): n is a, c, g, or t
ttttanaagacgagaaacccnnnnnnnnnnnnnnnnnnnnnntaantagnnnnnnnnnnnnnnnnnnnnnnnnnnnnnnnnnnattttaaatgggggtgatnnnnnnnnnnnnnnnnnnnnnnnnnnnnnnnnnnnnnnnnnnnnnnnnnnnnnnnnnnnnnnnnnnnnnnnnnnnnngataaattaactttaggataacagccnnnnnnnnnnnnnnnnnnnggtcaaatgcttaataagagtggcggcccccccctgggttggggtaaaaaatttttaatttgggggggaagnnnnnnnnnnnnnnnnnnnnnnngttcccnnnnnnnnnnnnnnnnnnnnnngttttggggtttaaa

SEQ ID NO: 8854 - DNA, 465 bp, Diabrotica virgifera
  misc_feature (31)..(51): n is a, c, g, or t
  misc_feature (311)..(330): n is a, c, g, or t
cgcccctccccgcccgcgcttaataataggnnnnnnnnnnnnnnnnnnnnngaataggaaatagaatgttaggtgtatgataactaattataatactaggagaattttgaaggcccagaatcgtaattgcacatgcccaaatttagaaagtaagtgatacagctcatgccactataaagattttttttataggaccgacataatatatatagccggttgtggaaattgacttgtacccttaataattggagtgctcgatatagcattccctcagaagaaaaaatagaagatttttattgcttcccctgtcnnnnnnnnnnnnnnnnnnnngaaccatcgatcatggcgcgtgagcgtaaatattgaacgggttacccgccacgagactcatgtgaagcctctggtagtccatcactcagatttagatgtagtcagaattcattaatatggtatttctccgctatt

SEQ ID NO: 8855 - DNA, 729 bp, Diabrotica virgifera
  misc_feature (2)..(50): n is a, c, g, or t
  misc_feature (52)..(623): n is a, c, g, or t
  misc_feature (625)..(694): n is a, c, g, or t
  misc_feature (696)..(720): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnngtaaaaagc

SEQ ID NO: 8856 - DNA, 133 bp, Diabrotica virgifera
  misc_feature (2)..(112): n is a, c, g, or t
  misc_feature (116)..(116): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttantaattttttgatcccaa

SEQ ID NO: 8857 - DNA, 855 bp, Diabrotica virgifera
  misc_feature (8)..(745): n is a, c, g, or t
tagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtatttttattggagagttcaatcgatataaagattgcgactcgatgttggattaagttatattggtggagcagtatatattaggtctgtcgactttaaaatt

SEQ ID NO: 8858 - DNA, 990 bp, Diabrotica virgifera
  misc_feature (42)..(54): n is a, c, g, or t
  misc_feature (56)..(80): n is a, c, g, or t
  misc_feature (90)..(109): n is a, c, g, or t
  misc_feature (197)..(252): n is a, c, g, or t
  misc_feature (293)..(338): n is a, c, g, or t
  misc_feature (510)..(510): n is a, c, g, or t
  misc_feature (539)..(812): n is a, c, g, or t
  misc_feature (821)..(874): n is a, c, g, or t
  misc_feature (876)..(938): n is a, c, g, or t
  misc_feature (940)..(988): n is a, c, g, or t
gaagttaagaaatttaaattttaaactaggattagatactcnnnnnnnnnnnnngnnnnnnnnnnnnnnnnnnnnnnnnngttatggtcnnnnnnnnnnnnnnnnnnnncggtattttagtctttttagaggaacctgttctttaaatgataatccacgattttattaacttttattattaatttgtatatcgtcgnnnnnnnnnnnnnnnnnnnnnnnnnnnnnnnnnnnnnnnnnnnnnnnnnnnnnnnnagatcaaggtgcagtttatatagaagtagaaatgggttacnnnnnnnnnnnnnnnnnnnnnnnnnnnnnnnnnnnnnnnnnnnnnnggatttaaatgtaatattaattaattagttaatatgattttggctctaaggtatgtacatattgcccgtcgctttcatttaatatgaaataagtcgtaacaaagtagatttactggaaagtgaatctagattatcaaattagagcttgatagaagtattttagttacattanaaagttaattgtgaaattcaatttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattcgnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnngg

SEQ ID NO: 8859 - DNA, 988 bp, Diabrotica virgifera
  misc_feature (252)..(271): n is a, c, g, or t
  misc_feature (565)..(582): n is a, c, g, or t
gtgtaataagggtaggaggaagaatacagaatgctgaggtagggtacgaccaaaagcatccgattatactttcgaaatcacataagttaacaaaactcataatacaaaacgaacactatcgaaatttgcatgcgggtgcgcaaacgttattaaatattgtgagattaacctattggcctatatcgggtagaagcgtggttcgggatatattacgtaagtgcataacgtgttttcgggcaaagccattgcatnnnnnnnnnnnnnnnnnnnntttaccggctagtcgcataactcctagtaaaccttttgaacggtgtggcgttgactatgcaggtccgtttcatataagggctcataagcttagagggcaaaaaaattattaaggggtatttgtgtatttttgtttgcttggtgaccaaggcttgtcatttggagttggtcaatgatttaactacgcagggatttttgaattgttttaaaagatttatatccagaaggggtttaccacggaatatatattcggataatggaagtaactttgtaggggctaacaaccactttcagnnnnnnnnnnnnnnnnnncgggatagggtaaatcagtgtacttttgctagatacttatctgaattgtctattaactggcattttatactaagctattctccacatttcggtggtttatgggaggaagctgtaaaatcggcaaatatcatttaaaaggggtgttggggacactagtctcacctatgatgatttgaatacggaaattgcgcaaactgaagcctgcttaaatttcccgtcctttgacccctctttccgaggatcctactgatttttatgttctcacctctgatttttttaattgggtgtccattgggggggttgcagcaggagactttctaaatctgaatccgggtcgtattcaagggttcaattggaaacggagatgatgaaaaatttttgaagaaatgggccaagggttatcggg

SEQ ID NO: 8860 - DNA, 832 bp, Diabrotica virgifera
  misc_feature (210)..(234): n is a, c, g, or t
ttatgttaatgttcatgttagtgaataacctttcgaatgaggtatcacacgacctatattctcattaaaaaaatcctcaattacgtcattacgcccagatggatgacgtcactggtgtgatatatatgtgtatactcactgacaaaaatattgcatattttatcttcaatcgttattatttctttattttttatctttgaaatgttaagnnnnnnnnnnnnnnnnnnnnnnnnntacttactttatttatttatttgctgtacctagtttaatttactagagataaataaatggttaaacatagtctttataaccggatatgcaataaagtcacaaattaacaaaacaaacatagtatggaaagtgtgctttggcgacttgacaattcttgttttgttgaaatgtcagttagaatatgtcagttggagagttttatttttcgattctgcagttttcttgctgatatgccacatttaagcgagttagtgtgtgttagaattgttacgttaaaaaatgagggttacagacaaaaatatagtacgtgaatagcggatatccatcagtcgactgtttctcgtgtagtaaagcgatacaatgagactggagaatacaaacggcgacctggtcaaggacgaaaaagatatacagcgccaagagatgaccaatatttaagacttaaatctttgcgaaatcgtacacttacagctccccatctcaaaaatgaattacttatcacaagataagttaatgtaagtgtcaaaaatgtgactagaagacttaaagaggtgggtttgatccaaaacggcctggcagagttccacttcttctacca

SEQ ID NO: 8861 - DNA, 764 bp, Diabrotica virgifera
  misc_feature (2)..(44): n is a, c, g, or t
  misc_feature (52)..(109): n is a, c, g, or t
  misc_feature (114)..(707): n is a, c, g, or t
  misc_feature (709)..(746): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnagacgagaaacccctata

SEQ ID NO: 8862 - DNA, 1107 bp, Diabrotica virgifera
  misc_feature (694)..(729): n is a, c, g, or t
  misc_feature (847)..(867): n is a, c, g, or t
  misc_feature (900)..(922): n is a, c, g, or t
  misc_feature (945)..(962): n is a, c, g, or t
atcctgagaagcaaacaaaacagtatcattcaacgcaattggttttttgctgaaattaatcatagataagagggttaaattaataaaaggagacaaactgaaggaacatggatatccaattgtaacagacgaaaacattatttgattcgcagtactcgaaagatttaaaaggtataaacaataaaaaatggatatgcaagacgtgaaagtactttttgacggatactccaaactagaaggtggagactactatgcaaattgttcttgtgttttaatcaaaggtccccacaatgttatcgttgatacgatgactccatgggacggagataaattgttgaatgctttaaaagaagaaaatattagttgctctgacataaactacgtagtatcaactcatggtcattcagatcatacagggtgtaattatctgtttaaaaacgctatccatatagtaggtttctcgatttctcacaaagataaatatcacacagatccagactttaggaatggtgaacactacaaaattaatgataagatcaaagtaattccaacaccaggacatacattacaagatgtctccgtaattgtagaaactgacaaaggagtgctagctgtcacaggagatctgtttgagaaatttgatgatcttgataacgaagatatttggttggcaggaggaaacgattctgaaagnnnnnnnnnnnnnnnnnnnnnnnnnnnnnnnnnnnngctgatttttatggtccccggtcatggaactatgttggaaggtcccaagaaataataagtaaagttaaataaattattgaaaatcaattaataatgtttggatagtttatatgaaggnnnnnnnnnnnnnnnnnnnnncaatcccgaaattgcaaaatggaaaaaaatccnnnnnnnnnnnnnnnnnnnnnnngtccaaaaggaaaagggggtttnnnnnnnnnnnnnnnnnncgggcggcccgccccaaaaggacccagttttcgtctcgcgggccttgggtccgtcaaaactttctttaaagcggcacccataaattacatttcccggggccggtccttttaaaaacacggtcgggctggggggaaaaaccctggg

SEQ ID NO: 8863 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 8864 - DNA, 919 bp, Diabrotica virgifera
  misc_feature (771)..(771): n is a, c, g, or t
  misc_feature (809)..(809): n is a, c, g, or t
  misc_feature (896)..(896): n is a, c, g, or t
cgtttaagacattgtttcatcagaaattatgtttttggaaagatgttttaatatcaaaacaaataaactttacaataatcaatatgataattgataatgcacaattttgcaatatgtttactactattgcatacttgttgagataatcttctgaataagctttacccggttgtaaatcaaaggttagaattgaaaacaaaatggatttaactggaatgcgagccaattataagagcaaattggcatccttcttagaaaaggacattgaagttaaagaaccgtatgacctattcgagaagtggtttaagttggtgaaggaagatccaagaacagttgaagcaaatgccatgtgtgtgtcaactgctacaaaggatggatttccatctgcaagatattgccttctcaaaggatttactaaagatggttttatatttttcacacattatactagcagaaaaggaaaagaattggaggaaaaccctcgtgcagctcttacattttattgggaacacttcaatagatcagttaggattgaaggtgatgtagaaaagttaccatttagtgatgcagatgaatactttagtaaacgaccatacagaagccagattggagctctttgtagtaaccaaagtataccggttgaaggacgccacatactagaacaaaaagctgaagaactagctagtaaatatagcgagggacaagtaccaaggccaccattaaatgggtggttatctagtaaaacctagacgtttcgaattttggcaaggncagacagatagaattcacgatagaatcatctttagaanacctagttgcccaatgaaccagatggtattgtaacacgtccagcagaaagaagttggatatatgagagattaacccttaactattgntatcataagagtgattttaaaat

SEQ ID NO: 8865 - DNA, 1217 bp, Diabrotica virgifera
  misc_feature (445)..(463): n is a, c, g, or t
  misc_feature (586)..(604): n is a, c, g, or t
  misc_feature (842)..(869): n is a, c, g, or t
  misc_feature (1020)..(1071): n is a, c, g, or t
  misc_feature (1137)..(1202): n is a, c, g, or t
atggcgttgatttataggggataagtttgtgtttttatgaattttttccagagtaaatattaaatataagtgccagtttaatacatgtggatgcttttgatcttaaacatatagtttccaccaacgatacaccagagcccgtggataatttggacggtgaaactacaactacagacgaaccaatggctaaaacgaggcgcaaaaataaaaagaacccacaagacagtgaggttgacaaaagtgataatactacaaatgataaactaattgatacttcacaagaggaaacagcagtagaggaaacaactgtggaaaaggataacaaggataaagaagatcctccaacacctccagaagaaacagaaaccgaagaggccacagtggaaaaagattctctgacaactcaagaggaaatagcagctgaagagacaacagtggaaaatgnnnnnnnnnnnnnnnnnnntcctctgccaactccagaagaaacagcaatagaagcggcaacagtggaaaaagataaaaacagagacgattctctgtcaactcaagaggaaatagcagcagaagagacaacagtggaaaaagnnnnnnnnnnnnnnnnnnnttctctgacaactcaagaaaaaacagcagtacaagagacaactatgaaaaaagataagaaaggtaagaaaaacaaaaataacgaagatcctcttaccagtgatgctgctgaaaatactccagaaataacagcagtggaagagacaactatagaaaaagataagaaaaacaaaaataaggaaggtccgcttacaagcgatgttgctgaagaaactccagaaacaacagcagtgggagannnnnnnnnnnnnnnnnnnnnnnnnnnnatctcttacaagtggggctgctgaaaaggttcaagaaaaaacggcagtaccaagaaccaactatagaaaaaagataagaaaaaccaaaaattagggaaaattcccctctaaaagggttgctgttggaaaaaaacccaggaaaacaaccccnnnnnnnnnnnnnnnnnnnnnnnnnnnnnnnnnnnnnnnnnnnnnnnnnnnnggaaaaaacccgttttaaaaatggagtggtgtgttgaaaaaaaacctccaaaaacaaaaccagcannnnnnnnnnnnnnnnnnnnnnnnnnnnnnnnnnnnnnnnnnnnnnnnnnnnnnnnnnnnnnnnnnaaaatatcccccctt

SEQ ID NO: 8866 - DNA, 775 bp, Diabrotica virgifera
  misc_feature (631)..(631): n is a, c, g, or t
gcgaaatataagataagatggatgttgaatcgttccgagagttcggtaaagctagtgttgactatattgcggattatattgaaaatatccgtaagaaaaaggttctaccgtccgtagagccagggtacctacaaaacgaaattccggaactagctcctctttctggagaaccatggcaaaatatccttcccgacgtcgacagagtcattcttccaggattaacccactggcactctccgcatttccatgcttactttccaacagcgaattcgttcccaggagttgttggagagctgtttttgtccggattgggttcgatctctactgattggcaatccaatcccgcttgtgttgaactggaagtaagaatgatggactggttagctaaaatgcttggactaccagaacattttcttaacgaatcagaaggtcccggaggaggtgtaatacagaacgcagcgagcgagtcaacattggttggcttgttatctggaaagcagagaacagtaaaacacatcctcgataaaaaccctaacctaactccagaagacgtaaaaggaaaactgatagcttatacctcaaaagaatcaaactcttccgtagaaaagccagtttactagcctcagttccnatgagactactgcctacagactcagattgccgtttacgtggagatactttacaggaagctatccagaaagataaggcagaaggcctgattccgtggtgtgttgtagctagtctaggtactactggaacctgcgcgtttgatgac

SEQ ID NO: 8867 - DNA, 612 bp, Diabrotica virgifera
  misc_feature (194)..(208): n is a, c, g, or t
caaaaaataaagtgcttaccacatacacaagaaatttaggagtgtaacagaaaaagtagtgtatactgaaagtgaggaacatcctggtaaaacaatagctatgaggtacgcctggattgattcacaaattccaggatttagcatatgtatgtgatgattggtttattttacattgatcaaatattgacatattnnnnnnnnnnnnnnnatttctgccctctgctgactatatgcccgactattctgtcctgaatgcatactattcttgtgctaactaaacgccaaaactgagggatcgctgctctcctttgtttactgaactgttgaagcttctttgtgcttggatctatgtttcccaacatgccaaacaatcttacagataccttactcttcaattactttatgatattataatgcagaaattatgttgaattacaattctctgtccttgtataaaatatgaccaaactgtgtatatggaaacaatgaatatatagaatgcgcaacccgtataatttgtctctatattatgtgacatcgctggggagcatatggtagtgattgtaattcatttatattgtttattctgaattccttttgttactattttta

SEQ ID NO: 8868 - DNA, 292 bp, Diabrotica virgifera
cattcattaactatataactataattaaagatatctttagtatgatcaaatttatgaggatgtattagccacgagattttcattaaaattccattataagtgcacacgtcatataaaagattcataatttgaacatatagtacttattaactaatcaactaacatcagttatagtgacacaattgtgtgtagcataggaagatttaaccctattaaagccatgctaggatgatcctacgataaacctaatcagtagattctcccagactaatatatggccattgctagaatt

SEQ ID NO: 8869 - DNA, 97 bp, Diabrotica virgifera
cccacgcgtccgattaatcgtctatttattttttgtttacaatattatgagataaaatagttgaattttactttttattaataaataagtaagaatt

SEQ ID NO: 8870 - DNA, 660 bp, Diabrotica virgifera
  misc_feature (2)..(50): n is a, c, g, or t
  misc_feature (52)..(543): n is a, c, g, or t
  misc_feature (545)..(558): n is a, c, g, or t
  misc_feature (560)..(612): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnngnnnnnnnnnnnnnnnnnnnnnnnnnnnnnnnnnnnnnnnnnnnnnnnnnnnnngtgaccgtgctactgtagcataatcatgagcttttttattgaaagctg

SEQ ID NO: 8871 - DNA, 403 bp, Diabrotica virgifera
  misc_feature (2)..(70): n is a, c, g, or t
  misc_feature (74)..(74): n is a, c, g, or t
  misc_feature (80)..(167): n is a, c, g, or t
  misc_feature (171)..(239): n is a, c, g, or t
  misc_feature (242)..(258): n is a, c, g, or t
gnnnnnnnnnnnnnnnnnnnnnnnnnnnnnnnnnnnnnnnnnnnnnnnnnnnnnnnnnnnnnnnnnnnnnattnttttannnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnggnnnnnnnnnnnnnnnnnccttagggataacagcgggtattttttttggggagagttaaatccgaaaataaaaattgggggccccccaagggtggggttaaaggtttataattggggggaccaatcatatatttttaaaattgtgttgaatcttttaaaattt

SEQ ID NO: 8872 - DNA, 568 bp, Diabrotica virgifera
  misc_feature (2)..(411): n is a, c, g, or t
  misc_feature (424)..(507): n is a, c, g, or t
  misc_feature (509)..(524): n is a, c, g, or t
  misc_feature (533)..(550): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttgaccgannnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnngttaaaaannnnnnnnnnnnnnnnnnccagaaaccccaaaaagg

SEQ ID NO: 8873 - DNA, 867 bp, Diabrotica virgifera
  misc_feature (645)..(645): n is a, c, g, or t
  misc_feature (763)..(763): n is a, c, g, or t
  misc_feature (822)..(822): n is a, c, g, or t
  misc_feature (832)..(832): n is a, c, g, or t
gaccgcagaagataaagcaagatgcttacagctggcacgggcacagatagcgtgctctccaacggccgtaatgaacatggataccaaaccaaactgtatactggaagaaatttatgagcgatctaagaatagcacatgtccagtggttacccgggcaatacatcaagctcagtggagtaagatgggtacacccaacctttggttaataatcacaccgattccgatacacctgtccattatctgtgatggaaatcggaacgaaagcgttctggagcgagtctcatttctgaaactctcgccccgatgcatcgcccaaacgaaaaacattacattactccccactagcagcggggtggagacagcgataaccagctacctgaagactccgatcactcctgtagcgcagttgctgacgatgccaagacatctgttaaatacgattcaacccacacacattaacacacaaaagcgatgaattccgtactatactattggacgaagaaagtctggagcaagaagtagcgcatacgccctggcgaaagatacatgagtcacattggacttatttaacggccaccggggtcattacttcgattgtggtgattggtctgctcatattgtggagatactgtcctggtatacganaatgtcgctcaggcaaagcacttaggcagacacccgaccacgaggtaacttctttagctcgtaaccggaaagacgcctccccgtcgacttccaaagccgacatccccctcaacacttnttccatctagtagtccccaattttgatctaaatatagaagtcggacgggtgaaagctanagttaacagntggaaaaaatattgattattttctaactacttata

SEQ ID NO: 8874 - DNA, 471 bp, Diabrotica virgifera
  misc_feature (48)..(72): n is a, c, g, or t
  misc_feature (113)..(138): n is a, c, g, or t
  misc_feature (274)..(292): n is a, c, g, or t
  misc_feature (336)..(364): n is a, c, g, or t
ttatgaaatatatctatttttgttagtgatagattattgttattgagnnnnnnnnnnnnnnnnnnnnnnnnnatatttttagtacctggaccatgaggatcaagtattattcnnnnnnnnnnnnnnnnnnnnnnnnnncaaatgagctagagagataaaatttttattgttattgaaatatatttattaatcatatttgtattggaaaggaattgcgattctacctataatccacatctcttaggattatgaattaaattgatttattatctcnnnnnnnnnnnnnnnnnnncgtaatattattaccataatatattgttagggatgagatgagcnnnnnnnnnnnnnnnnnnnnnnnnnnnnnagtaaaaactaagcacgaaaatttacatatcgttaggacatggaagtatttatttatatccatcattacttttattcatcataaatgcatttttaaaccattaacta

SEQ ID NO: 8875 - DNA, 339 bp, Diabrotica virgifera
  misc_feature (205)..(236): n is a, c, g, or t
cccacgcgtccgtttttaaataaaccaaattgtttttatttcttaaagtttactcgtatcaaaaaggaactacaaaacttaacatcacattaaaaatattgaaaacgtcgtctcaactcaatgaaaatctgttttagctgattttgttcttaaacattcttataatatttatacactatattatatagaataacgaaacacatgnnnnnnnnnnnnnnnnnnnnnnnnnnnnnnnnttcttgaaactaaactaagaacatcaatataaaatgaaaatttttccagtattaccctttacattcggacattttaggtagtgttccccaaaatcggtcttga

SEQ ID NO: 8876 - DNA, 633 bp, Diabrotica virgifera
  misc_feature (5)..(35): n is a, c, g, or t
  misc_feature (39)..(54): n is a, c, g, or t
  misc_feature (56)..(84): n is a, c, g, or t
  misc_feature (97)..(114): n is a, c, g, or t
  misc_feature (122)..(189): n is a, c, g, or t
  misc_feature (257)..(278): n is a, c, g, or t
  misc_feature (310)..(356): n is a, c, g, or t
  misc_feature (416)..(434): n is a, c, g, or t
  misc_feature (468)..(489): n is a, c, g, or t
ccctnnnnnnnnnnnnnnnnnnnnnnnnnnnnnnngggnnnnnnnnnnnnnnnncnnnnnnnnnnnnnnnnnnnnnnnnnnnnntaaaaacgttggnnnnnnnnnnnnnnnnnntttttggnnnnnnnnnnnnnnnnnnnnnnnnnnnnnnnnnnnnnnnnnnnnnnnnnnnnnnnnnnnnnnnnnnnnctccttgggcctttggggaaaataaaaacctcccccgccccccccccaggacccgggattttcggttnnnnnnnnnnnnnnnnnnnnnnccggaattttatcgggggccttttttgccccnnnnnnnnnnnnnnnnnnnnnnnnnnnnnnnnnnnnnnnnnnnnnnnattttaaaatgggggggggccgtttaaaaggatcaaagtttaagaagggggggtgggaannnnnnnnnnnnnnnnnnngggccccaaaattaaattccggggcgggggtttnnnnnnnnnnnnnnnnnnnnnnccggggggttacccaatttaatcgctttggaaaaatcccccttttccccagggggggaaaaagaaaaaaggccccccccaatcccccttcccaaaagttgccaaccctaaagggaaaagggaaccccccctgaagcggcaataa

SEQ ID NO: 8877 - DNA, 755 bp, Diabrotica virgifera
  misc_feature (8)..(734): n is a, c, g, or t
  misc_feature (741)..(741): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattnaatagtttttttag

SEQ ID NO: 8878 - DNA, 394 bp, Diabrotica virgifera
  misc_feature (202)..(225): n is a, c, g, or t
cccaacgcctttcgacttacctatctttagatactctatttctatagaatgaaagatggggatatctcccttgtctataccatgacaactttgcttttaaaaaaaccaggctgtttctgggtattctaatcaatataactggacatcaaataaggctaaagcataatctaactgattgttttagagagtaaaaaaacgatcnnnnnnnnnnnnnnnnnnnnnnnngtttattgttatgagcggaaacacacttccgaataaaaaaaaatctggtcaaagcctgcggcacgtactcccaccaatatttatttctataaaaatatgaataacgcctcaatagtaggaatattaaacaacacactcgccactacattatactgaagattcgtttatt

SEQ ID NO: 8879 - DNA, 245 bp, Diabrotica virgifera
  misc_feature (7)..(86): n is a, c, g, or t
  misc_feature (89)..(89): n is a, c, g, or t
  misc_feature (109)..(132): n is a, c, g, or t
  misc_feature (142)..(142): n is a, c, g, or t
  misc_feature (166)..(179): n is a, c, g, or t
  misc_feature (182)..(197): n is a, c, g, or t
  misc_feature (213)..(234): n is a, c, g, or t
ggggtgnnnnnnnnnnnnnnnnnnnnnnnnnnnnnnnnnnnnnnnnnnnnnnnnnnnnnnnnnnnnnnnnnnnnnnnnnnnnnnnntanattaccttagggataacagnnnnnnnnnnnnnnnnnnnnnnnntcgataatanagattgcgacctcgatgttggatnnnnnnnnnnnnnnggnnnnnnnnnnnnnnnnattaagtctgttcgannnnnnnnnnnnnnnnnnnnnnagtttaaaccg

SEQ ID NO: 8880 - DNA, 897 bp, Diabrotica virgifera
  misc_feature (846)..(846): n is a, c, g, or t
  misc_feature (876)..(876): n is a, c, g, or t
tcaaaagattatcctttaacaaaaaacttaggattagtaattttatattaatgaatttaacaattttactatgacagaaagaacagaagacagtggatatgaaaatgatatatctcattcttatgatggtattaactggaagttagattccatttacaacattagagtagcaaatatttatgatccctccaaattttggatagtgcattttacggaagagttagatttatttttttcatttatgaacagtttttacaatgaaaaatatgaagagtatcgaatgccaatagaatctatgaaaagaaacacttattgtgcagtttacacagataatgggttttatagggctcttattgtggagattacaaatagggtgagaccagatgataggatcattgtatttttattggactttggttatactagcacagtttctccagataacatatatagattgtacgagaagatgtaccatatgcctagatgtgccataagagcttgtttatatggagttgaaccttatgattcagatacttggaccacccaagctacagaaaagttgaaggagttaacccaaggcaaaatattaatgtgtcagttgtgcgcaattgatgacgaatataaaatagtgtatattagaattgtggatacagctcacgttcctgagcaaatcgacattggagaaaccctaattatcaaaaaaatggcaaaactagccagaaaaaaagatatgaaaatgacagaaaaacacatagaaaaatttatacccaaagttaggtatccgcatttgtgtccatcctttgaccttctagaaaatgggacgatgccttcatcagtgcatgttgncggagtataaaaacatatatgatggctgcncaatatttcaacccatatata

SEQ ID NO: 8881 - DNA, 935 bp, Diabrotica virgifera
  misc_feature (773)..(773): n is a, c, g, or t
  misc_feature (836)..(836): n is a, c, g, or t
  misc_feature (845)..(865): n is a, c, g, or t
  misc_feature (867)..(867): n is a, c, g, or t
  misc_feature (886)..(886): n is a, c, g, or t
aatggacaagccatacaactttgttgacgttgtattttgtgatgtttattttgagtaggtaggggaccaaaaattgtaaattgtattagtaaatgtggtagcttgtgtgtgtcgcgtatatacgataggaggtacttaattcgaggtttttctgcttttattaagtacaaaagagtggttattttattccaaaatcgagcataaataaactaaaaagtgcaagtgttatttaaaaagtgtcaaaaagtttccagaaactgtttttaataccagaatgagttcataaccacaatcttggccgtgattatttgattgtcgaacattttaatacaacaatggatttcctgaaagaaatctagtgctagcaatggaatcggaagatgctctgaaatattatctagaggaagtcaaagatactcagcatgatataaaccacatcgaagaagaaatacacataccaaacgaagccgaacaggcgactgacttccttcagaatgcgggactcggagacctctcaaagctctaccagcagggcaaagagataaccgaaaatgtgatcaaaaattccgttcatcaaaggaatctgagcgagaaacaggcccagactattcgatctcgagtgaggattctaaatcaaacattgaggagtcgacaaccacgaagaaaacaaagacaggacattcgagacatttcttggaatgctgagacttcaagtacaggaactaggtcacgatctgctactccggattccttggattctcttgacaatttanatgacgaaattacttatgatgaccaaaatttgacttcgctatctcccttctcactggatctancagacacannnnnnnnnnnnnnnnnnnnncnacgaatagtgaaccatggncaaaacaaaaagtttacagaaacgacccgaggagatgtagctcatactg

SEQ ID NO: 8882 - DNA, 750 bp, Diabrotica virgifera
  misc_feature (710)..(710): n is a, c, g, or t
  misc_feature (724)..(724): n is a, c, g, or t
  misc_feature (734)..(734): n is a, c, g, or t
gtttagttgtgatttttagtcgaaaaattttggaagatggcgattataaaagatatgatgatacttctaacactttggctgtcagttaatttggccatgtgtagagaaaatctagacgacggacaccagaagattttgcatcacgttttaaggaagtttcacaaacgccacatttgccaagagctatgttcatcaggtttaggaggacattcgtgcggaagagattgtttagatgtttttcaacaaatatataatatgcagcagtctacatctaacaatttaactgaaagtcataatgataataacgtacctagaagcgatatgtgccctgttctttgtaaataccacttggggaaaccattgtgcgtatgttcaaaagtgcaacatattgttccgtcgaaagctattgattttttggaaatttgcagtgaattttgcaatacatacaactacagaatctctggttgccaaaaatgcagcatttatcaagacataactccaccaagaaagtcagcttcaggtctaccagatctagatccagatgacatagattggaatgagtggtgcactttgaaatgtagagaaggtgacggtggagctgcttgtgcttgtgaccgaggggctttcggattagtatcttaagaatgcaatatcaatataaaaacaaaaacaattgaagcgtttattttgaaaataacaatttttgtccnaaaatttaaatttntggaaaatanagaaaaaccctaattc

SEQ ID NO: 8883 - DNA, 414 bp, Diabrotica virgifera
  misc_feature (5)..(49): n is a, c, g, or t
  misc_feature (56)..(56): n is a, c, g, or t
  misc_feature (61)..(62): n is a, c, g, or t
  misc_feature (64)..(117): n is a, c, g, or t
  misc_feature (122)..(124): n is a, c, g, or t
  misc_feature (128)..(147): n is a, c, g, or t
  misc_feature (149)..(149): n is a, c, g, or t
  misc_feature (151)..(151): n is a, c, g, or t
  misc_feature (167)..(190): n is a, c, g, or t
  misc_feature (331)..(406): n is a, c, g, or t
aagcnnnnnnnnnnnnnnnnnnnnnnnnnnnnnnnnnnnnnnnnnnnnnattattnaatanngnnnnnnnnnnnnnnnnnnnnnnnnnnnnnnnnnnnnnnnnnnnnnnnnnnnnnnaaatnnnattnnnnnnnnnnnnnnnnnnnnantnataaatttttgatccnnnnnnnnnnnnnnnnnnnnnnnnaccttaagggatacagcgtatttttattggggaggtcaatcgatataaagatgcgcccccaggttggataaaagttttaatggggtacagctattttttttaatctggtccccttttaaatttttaatgttcggaggttannnnnnnnnnnnnnnnnnnnnnnnnnnnnnnnnnnnnnnnnnnnnnnnnnnnnnnnnnnnnnnnnnnnnnnnnnnncgccccgc

SEQ ID NO: 8884 - DNA, 113 bp, Diabrotica virgifera
  misc_feature (13)..(13): n is a, c, g, or t
  misc_feature (20)..(65): n is a, c, g, or t
  misc_feature (82)..(82): n is a, c, g, or t
ggaatggaagggngtggatnnnnnnnnnnnnnnnnnnnnnnnnnnnnnnnnnnnnnnnnnnnnnnggtaaaagcttaaattnttttaaagacgagagcccctatagagtttat

SEQ ID NO: 8885 - DNA, 932 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (777)..(778): n is a, c, g, or t
  misc_feature (783)..(795): n is a, c, g, or t
  misc_feature (798)..(842): n is a, c, g, or t
  misc_feature (861)..(924): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttannatatnnnnnnnnnnnnnccnnnnnnnnnnnnnnnnnnnnnnnnnnnnnnnnnnnnnnnnnnnnnctcatcccctaaaatattnnnnnnnnnnnnnnnnnnnnnnnnnnnnnnnnnnnnnnnnnnnnnnnnnnnnnnnnnnnnnnnncttaaaaa

SEQ ID NO: 8886 - DNA, 487 bp, Diabrotica virgifera
ccatctcaagagtgtaagaacacaatctatcggggtgacgaagatagaagacactatgaagtgtgggatggcttgtgaatgcaatgatagggagtaaagaaattatattcacctataggaatcaatagaaagtatacatgtaaagacagatcccagcatgggaagatcaagacgaacggcataccgagaatttaccacattagatactatcgacaaaagtatagatgccgagtatatgacattaccgacagaaaagtagagccagaaaaagccaaagtgaggcatgcaagaatatgtagtacgaggtctcacctgcgagttgagcgatgatgaaatacagacctatttctcacaatatggaaagatcgttgatattgaaatgctatgagagtaggcgaaaaacaaaaagaaaggattctgcttaatgacaatagaatatgaaaaagaagcgaaagagttacgcacgcaacccacacaaaccattaaa

SEQ ID NO: 8887 - DNA, 671 bp, Diabrotica virgifera
  misc_feature (11)..(28): n is a, c, g, or t
  misc_feature (33)..(69): n is a, c, g, or t
  misc_feature (71)..(84): n is a, c, g, or t
  misc_feature (94)..(115): n is a, c, g, or t
  misc_feature (124)..(136): n is a, c, g, or t
  misc_feature (138)..(472): n is a, c, g, or t
  misc_feature (479)..(516): n is a, c, g, or t
  misc_feature (536)..(549): n is a, c, g, or t
  misc_feature (552)..(574): n is a, c, g, or t
  misc_feature (582)..(604): n is a, c, g, or t
  misc_feature (634)..(665): n is a, c, g, or t
cccgcgtgcgnnnnnnnnnnnnnnnnnnatacnnnnnnnnnnnnnnnnnnnnnnnnnnnnnnnnnnnnncnnnnnnnnnnnnnncgtcttttcnnnnnnnnnnnnnnnnnnnnnncgcccaccnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8888 - DNA, 668 bp, Diabrotica virgifera
acaagaagatgggattccagtatatacccccgatccagctcctgctctaccaaaatatgcgcaaattcacctgaatgtgtcagaagtatatttaccagatcgttcttcaaaccatagaatcgatatgaaatatgtcgcgtatgatagaagtcctcagatcgtttgacatcaatacccctgacgatggattctcatgaattgaaatccatgtgatccggccaatgcatttaaacctccgcctgagttatctcaaatgctgcctatcattacctccacctcacacttttcattctactcccgcgtgctgacatacctacttatgactatatcttatcccatagaatcctagatgaatcttgatgtgaccactccttatacaaattctggcattatacttggctgcctcctctcataccatctcagcccttaaatatgtatcattgcttatagtacaacctgatcaattcctacatattacgtgctcttccttcgaactgatcttcgtgcttgttccttatctgcttctcttcccgcacccatatcaattgtcttcatactgctccacatatgtgcttcttctttcctccaactattgcatatcctaacgcgcctatagattttcttacaccgccgcggtgagcctcctataggagatcctcagccccagt

SEQ ID NO: 8889 - DNA, 139 bp, Diabrotica virgifera
  misc_feature (8)..(42): n is a, c, g, or t
  misc_feature (47)..(98): n is a, c, g, or t
  misc_feature (100)..(131): n is a, c, g, or t
cccgcggnnnnnnnnnnnnnnnnnnnnnnnnnnnnnnnnnnncaacnnnnnnnnnnnnnnnnnnnnnnnnnnnnnnnnnnnnnnnnnnnnnnnnnnnncnnnnnnnnnnnnnnnnnnnnnnnnnnnnnnnncgaaacgt

SEQ ID NO: 8890 - DNA, 520 bp, Diabrotica virgifera
  misc_feature (205)..(222): n is a, c, g, or t
caatgccctataggcggatcttttttccgtacctgcatatctatatggaagagaggtccgcgattatgggatatctgactgacgcagaatactgttaaataacgaaatgaatccttgttcactgattcggaggagtcaagactagaccattacagtttatctccaataactacaatcttactgttgctgcggagagcacgagtcnnnnnnnnnnnnnnnnnntatgctatcactcagtcacgagggaatactgatgtgtttgttgaggtaccagacctccatatgcattatgatgctccataatggtgttgtgtgacagacagaccgcccatgtgagatagccgtcgaagacagtcttgagacaggcgtgttgtaaatgatctactagagttactacgtgtagggatcattttctgttgtatgcgtagtagtaattgacaatttggaaagctacattgaaaaacttctagactcaactcactacaaacgttgatatagccgttctggtatactttatctc

SEQ ID NO: 8891 - DNA, 798 bp, Diabrotica virgifera
ggtctggaggtccgtgagattttcataaaacccaacattttccttgttagtttttacatgtaatatgtcattaatgtgcgtcacataaacgacagcatctgacagtgacttttaacaacaaattagtcgcctagttcctacttttattgattcctcatatcaacaaaaatgtttactggactcactagtcaggtctcctcatggatgggcagtgttaagggtgatcaagaggaaaaagttccaacacctacagaggacagcaatgtacttgttggttctgagaagaaagaaggaagtccaactaaagcaagcggtggaggaggaaagctagagatgttttcaaatgtgaaaaacaaggttgagggtattggaggttggttgggatccagtattccaaaattaagaaagtcagacaccgataatcctactgatggtcaggaccaaccgcctattgcagaagcttcagaacctcacacttctgaaatccacgcccccaaggacgatgatgataattcaagtgctaccgagggagctgactctggaccccagtctgcggctgaatctcccactgaagataaagatagtcaattcgtaaacgtacaaactaaagctttagcaggcgctaaatcctttggtagatttctttattctgctgtaaataaagctggtaagaccgtgagcgaggcaagtgctaagataaaagaatcagtcgagaaaaatagcatattaggagagttcaacagagaacaagaaacattcatgaaatctcagaatgaaaactctgcctcaccattgccc

SEQ ID NO: 8892 - DNA, 810 bp, Diabrotica virgifera
  misc_feature (246)..(260): n is a, c, g, or t
  misc_feature (622)..(653): n is a, c, g, or t
  misc_feature (785)..(785): n is a, c, g, or t
  misc_feature (791)..(792): n is a, c, g, or t
  misc_feature (803)..(803): n is a, c, g, or t
catctgtttaccggatgcaaaggctccacgagaatcatacggtaactgtaaggttacaggatggggaaaacgcattttacaattgcacgctagaggcgccataatgcaccacatcgatgcacagttgatcgacaagaagcaatgtacagatactgtgaatgagaagttccaagattcagcatcaacgcttaaagatcatacattgtgtgttacatcagagatcgatcagtgcaaggtcgattacgnnnnnnnnnnnnnnngtacaaacgaccaaggtaaatacgtcctatcgggaatatacgcctgggacacaggctgcaaacaggaaggtcaaataggaggctatatcccaacggacgtcacgtgggtcgaagaaagtctaagaaaacctttgaaagagctgagacggttagatagagaatacttgctcaacagcaacaaataacttagcagaaacgaattgttatagtcctttgtagagatataagcattactgaagagaaacaattttatattactgtaaattttttgttatgtaaatacttataataaacatgtgatagatgtattacaaatatcttcggactttatttatttaaggtttaagaatgccagtaacttnnnnnnnnnnnnnnnnnnnnnnnnnnnnnnnncaaaaactgccatattgtctattttgtaaattttctctagctacctactatgttaagtttgtacgaaaattaaaaagggaataaacagcaattaataattttctaccagttttgattttaaatgtagcttanatgttnnaacaaataggntaagtgt

SEQ ID NO: 8893 - DNA, 845 bp, Diabrotica virgifera
  misc_feature (82)..(105): n is a, c, g, or t
aagtgtttttgttaatagttaattatgtagacaatacaacagtagatactggctaatattcggagggatttcagtactgccnnnnnnnnnnnnnnnnnnnnnnnngtaattcactgtatatctacttaaacgagagaaatgtcaaactacgatctttatccgaatagatcatcatcaaatatttgcttgtccaaggctggacatagatctccctcataattctccatctgtttcgatcttgtgcctcttggcacagttggcaaagttttagatcatcagttcaacgtgttggtggacggcctttgcttcggtaggcatcatatctctttggtctccattgcagtatccgctttgtccatctgttatctatcattcgagccacgtgacctgcccagtcccatttcagtgttgctattctctctacagcatcggcaactcccgatcttcgtcacagctagaggtttgggatcttgtctcgcagtaaaacgcacaacataacaagccaattgagccacacggatcttttgcactgttctccctttcatggtcaatgtttccgcttcgtaagtaaacattggcaaaacacactgattaaaggtttttcttttaacgacatattagtatgtcggacgatttcaaaatgaggttcaacttgccgaaggctgcccaagtcagttttatatgagggttgaagctcaacggtttggttatcttttcttatgcgaatctcgtgacctaggtatttctagtgtattacctggtctataaaaatacagtttcctccactaattttatacattggataaatgatatatgaacatttatctactcgaaaaattctgaat

SEQ ID NO: 8894 - DNA, 649 bp, Diabrotica virgifera
atgtttactggcgttccagcgcataaaccgcagttgagagttcaggaaactctcacctcattttgttctcactgtctgcaaccgcatgcatgagaacttcccggccgatagattggacgaggccctccaaaatgtcctgtaccaatgccctggcctacaagaattccaaatttgatagcgctggacaataatgcaatatggggttttcttaaagaggaggttagaaaagatagatatgttttgaatgacgattttagaaacggagttcgccaagcttttacgacgtagcaactgttgtcttcacaggtaggccagggtaataagacaaaaatataccctgttcgtgacacttcagcagccagggtgctgaagcgtttttttgacaagtaatgcctatgggaacaggttgtaactgtttcctgcgtagtatctggcggacatttttatttataaacaattgactgtcggaaaatggtatttttccattgatttgtataaacaggaaagagtaccattatttgacacttgaatgtttataaatgtagaatgttcaaaaattgtacgtacaaccgtagatatatatggacaatagagaaattcgtgttcattggtttctcctgttcaccctaatataatcttttgtaataaa

SEQ ID NO: 8895 - DNA, 378 bp, Diabrotica virgifera
  misc_feature (13)..(42): n is a, c, g, or t
  misc_feature (44)..(94): n is a, c, g, or t
  misc_feature (100)..(184): n is a, c, g, or t
  misc_feature (213)..(230): n is a, c, g, or t
  misc_feature (297)..(332): n is a, c, g, or t
  misc_feature (341)..(362): n is a, c, g, or t
aagacgagagacnnnnnnnnnnnnnnnnnnnnnnnnnnnnnngnnnnnnnnnnnnnnnnnnnnnnnnnnnnnnnnnnnnnnnnnnnnnnnnnnngggtgnnnnnnnnnnnnnnnnnnnnnnnnnnnnnnnnnnnnnnnnnnnnnnnnnnnnnnnnnnnnnnnnnnnnnnnnnnnnnnnnnnnnnagaataaattaccttaggggataaccgcnnnnnnnnnnnnnnnnnnagggtcacatccgaaaattaagagggggggccccccccggtgtgggtgtaaaaaggttttatatttnnnnnnnnnnnnnnnnnnnnnnnnnnnnnnnnnnnngccggcccnnnnnnnnnnnnnnnnnnnnnntgtggggggggtaaag

SEQ ID NO: 8896 - DNA, 383 bp, Diabrotica virgifera
  misc_feature (337)..(355): n is a, c, g, or t
gttctagattgagaattacaaatgaataaaaatagaaaataatacaaaatattcgacttcggatttccatagattcctaaaggagaaatattaacacattgacgaacagtgcgtaaaatgtataagcaagtgttgtgacactaatatgtattttgcacagtagaataggaaaattttttgaatttcttttagcacatggatatagtttgtgaaaacaatgagtttttaacatctttgaaaaacatggggacatgaccatggacatcatgcccatttcttataatctggaaaggaaggggggaaaaaacagaaattttttaaaaaataccgttttttnnnnnnnnnnnnnnnnnnngttaaattcaaggaaaaataaagtatta

SEQ ID NO: 8897 - DNA, 871 bp, Diabrotica virgifera
  misc_feature (91)..(154): n is a, c, g, or t
agagtacccaagacacacacatacgagagataatgtgtatctcgatatataaatcatatcgacacaaatattttgtttgtcttataacagnnnnnnnnnnnnnnnnnnnnnnnnnnnnnnnnnnnnnnnnnnnnnnnnnnnnnnnnnnnnnnnnaaatagagtttgtaaagatgatctctgtatctgtgatgtgggctggagtggtccccaatgtcagcattgtgtaggaaacgttagtaacagtaccacaggaaggagctgtcagcaatgtatgaaaggctactggggaaccactttaaatggagaccaatgtaaaaagtgtcaatgcggtcttgatgctagagattgtaataaaaacactggagaatgcaattgtttgacgaagggaacgattggaaatacttgcgatgagtgtgacacacttaatcattatcatccagataaagataagaataaagcttgttactatgaacttactacagattatagattcacatttaacatatcaaaatcaagcgacaaatatttcacaagaatcaactatgttaactcccccactaaacctgacttggacgtagatgtccggattacatgttcaaagccggcgaaagtgaatctaacagtcaaaactgaaggattggaagaaaaaaccattttggaaagcctccactgtggaatgatcaccacaaaaatttcaaaacatttatacaattttgatgatccacggaatatcagtaccactagattttatgcccatgtctacgattttcaaacccctactgtaatagaaatttccttcagtcagcctccgaaactaaatctggaacaatatgccataactttattaacggccaagttatacagcaaaac

SEQ ID NO: 8898 - DNA, 436 bp, Diabrotica virgifera
  misc_feature (59)..(80): n is a, c, g, or t
  misc_feature (135)..(183): n is a, c, g, or t
  misc_feature (191)..(232): n is a, c, g, or t
  misc_feature (234)..(300): n is a, c, g, or t
  misc_feature (302)..(331): n is a, c, g, or t
  misc_feature (337)..(356): n is a, c, g, or t
  misc_feature (358)..(396): n is a, c, g, or t
ctgaataacagctgagagaaacagaaacttgaactggcttttgtattttgataacaaannnnnnnnnnnnnnnnnnnnnntttagagcattcaatgggacaacttatcaacacaccaggagtgtatggatgcgcnnnnnnnnnnnnnnnnnnnnnnnnnnnnnnnnnnnnnnnnnnnnnnnnnctaataannnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnattacnnnnnnnnnnnnnnnnnnnnannnnnnnnnnnnnnnnnnnnnnnnnnnnnnnnnnnnnnnaaatacttattaggattatcaaatgttcatattctaaaat

SEQ ID NO: 8899 - DNA, 174 bp, Diabrotica virgifera
  misc_feature (2)..(173): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 8900 - DNA, 828 bp, Diabrotica virgifera
  misc_feature (749)..(749): n is a, c, g, or t
  misc_feature (767)..(768): n is a, c, g, or t
atcagtggacacaagatgcggctacatattaaaatctttttgttttgtgcttttgttcttgcaggtattaactgcattcccgacatccccatcgcgctaaagaaagactttttccaaatctacaaaggactcgcagtagaagtaaagcaactcactggtggtaatgtcaccctcgacaagttaacctttacccactttgagaggaaacatcgggaaaatggtacggtattagattcttcaaacctggaagacgttaagtacgccaaagagaagatcgtatttattttacatggatgggctagttctgccactgtggattgggttttggaaatgaaaaatgcgttcctggccatttatccgaatagttcggtgattacaattgattggagtggaccggcatcacagccttactcaatatcttctattaatacttacgatgttggaaatttcatggcggatatgattcttgacctgataaataagcataatgttgatattaagaaattccttctggtgggtcactcactcggaggacaagcttgcggatttgcaggaaaaaaactacaatcagtaggtaaaattttacccagaattattggtctggatcctgccggtcctctgttcagcattaggccaaaagacaaaaggttaaattccgaagacgcagaagttgtagaggttattcattctgatgcaggaagattcggatttgaccatccctgtggtactatcgacttcttccccaatgnaggaaaatggcaacctgnnatgcagagaatcgatttgcttgatattacgagtgtcgctgatccagttacctgtgatcat

SEQ ID NO: 8901 - DNA, 333 bp, Diabrotica virgifera
ggctgtttgggcttcctcattttcaacttcctgtttcttatattcttgtgctttatctaacggatttccttgaaatatatcatcaaagcggtctcatcttataactttctgttggcctggcggcttctgcatgcaccttctgttggattctgttgacatatttatttttaacagcaattctaacttgattcctgtaccttgcaggactcatgtaacttgctttttcctatagagccgcaccttcaaatctcccaaagatttatattcatgggtatcaaatacacacaatgaacataatgggaacaatatattattaaatgataatactatgaa

SEQ ID NO: 8902 - DNA, 678 bp, Diabrotica virgifera
  misc_feature (2)..(591): n is a, c, g, or t
  misc_feature (598)..(598): n is a, c, g, or t
  misc_feature (607)..(648): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggnttggatgannnnnnnnnnnnnnnnnnnnnnnnnnnnnnnnnnnnnnnnnnttagtaaaagcttaatttttttaaagacga

SEQ ID NO: 8903 - DNA, 842 bp, Diabrotica virgifera
  misc_feature (699)..(699): n is a, c, g, or t
  misc_feature (761)..(761): n is a, c, g, or t
attttgccgatacctgtctggttttgccaggttttggtatgaatgctacccttgttgatctccatgcctttagtatgtagcccagtccgatgcttcgcctgaagtaacatactcatttgttgtacaaagagtctgttccatttcgtaacaataaaatgattcttcagttatcaaaaattctattgtttcactcgtgttattaccgatgatccaattctgacattgaagtcatctggaaattattgccaactgcttttctgtatccatcacatcttgcagttaatcgtacaacttttctatccccgtttttctggcttgcaatcttctggggcgtataactgttcattctcattttgactattgctatatttgaaaataatattaaaatcactatatttgtgatattcactaattgctacttctgctaattcattaactgcatttaaaaacatctgctagatgttagggcgaaaaaatatctttaattgaatatgttttataacagaaaactgttaaataacttcaatttcaaatatatttttatagaatacaacaactatttgatgtcatcatttaaaccgatcaaaacgaaaacattattaaaagttgctttaatcaattcacaacaaatctccataatgtctctgaaacactttcgttaatatttttaaaacactttttcatctcttaaatttttgngatcttcaaaacacaactaattgtgtgcattttgtaaatttttcagtattcaacttgattcnaaaatgtttccattacatgtttaaatgttaaatacactgtgatattataagtattttcaataataaattagtcattttttt

SEQ ID NO: 8904 - DNA, 356 bp, Diabrotica virgifera
  misc_feature (166)..(190): n is a, c, g, or t
gccagctggttatgtaggaggttatgtctgaggtgcgatatgttttgagtgagcttatattagagttactgttgctgacctcgaccctgaacgaatagcccagcggaactctcagagacttccaatttatgagcctggctatgaaccatgtattatggaagagagnnnnnnnnnnnnnnnnnnnnnnnnntgtcatgattggtgtgaataatagaagcacaatcattatttcatattgttgagtgttgcgagatgttatccacgacaatttatatgaaattctacaagaaatcaagtacgattaatttgtttctgatatagtcttcactcaatatcttaatattattttgtattca

SEQ ID NO: 8905 - DNA, 568 bp, Diabrotica virgifera
  misc_feature (429)..(448): n is a, c, g, or t
cgtttcccaaagttcacaacaccctgtggaatattctagcatttataaaatactgaaatttaaacccaactatagtctcaggttttcttaacattctgtttgatttatttgcttatgttggataataaaaaagttaggtattttaacaactagccatgttcttcatcaatacagggtgtttctaaagaagtgcgtcaaactttaacgtgcaattctgcatgaaaaaattgtgaacgtttgctttataaacctatgtctgcaaatgcttcgtttccgcgatacatgatgctgaattttttcttacatactgacgatttatttattgctcttaaaacctaccatggctgcataaaatattatgtttgtggaaattttaaatgatcacatgatcacaacgcatgcagtatttaagataatggtaaagtggcnnnnnnnnnnnnnnnnnnnngaagagtgatttttctaagattatcaatagttttctttgtaaagtgttaaaataccaaatatacttttatataattatttctattatcaagtttagtgaatatacatatttaatatattg

SEQ ID NO: 8906 - DNA, 112 bp, Diabrotica virgifera
  misc_feature (5)..(85): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnaagacgagaaacccctatagagtttta

SEQ ID NO: 8907 - DNA, 637 bp, Diabrotica virgifera
  misc_feature (126)..(146): n is a, c, g, or t
  misc_feature (225)..(244): n is a, c, g, or t
  misc_feature (309)..(357): n is a, c, g, or t
  misc_feature (497)..(517): n is a, c, g, or t
cccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctggacacagatattctgaattgccaatattatcatc

SEQ ID NO: 8908 - DNA, 272 bp, Diabrotica virgifera
  misc_feature (11)..(130): n is a, c, g, or t
  misc_feature (133)..(228): n is a, c, g, or t
  misc_feature (240)..(258): n is a, c, g, or t
gttggatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttttgnnnnnnnnnnnnnnnnnnntaagggataacagg

SEQ ID NO: 8909 - DNA, 470 bp, Diabrotica virgifera
  misc_feature (214)..(235): n is a, c, g, or t
  misc_feature (250)..(271): n is a, c, g, or t
  misc_feature (310)..(346): n is a, c, g, or t
atttgtgtgacataaataaatgattttgtaataaacgaaagaaaaacttattattaccgccctataggaagcattggctttatgatatactgttttatagcggagggaactattcttactcatgctgaaatagtagcaaataatttgctggaagccgattatagaggacactacagccatggaatgaatagattataaatgtaccttataggannnnnnnnnnnnnnnnnnnnnnctagtatggagatgnnnnnnnnnnnnnnnnnnnnnntattgtttaagatattgattacatttatttattagcagnnnnnnnnnnnnnnnnnnnnnnnnnnnnnnnnnnnnngacatatttttggggatgagattaagcataaaattttatgctaatataattgtctaaataaaaattaggttttagagaatttcatatcataaaatatgtgatgatgcagtatcatatattacta

SEQ ID NO: 8910 - DNA, 482 bp, Diabrotica virgifera
  misc_feature (23)..(104): n is a, c, g, or t
  misc_feature (106)..(182): n is a, c, g, or t
  misc_feature (188)..(236): n is a, c, g, or t
  misc_feature (238)..(278): n is a, c, g, or t
  misc_feature (297)..(327): n is a, c, g, or t
  misc_feature (329)..(381): n is a, c, g, or t
caaacatgcccttttgtattacnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnngttacnnnnnnnnnnnnnnnnnnnnnnnnnnnnnnnnnnnnnnnnnnnnnnnnncnnnnnnnnnnnnnnnnnnnnnnnnnnnnnnnnnnnnnnnnncatttattaaattgggggnnnnnnnnnnnnnnnnnnnnnnnnnnnnnnncnnnnnnnnnnnnnnnnnnnnnnnnnnnnnnnnnnnnnnnnnnnnnnnnnnnnnctttgggataacaccgaaatttcttggggaagttaaatcgcaaaaaaacatgcccgccccccccgcggccacttactcgttttatattcttgttccccccc

SEQ ID NO: 8911 - DNA, 73 bp, Diabrotica virgifera
  misc_feature (6)..(67): n is a, c, g, or t
gggggnnnnnnnnnnnnnnnnnnnnnnnnnnnnnnnnnnnnnnnnnnnnnnnnnnnnnnnnnnnnnntttttt

SEQ ID NO: 8912 - DNA, 451 bp, Diabrotica virgifera
tggaatctgaagaactttaattctaagagggcatgtttttagcaaaattactgaacaattgtgttgactgtttgaccgattccacattgcgtcataatattatattatccagacagccacacctcgttgttggaccccgagtagcaggtattattagtcctaggatatatatctattaggagccactctagtaaagatcacaaatgcagaatcggagtaccaagttttattttaattcctcgtctcgccgggatttgctgttctctactaaatatatttaattcttgaacacgaactgatcatttcattattaatcatatctttacatatagctattcgtagtttatgtgtgttattctcttccaccgcagagcgtatctatatagaggtatcaggccctcttgggagcgtaaatattccgcattacaaaattcgcaggcgccaagaccgg

SEQ ID NO: 8913 - DNA, 505 bp, Diabrotica virgifera
  misc_feature (13)..(50): n is a, c, g, or t
  misc_feature (261)..(281): n is a, c, g, or t
aaagggccaatannnnnnnnnnnnnnnnnnnnnnnnnnnnnnnnnnnnnnccttgattttttttccccccccttcaaaggcgggcagggatctaaggatacccctgcccccgggatctgaaagggacataccccccccccggaagtatttcccccagggggggcccacccccactttattcccaaaaaaaggggggcccccagttttacccaacatagcgaaatattcaatttcggattcccttaggggaggaggggtgtnnnnnnnnnnnnnnnnnnnnnatttcccttgccccaaggtttttaaggcctgcttgtaccccaaacaatatttgccaaatttctttaccaaacccaaacggggggggaaacttccaaccccctccttctgtttctttggggcaccctttttactgatttataaattgcaaagggctgaaaataccgcaaatctttaaggaaaaaaaacttccacccccccttttcaagggggttctaaatcccga

SEQ ID NO: 8914 - DNA, 1098 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (801)..(841): n is a, c, g, or t
  misc_feature (853)..(853): n is a, c, g, or t
  misc_feature (861)..(901): n is a, c, g, or t
  misc_feature (903)..(938): n is a, c, g, or t
  misc_feature (969)..(1027): n is a, c, g, or t
  misc_feature (1036)..(1082): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaannnnnnnnnnnnnnnnnnnnnnnnnnnnnnnnnnnnnnnnngctcatccctanaaatattnnnnnnnnnnnnnnnnnnnnnnnnnnnnnnnnnnnnnnnnngnnnnnnnnnnnnnnnnnnnnnnnnnnnnnnnnnnnnaagatatatttaaaaaacgaataaaatttcnnnnnnnnnnnnnnnnnnnnnnnnnnnnnnnnnnnnnnnnnnnnnnnnnnnnnnnnnnncttcttttnnnnnnnnnnnnnnnnnnnnnnnnnnnnnnnnnnnnnnnnnnnnnnnccccgcgaaaaccaac

SEQ ID NO: 8915 - DNA, 651 bp, Diabrotica virgifera
  misc_feature (2)..(50): n is a, c, g, or t
  misc_feature (52)..(546): n is a, c, g, or t
  misc_feature (567)..(584): n is a, c, g, or t
  misc_feature (586)..(648): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtccccttgtattaaacnnnnnnnnnnnnnnnnnncnnnnnnnnnnnnnnnnnnnnnnnnnnnnnnnnnnnnnnnnnnnnnnnnnnnnnnnnnnnnnnncta

SEQ ID NO: 8916 - DNA, 494 bp, Diabrotica virgifera
  misc_feature (221)..(238): n is a, c, g, or t
  misc_feature (254)..(297): n is a, c, g, or t
  misc_feature (299)..(352): n is a, c, g, or t
ggagaaacaacccttccattggatcgtgtaagctagaatatttggattgaagtattgggtttcagaaacctgtgttcaccatgggtgccacattcgctaacaacggaacaaaaacccattcgagtacgtctttctgagtaatatttagagcgttttcgaaagaattaagcagattttgtgtatcgattcatcactatgtatgtgttttgtaagaaacatgnnnnnnnnnnnnnnnnnnctgagatgttattcgnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnngagggacgattattaaaaagatattttattatggtttgttttggcataatagctaggatcaatattttccttattaaatacatggtatcatttattttgatgtattagtatcttgatctgttatatatgcttgatgaaaata

SEQ ID NO: 8917 - DNA, 595 bp, Diabrotica virgifera
attataatcatcagtcttatgttttaatttttgatgtagctcctggaattagatgttgattataagtatcaaatacgggaaattcttcctgagccctttaactatactgactatctactatcatgcatcataaagggactcatatatgatcatctctttcatattactacagtggagaacatgtaccagcagagtgattaaaaaatcactgtatctaagcaagaagcatatgcagaatactcttgcatggatgttcgttacctaggactcacctcattacaatgatattattatgagaaggatatatagtatagcaatgttcttgacttctggactactagcaaaatatgcaactatgctgtgcgggaataatatgtgctacatccacccaatatcaacgatgtggctctgttgatgatctgttgcttgaatagtacctaccgctcaaagaaataccattgattgtagatatgctgtaggaaatgaacttcttctaccgtacaatacataatcagcactaggaactgatgaatcctgcctatccttcttatccatcttctactaggatgcctgcaaatgtaactgcgtccgattg

SEQ ID NO: 8918 - DNA, 972 bp, Diabrotica virgifera
  misc_feature (175)..(194): n is a, c, g, or t
  misc_feature (628)..(644): n is a, c, g, or t
  misc_feature (724)..(724): n is a, c, g, or t
  misc_feature (826)..(826): n is a, c, g, or t
  misc_feature (888)..(888): n is a, c, g, or t
  misc_feature (909)..(910): n is a, c, g, or t
gcttgttattgaaaattattgttttgaatcaaaagaatgctaaaatagtctgcaaaaatgactatagaaactttagaaaacgacaatataattttagccactgggggctacgaccataccataaaattgtggcagacgcacacaggaatttgtactagaactctacaacatgcannnnnnnnnnnnnnnnnnnnagaaataactccagaccgacagcatttagccacagccagttaccagcatatatacatgtatgacttaacttccaacaatccaaatgccattgttaactatgagggaacatccaaaaatgttacttgcgttggcttccaggaagacggaaaatggatgtactcagggggtgaagacagtagagcgagaatatgggacttgagatctaggaacaaccaatgccccaaaatattcgaagtacaaagtgctataaactgcgtagctctgcatccaaatcaagtggaattgtttgtcggggatcaaaatggtatcatttacaagtgggacttacggactgatcataacgaacaacttatacctgagaatgatgctatgatcttggatgtggaagtatctcctgatagccaacttatggcttctgtaaacaataaaggcnnnnnnnnnnnnnnnnntttgatctccggaatgattgacactccaacaaagatgataccaaaacagaaattcgaggcgcacacaaggcacacattanagtgtaaatttagtccagattcaaatatgttggtaacaacttcagctgatacaactgctcgaatatggaattgtgccgacttcagcctattacaagaattanaacagccagagagtcagagatgggtttgggatgctgatttcagtgcagatggccaatacatntttacagcttcttctgatggnntgtgcagactgtgggatgtcaaaactggagcgatgggaaagggattacacagggcatcaaaa

SEQ ID NO: 8919 - DNA, 545 bp, Diabrotica virgifera
  misc_feature (13)..(91): n is a, c, g, or t
  misc_feature (93)..(317): n is a, c, g, or t
  misc_feature (485)..(528): n is a, c, g, or t
ctattttgacccnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggaaaccgggtaattttaatgggaaagttccaaatcgataataaaaatttgggacccccatgttggaattaagtttataattgggggagcaagttaatttttaaggctggtccgattttaaaattttaactggatctgagtttaaaccggggggaggcccggnnnnnnnnnnnnnnnnnnnnnnnnnnnnnnnnnnnnnnnnnnnncagaaaggggcccaaac

SEQ ID NO: 8920 - DNA, 871 bp, Diabrotica virgifera
  misc_feature (679)..(679): n is a, c, g, or t
  misc_feature (709)..(728): n is a, c, g, or t
  misc_feature (835)..(835): n is a, c, g, or t
caaacatttctctaaaaattttggaattttgacacgctgaataggcaggaagtgcggtgcaaattataggcccccccatgtctccttttattcagcattcgtttggtttgcaagtcatagaaatcacgaaggcgtaactagaaacttggtctcattagagattttatttctccggaaataaaacttcgaattgttttaaacagatgtcgctgtatgttttaaacagatatatcgaattattatgtcgtgattcggtactgatacgatacgtggttggtttcggttcgttaagagatagccatatatacagtctctgaagatctctaatgatctacaaccaataagggtatttatggcgctataagacgtattatactgaaatataatacgtctcttgcagaatgtagttcttcaaaatcttctgcttttaacgattttcattagtgtttacgtctattttttaaattcctgcttctaacttcgttctttgcacatttaggtaaatagctacattggcaaataagaaagaacgcttattttctataattgaaaatggtctattttaaaagattctggaactaactataacttcttattcttatacattgccgtaacacaaaaatatccataaagtcagtaaaaatagttacaagcagtggcgacgcgtgactttttctanagtgttaccaaaaccagatgcaaaaaatcnnnnnnnnnnnnnnnnnnnnatggctaaagcttcaataatatcattttgttcatcacttgaaactctcgaaaaaacagttgatgtttctagatgttggcaaaatgtttgaccttttttggtaacttngtaaagtataataaagtgcaactgagtcacataact

SEQ ID NO: 8921 - DNA, 203 bp, Diabrotica virgifera
  misc_feature (16)..(125): n is a, c, g, or t
  misc_feature (129)..(129): n is a, c, g, or t
  misc_feature (137)..(172): n is a, c, g, or t
  misc_feature (182)..(183): n is a, c, g, or t
  misc_feature (195)..(195): n is a, c, g, or t
aaacatgtcttcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtntggatgannnnnnnnnnnnnnnnnnnnnnnnnnnnnnnnnnnntaatttttanngtaaaaagcttnaaattttt

SEQ ID NO: 8922 - DNA, 539 bp, Diabrotica virgifera
  misc_feature (344)..(361): n is a, c, g, or t
  misc_feature (437)..(456): n is a, c, g, or t
  misc_feature (520)..(537): n is a, c, g, or t
ccttattctgccaaaaccacccacccaaaatcctcacctcctgtccactacatcaaggaacgaagatcccagtacgagtccggacctcgtttctcaatgaccaccccgtcggccctcctagacggtttcacaccccttcctttcacccggtcaaccacaaactatccccccctttgtgcctacatgcacccgaatccccctcctctccccttgctgctatattttcacttccccccatacacaataccccttccccaccccctcctctcaccgcatccccatccttaggctctctaatgcccccctttctctccctcctcttgacatcactgcccgcagcaatnnnnnnnnnnnnnnnnnngtcaatccccccgcccatcgcccccgaccactacccatatctcctaaatcactgcgtctcttagtcactcgctatnnnnnnnnnnnnnnnnnnnntcttacctcaagctctctccatcctcccctcctcctcccccccccggccgtccctccccctctnnnnnnnnnnnnnnnnnntt

SEQ ID NO: 8923 - DNA, 1004 bp, Diabrotica virgifera
  misc_feature (2)..(579): n is a, c, g, or t
  misc_feature (581)..(841): n is a, c, g, or t
  misc_feature (969)..(989): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaggaataaccgcgaattttttttgcagaggtcaaatcgaaaataaagatggcgaccccccagggtgggattaaaggttttaaattggggggaggagccaatttttttttaagatcgggtcccccnnnnnnnnnnnnnnnnnnnnntttggggggttaaaa

SEQ ID NO: 8924 - DNA, 250 bp, Diabrotica virgifera
  misc_feature (83)..(129): n is a, c, g, or t
cggacgcgtgggtgaggatccaatatatacataacatccatccacaaatatgtctaaaggaaggatatttaatgtggagaaannnnnnnnnnnnnnnnnnnnnnnnnnnnnnnnnnnnnnnnnnnnnnncaccgaggattatcagataataataaaatactcatatatagaactaatctgggcactaatactgtaatctattctattgctgtatttctagtacgcacatcagaaagaatatgggtagagc

SEQ ID NO: 8925 - DNA, 218 bp, Diabrotica virgifera; identical to SEQ ID NO: 7300
  misc_feature (6)..(28): n is a, c, g, or t

SEQ ID NO: 8926 - DNA, 80 bp, Diabrotica virgifera
  misc_feature (6)..(41): n is a, c, g, or t
  misc_feature (43)..(77): n is a, c, g, or t
aaagcnnnnnnnnnnnnnnnnnnnnnnnnnnnnnnnnnnnngnnnnnnnnnnnnnnnnnnnnnnnnnnnnnnnnnnnatt

SEQ ID NO: 8927 - DNA, 218 bp, Diabrotica virgifera
  misc_feature (27)..(64): n is a, c, g, or t
  misc_feature (84)..(97): n is a, c, g, or t
  misc_feature (100)..(114): n is a, c, g, or t
  misc_feature (124)..(124): n is a, c, g, or t
  misc_feature (131)..(152): n is a, c, g, or t
  misc_feature (187)..(210): n is a, c, g, or t
cgaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnntattaagtcntgtcgannnnnnnnnnnnnnnnnnnnnnagtttaaacggtgggagccaggttggtttctatcnnnnnnnnnnnnnnnnnnnnnnnncgaaaaga

SEQ ID NO: 8928 - DNA, 65 bp, Diabrotica virgifera
  misc_feature (8)..(61): n is a, c, g, or t
gtttatannnnnnnnnnnnnnnnnnnnnnnnnnnnnnnnnnnnnnnnnnnnnnnnnnnnnntatt

SEQ ID NO: 8929 - DNA, 715 bp, Diabrotica virgifera
gtgataaagtcaactgcctataaatttaagatgagaaatatccagaatttcttccgcgttcttctcgttctacattgttatttagtcatactagttgagccttcctataacaatgaattggtgccagaaggttaccaaaccaactatggaaacccttatactgactatccctacagatatgcaactaatggtaacatttatacaactgacgtgtatggactaacttccgtactacgatctggatatgctagaggttattcgtaccaaacctacaaagcaaacccatccgctggtcagtcgcacagatctgccagtactaatgatgtttatgtaaccgaccaatatggaaggactacactacaatctggaagaagtgcagttcaatctggagacagcaatagaggctatagatatcaatcctactacacaaacccttccgttggccagtcctacagatctgccagtaataatgacgtttatgtaaccgatcaatatggcagaactacactatcatctggaagacctggttattcgtatcaatcctactacggaaaccgttacgctgaccatgcctaccgatctgccagtaataatgacgtttatataaccgaccaatatgaaagaactacactacaatctggaagaactgcagtacaatctgaagatagtaatagaggttatttcgagcaatcctactacagaaacccttatgctg

SEQ ID NO: 8930 - DNA, 832 bp, Diabrotica virgifera
  misc_feature (255)..(273): n is a, c, g, or t
cattcacaaaaaaaattaaaacctgcttttatttcattggtgttttttatacataactgcagctgcagcagtgatgttaaaactattcttcaatcttttaaagcttgttgtaggttcatttggtaccttttaggaaaccgttcatgataaatttttctgataacgcatttttattacattctaatttagacacctaattagtaatttgcttgaaagatgagaatatctcaaggactaataaatttagatacaggnnnnnnnnnnnnnnnnnnncagtatagatggcaattttcaatagtgacaaaatatagggtgttctatttaaaattactaagaaaataatctacttacttaccctgtattcgaggtaaagaaaattagcaatatccatcatttttgaaaattttggcgtcaataaagaatatgaaagtaataggccattgttattgtgctgatttctatgatttgaatgaatcaaaacataggagttgaacttgttacgatttttatagaaaattggttataactttataaatgccctgtataacataacaaaactttatataattgtactggggaagtcaagaagattttgaatataaaataaaatacagagtgttccattaaaaaaaacataaatttggtctgccagactatgttgaacaccctgcgacattctaactaattttataatgtgaacctcaaatgggtcgaaattgaatttttgttattaacttttattgctatccattgttgtgacggatctgctgagctttatcacactaaacatcaccctgtatgttctatagattgttcgtagttgatcagcaca

SEQ ID NO: 8931 - DNA, 328 bp, Diabrotica virgifera
  misc_feature (23)..(53): n is a, c, g, or t
  misc_feature (60)..(83): n is a, c, g, or t
  misc_feature (132)..(152): n is a, c, g, or t
  misc_feature (175)..(211): n is a, c, g, or t
  misc_feature (226)..(244): n is a, c, g, or t
cccggctccccccacgcccccgnnnnnnnnnnnnnnnnnnnnnnnnnnnnnnnctatttnnnnnnnnnnnnnnnnnnnnnnnngttaatgttattaatattgtgaggaagataatatatattttatcaatcnnnnnnnnnnnnnnnnnnnnncctgtgacctatgtgtgatcacnnnnnnnnnnnnnnnnnnnnnnnnnnnnnnnnnnnnncgaattatctaaagnnnnnnnnnnnnnnnnnnnattgcaatatacatatttatataaattgttctggaaagtgatgtcgtatcttcgcctcatatacaatatctacttatattgtat

SEQ ID NO: 8932 - DNA, 792 bp, Diabrotica virgifera
  misc_feature (2)..(766): n is a, c, g, or t
  misc_feature (783)..(783): n is a, c, g, or t
  misc_feature (788)..(788): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatataatttatttanttggnggtg

SEQ ID NO: 8933 - DNA, 677 bp, Diabrotica virgifera
caataggtatggcctctgcgaaagatacggctacgttctttactcacggcacctgtcaacatttcgagcaggtcctcaagttatatccacaagcccttcgattgaaagctgatagaaaagccaaaaagcccgaggaactgattaaattagacaattggtatcagaatgaactaccgaaaaggatcaaaagtcgtggcaaagatgcccacttagtacacgaggagttggtacaatgcatgaaatggaaacagaccagggggaagttcttcccccaattatcgtatttggtaaaggttaacactcctagagctgttatggcagaaacgaagagagcctttagaaaattgcccaatcttgagttggcgatgtcagcgctctcaaatttgaaaggagtcggtaccacaatggcctcagcattactggcggctgcttgtccagacagcgccccctttatggcagatgaatgtctgatggccataccagacatcgaaggtattgattacaccaccaaggagtacctgaaattcgccaaccacatcaaatccgtcgtcgagagattaaacaaggccgcagaagaaaggtcagaggctgtacgttggtcgccacacaaggacgagttagctctttggacacctacgttgtctccgaacacaaaccagagttgctctctagtattt

SEQ ID NO: 8934 - DNA, 83 bp, Diabrotica virgifera
  misc_feature (9)..(38): n is a, c, g, or t
attactttnnnnnnnnnnnnnnnnnnnnnnnnnnnnnnaagtatagttgacaaatgatggtgatgatgaacatgtttattata

SEQ ID NO: 8935 - DNA, 804 bp, Diabrotica virgifera
  misc_feature (312)..(330): n is a, c, g, or t
  misc_feature (512)..(533): n is a, c, g, or t
cataaattttccagccaggaaatctttcgccttcctggtccccgtttgccttctaattttccctgtaaaattagtttcagcagtccatatctctcggtgttcatcatactcttaccgaagtattcgattttggctgtttttattctggttagcagctgttattcattttgtattcttaataaaacgtcttgattagtaatgtatgattaataatgtatatgttccttccagttattttattgttcgagaagccttaaatgttattttatttgcaaagcactgtttatttgtcttattataaattcttctttnnnnnnnnnnnnnnnnnnncttcctgactagacaatcagtagtacttaaatttttagatttcagttttataatgccgatttttattatttacgaaacttctccattctgtattgtcatattagacttgtgcaaactttatattattaattagccgggttcgaatttttggttatatctgcattcattaaatggtatatttnnnnnnnnnnnnnnnnnnnnnnctatttgatcatctggataaacacaaaatgcttcccgcatattcttacatactctcttatagtataatatactatatttacatattatgtaatattgtattcttcttcatattatattctagcttcagtggttgttggcagtccttttttcatgtattattatgtaggtgtgtttaaattcacgtgtttttacatatttattaacttttgtccttaaattctctctttatagacagctctataaggcgccatttattatctgtcaaaatat

SEQ ID NO: 8936 - DNA, 528 bp, Diabrotica virgifera
  misc_feature (2)..(33): n is a, c, g, or t
  misc_feature (39)..(40): n is a, c, g, or t
  misc_feature (56)..(77): n is a, c, g, or t
  misc_feature (90)..(90): n is a, c, g, or t
  misc_feature (100)..(100): n is a, c, g, or t
  misc_feature (104)..(104): n is a, c, g, or t
  misc_feature (129)..(167): n is a, c, g, or t
  misc_feature (169)..(261): n is a, c, g, or t
  misc_feature (263)..(278): n is a, c, g, or t
  misc_feature (439)..(513): n is a, c, g, or t
tnnnnnnnnnnnnnnnnnnnnnnnnnnnnnnnngctggnnatgagggttggatgannnnnnnnnnnnnnnnnnnnnntttataagaattntatttttaangtanaagcttaatttttttaaagacgagnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnngataaataccctaggggtacagcgatttttttttgggaaggtcaaaccgtatatgagtgggccccccccggtggggttaaaggtttttatttggggggggagcctaatttttttaatttggggcccccctttttaaatttattagtattcgggggggaaannnnnnnnnnnnnnnnnnnnnnnnnnnnnnnnnnnnnnnnnnnnnnnnnnnnnnnnnnnnnnnnnnnnnnnnnnnggggggccggcccgc

SEQ ID NO: 8937 - DNA, 909 bp, Diabrotica virgifera
  misc_feature (15)..(623): n is a, c, g, or t
  misc_feature (625)..(726): n is a, c, g, or t
  misc_feature (728)..(746): n is a, c, g, or t
  misc_feature (753)..(804): n is a, c, g, or t
  misc_feature (845)..(903): n is a, c, g, or t
caggacgcgtagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnngagggannnnnnnnnnnnnnnnnnnnnnnnnnnnnnnnnnnnnnnnnnnnnnnnnnnngtaaaaagctaaatttttttaaagacgagacgacctatagnnnnnnnnnnnnnnnnnnnnnnnnnnnnnnnnnnnnnnnnnnnnnnnnnnnnnnnnnnnggggtg

SEQ ID NO: 8938 - DNA, 550 bp, Diabrotica virgifera
  misc_feature (315)..(339): n is a, c, g, or t
  misc_feature (372)..(392): n is a, c, g, or t
aagtttgacaatctataactttattatttgtgctccgattttcaggaatcttgcatcagtttgtaggtacatgcattgatttcgtttgatatttttccggtaacaaaaatttcctgcttatacggcatcatacggggatgaatggaagcggtgtactttctctcaactctaaaaaattctgtgaaaaaattggaggattgattttgttttatactccttttgtattatcctggaggtatcactaaggttttgttctttgaaccatccgaacatctcccctcttggaagagctgtaaataaaaaactgctttgaannnnnnnnnnnnnnnnnnnnnnnnncgcactaatgttaacaaaacataattatcgacnnnnnnnnnnnnnnnnnnnnngcgctctatatgattgaatattatcttggcgtgattgcaacactataatgcttctaaactgcatctgaatgcaaatcactggtcgtcattctaccactattagactgctaaaaccctgctctaacgcatactaattatctagtaacccatcttccttt

SEQ ID NO: 8939 - DNA, 185 bp, Diabrotica virgifera
  misc_feature (2)..(105): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgaatggccgagatatgttgaccgtgctaaggcagcataagccttaggttttttattgaaagctgttatgaagggat

SEQ ID NO: 8940 - DNA, 835 bp, Diabrotica virgifera
  misc_feature (670)..(670): n is a, c, g, or t
  misc_feature (675)..(675): n is a, c, g, or t
  misc_feature (716)..(717): n is a, c, g, or t
  misc_feature (735)..(735): n is a, c, g, or t
  misc_feature (742)..(742): n is a, c, g, or t
  misc_feature (765)..(765): n is a, c, g, or t
cttctgcgctcgtgagaaatatatcttttttctcacttgttgtacaatatactattctgaatgttaaattgattatgctactcaacgtaattttcgttctaaatcacttctctgtaggttctaattagttcatatttattgtataaagtatattccttaaaatcatctgactcaacttcgtcgagagcaacttcagcgcgattataacattctttctcttctttttctactgcagagtttgtacaaaaatttggacagtttacaccacttattttacagtcccatcttgtatctttgaaacctgttaaaaatgtatgtgttgtatttgtttcaaaatctctttataaatctgaatatctaatataatgtgtacttacttattttatcaactttctttaaatataaatctcaattacaaaaattcatcaagtttcttaactggatcaccctatatggtatgacgttattggaaaagtttaactgctctaagttttgttaactgcttttagacttcgggcggatctgttttgcggaggatgtaagaggtggcattctaattgcaggaaaagttgtgtcataacttcaataatattaattgacttcgtcaacttataatacaagcaatatataagtcaagtaacttgtgaagcggtaacaattattttcattntgtgngatgctaactaaggtgtgatttttacgatttttttacccannaaagtgtccaactttatngtgagcngtacatagttaatattgaatatntatgctagaaactaaaaaataacaaaatatagcttttttaaaacattaaaaaagtgtgatgacttcttct

SEQ ID NO: 8941 - DNA, 73 bp, Diabrotica virgifera
  misc_feature (13)..(13): n is a, c, g, or t
  misc_feature (20)..(71): n is a, c, g, or t
ggaatggaggggntggatgnnnnnnnnnnnnnnnnnnnnnnnnnnnnnnnnnnnnnnnnnnnnnnnnnnnngc

SEQ ID NO: 8942 - DNA, 521 bp, Diabrotica virgifera
  misc_feature (98)..(123): n is a, c, g, or t
gcaaaacacgtagccgatcccaatgtccaagctgtagaatacttctactatttggcagttagcaaattacccaattggtccagaggtgaattccacannnnnnnnnnnnnnnnnnnnnnnnnnctactaatgacaggccgtattatccaacagggataccattctttatatacggcgaatctggtcactagttccgcattcctcgtagtaactggagagcccaggctacaacaatagagagcttttgtgctgagtacagacgtgacgattttgatttgcttactccattataccgaaaatggaaaattcgacttaggatccatagaataagataagcatccaatatctggaccaagaactcttccttacagaaacccatgaagaggattcatttgatattttaagacctgggccatttattagcgcggaatataatttcccgtcgatttccaaactgtttgttatggtgatgatatatgtgattccgaatgtgacgacaagattttcatcccattgttttt

SEQ ID NO: 8943 - DNA, 121 bp, Diabrotica virgifera
tctggcaacaacttgtgggttggaagatagttgagctcttatagtacgacaatggtaccattaccactttcatggagacccacaattcgacggtgatgaaattaagtgtatatccatggaa

SEQ ID NO: 8944 - DNA, 816 bp, Diabrotica virgifera
  misc_feature (5)..(807): n is a, c, g, or t
cgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagc

SEQ ID NO: 8945 - DNA, 527 bp, Diabrotica virgifera
  misc_feature (5)..(84): n is a, c, g, or t
  misc_feature (90)..(166): n is a, c, g, or t
  misc_feature (173)..(228): n is a, c, g, or t
  misc_feature (232)..(259): n is a, c, g, or t
  misc_feature (299)..(316): n is a, c, g, or t
  misc_feature (337)..(354): n is a, c, g, or t
  misc_feature (392)..(410): n is a, c, g, or t
  misc_feature (473)..(503): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnncgaagnnnnnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnncccnnnnnnnnnnnnnnnnnnnnnnnnnnnntaagggaaaaagccgaaatttttttggggaagtttcaaannnnnnnnnnnnnnnnnncccccccccatgtttggattnnnnnnnnnnnnnnnnnngggcacaaacctaattttttttaaactcgggtcccccnnnnnnnnnnnnnnnnnnntgtgcctcccggcgcgtaaaaaacacggggggggggtgcccccggagggggggtccctctcannnnnnnnnnnnnnnnnnnnnnnnnnnnnnnctttttttctttcctctccacgcc

SEQ ID NO: 8946 - DNA, 644 bp, Diabrotica virgifera
gctacacgctaatatagagtctctttttttatattgatccgagtgaaatacgaacccaaacatgccaaataaggataattctcctatatggtgaaccacctgaattttggtttgaaatagtggatgctgattacgctgcaacctttcattggagaatatgtattttatgttgatgcattccttcatgaaaaggactataattaattttattccgaaaacgtagatgaaaaatactattgaatggtagcgaagaatttgtacaaatttctgtcttcataaggatattgttacggacagtggaagacaatttgactgtcatgattgatagcgctactatgaaaaataatggcattatgcatgaaaaaaatgcaccctaacagcctgcaattagtaaacagagacagagatatgtctagaaactatatatcgtgttcaaaggctctgtatggtgaatatattgacggaaagttagaatgaagtatgctacttatgtaatgcctgaaaatttcaatctaagctacacatacaacatactctatacttatgttacgatcatgattaaggaatcgaatatatttactaatacctgcatgacttgatagagttgcatattctgatatgagttgatcatactacgatgtatg

SEQ ID NO: 8947 - DNA, 641 bp, Diabrotica virgifera
  misc_feature (2)..(18): n is a, c, g, or t
  misc_feature (20)..(62): n is a, c, g, or t
  misc_feature (70)..(640): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 8948 - DNA, 821 bp, Diabrotica virgifera
  misc_feature (46)..(71): n is a, c, g, or t
  misc_feature (73)..(86): n is a, c, g, or t
  misc_feature (91)..(571): n is a, c, g, or t
  misc_feature (578)..(615): n is a, c, g, or t
  misc_feature (635)..(648): n is a, c, g, or t
  misc_feature (651)..(673): n is a, c, g, or t
  misc_feature (681)..(703): n is a, c, g, or t
  misc_feature (733)..(764): n is a, c, g, or t
  misc_feature (771)..(805): n is a, c, g, or t
tttctgcggccgagataatactaatattatcatcattactaatttnnnnnnnnnnnnnnnnnnnnnnnnnncnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnntataaatgctctggat

SEQ ID NO: 8949 - DNA, 295 bp, Diabrotica virgifera
acaacgaaaaatgtagagatccaagcttggtctaactttgagagatagaatacataataataagatataacgaagaactagagtggaagacatcataaaacgcattacgatgttgaagtgaaaatggacacgtcacacgacagagagacaacagatggaaaaagaagaatattgagtggtgaccaagggcaaacaagcaaagtcgtggaatcccacctaccagatggacggtcgacataaaaagaatgtcgttattcttgttaaactggattatcactgcgcaggacagagaagg

SEQ ID NO: 8950 - DNA, 867 bp, Diabrotica virgifera
  misc_feature (19)..(751): n is a, c, g, or t
  misc_feature (781)..(781): n is a, c, g, or t
  misc_feature (815)..(815): n is a, c, g, or t
  misc_feature (833)..(855): n is a, c, g, or t
aaaaacgaataacatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgggagagttcanatcgataataaagattggcgacctcgatgttggnattaagtttataattggnnnnnnnnnnnnnnnnnnnnnnntggtcgactttt

SEQ ID NO: 8951 - DNA, 749 bp, Diabrotica virgifera
atcatctataaaacattaatgttgcgtgttaagcttggaattatcgtaaatgccttcattgttgtttttaacaaattaataaacaagtaggtaactaatattatgtagatctttaagtactaaccagttcgtagtcgctattatctaagtgcaaattatttctttatatacaatgcatctgatcactactttcgaaatctactaacttactggagaacccgtctacgacaactgatagcagctgtactgaatacagtcgaaacgtatttgccttggaacctccacgagccatacaatggaacatttgactttggatccagtggatctgatatgcaagactttctggaccttgaatccttccttaagataacacaagaagaggatttatttgatattttaagacctgggccatttattagcgcataatataatttccgtggattttccaagctggatgatatggggataacctatgggtttccgaactgacgaagataattacaaccattttatttctacaaacttcaattatttccttcgaaaaacttgctgccttacaagttttttaaaggggggcctataatagcttattcagtcgaaaacgaattattggtaccctaactacaaagagttttttaaaaccatctttaagatacctaggacttattcagcagcctataatagactttgatttctgagattttcctaagaacttcgtaaaccctatttgcaaaaggaaattccgaact

SEQ ID NO: 8952 - DNA, 516 bp, Diabrotica virgifera
gtggcatcctcttgtaataccttctgctcaaaatatacagaaaagaatataacgggacacaatgaaaaaagcacaaagcttgtcctccactcaaaataaaacgagaacgtacacgtaagtatgaatgttgaaataaagtttattgttgttcctatctgtggcccagctgccccttggacagctacagcatctccagcttgggtcagacttcagtgccttggccaaataccaaagatgattacgaattgggaaaagttatcgataatagacgacggagcaggaaattcagtgaagctaacaagtctataaatgaaaaagaagacgaagaacttgaagatacacagattaatcaaccaattgcctagaacattttatggaaggcgttaatattaaacgcctcagaatggttctatattcttaatggatggttatcctcgctcataacgggatcttccttacacatttatgggatagtgcaagtaggaaaaaagtgaaaatttgaatatgatcttgagg

SEQ ID NO: 8953 - DNA, 809 bp, Diabrotica virgifera
cacagaaaagctgattgaatacaaaacctacactcaagccttgccatactttgacagattagattacgtctctatgatgtgtaatgagcaatgctatagcttagcaattgagaaacttcttaatattgacgtacctttaagagctaaatacattagagttctatttggtgagttgactaggattttaaatcacattatgggcatcggaacccatgctcttgatgtaggagccttgacaccattcttctggctcttcgaagagcgtgaaaagatcatggagttttatgaaagagtttctggagctcgtatgcacgctgcatatgttaggccaggaggagtatctctggatcttcctttgggtctgatggatgatatttacgaatttgcttgcaaatacaatgaacgaattgatgaagtagaagatgtcctcacccataacagaatttgggttcaaagaaccaaagatattggagtgatttctgctgaagatgcattgaactatggatttagcggtgtgatgttgcgaggttccggtatcaaatgggatttgcgtaaacaacagccttacgatgcatatgatcactttgaatttgacgttcccatcggtaccaatggtgactgttacgaccgttatttatgccgcatagaagaaatgagacaatctttgagaatcatagatcaatgtctcaacaaaatgcctgccggggaagtaaaaaccgacgacgctaagttaacgccacctagcagagcagaaatgaagacatccatgaaagctttaatcaccacttcaagctcttcacccagggata

SEQ ID NO: 8954 - DNA, 1270 bp, Diabrotica virgifera
  misc_feature (743)..(743): n is a, c, g, or t
  misc_feature (811)..(811): n is a, c, g, or t
  misc_feature (934)..(934): n is a, c, g, or t
  misc_feature (941)..(955): n is a, c, g, or t
  misc_feature (958)..(1204): n is a, c, g, or t
  misc_feature (1221)..(1261): n is a, c, g, or t
attgaaaacattcctggaatgtctccaaaagcactcgaacgtcccaggaaagtgctgtgttagcattttaaacagtccttggatgtcttgttggaacattccaggaatgtctacaatgttctttgaacattcacagtatattttttagactgaatgtcttgtttaaacattccatgaacgtctacgaatgttctcaggacattcaaagtatatttttttagacattctctaaaatatatcgccagtgatgtgacaatgcctcctatatgttttttcatgagttttgcaggagacgaaaaaagttttttaaggtcacctcttgttttcatacgtaagttttgacttgttttgtagtaaatagatagttgaatttactacaaaacaaacaagttttaagtctctcttacaaatctcatgaaggaccagataggaggtgttgtcacatcactgacaatatgtggtcataccaaataatacatccttgataaatataaacatttttattgcacaaaatcttttcatacatttttttaatgtaatttactgatattcctataaaaaatgtgtcacatttgcttttttttttcttccttattggctttggattacttgatccattcagccacgatagataataaattactgtttgctacaatattccaaatataatacattgcattacataatacattaggtacatgtgcgcacatataatacttatgcacgcacatacatacatacantatgtagaagtggaaacatttaattgatcagtaggtatactcctcattcatggccctaaccaacttanattaatttacaaataattaaatcgataaaaaaaactacatgctaatactaatgctataaaatatatgtttttttacacagcgataggcttcacccgatcaccccccccggaggtacacccccntgggggnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttttctctcgggnnnnnnnnnnnnnnnnnnnnnnnnnnnnnnnnnnnnnnnnntgctctctt

SEQ ID NO: 8955 - DNA, 801 bp, Diabrotica virgifera
  misc_feature (688)..(688): n is a, c, g, or t
gtaacttacttttcattaagtctttgtatgcataaaagcacttagtaccgctaagaatccgtgcttgtatatacggggtgttagtgagtgggtgtgaaacattttgagggctggttctacatgaaaaaataatgccgctttgctctataaacatatgtctgcaaatgcttcgtttgcgagatgcggggtgttgaagtttttatttcgaactgcggatttatttattgctctaggaccggttgagctgtgaaaatggaatttggtgagttttgggaggtggttgttgcgcattctttgtcatgcaattgagaattttgtattcatcattgggtaatagtctgaatttttttaaagaaaagaatggtgctccactgagatgtttcagattgaaaattgtgtttaagttccaagtttagtttttgatgaaaaacctttcttgcctttttttttcatatgatgcaccgtttttatgcagaaaaataaagggtcttggcgagtattttgcatttcttaatacatcatcaagaactatccagtgtaatggtgctaaactggaacagtgacagaaagtattactggtaggatttcaactaggtgcagaactgcgggaaatgtttacaatgatctcctttacaggtgacggaagggttttgtattcatcattggcgcgcgtactatttttctcttngaagggttcagacaattacacgtacgcgcgctagtgatgaatgtaaaattcttctgtaacctctaaaggaggtcatttttaacatttgttgtagctctgcacctggttgaatc

SEQ ID NO: 8956 - DNA, 198 bp, Diabrotica virgifera
  misc_feature (2)..(28): n is a, c, g, or t
  misc_feature (66)..(108): n is a, c, g, or t
  misc_feature (110)..(122): n is a, c, g, or t
tnnnnnnnnnnnnnnnnnnnnnnnnnnngctggtagtgaacggtttggatgacaaaaaaactggcnnnnnnnnnnnnnnnnnnnnnnnnnnnnnnnnnnnnnnnnnnncnnnnnnnnnnnnngtatttaaaaggaggaaagaatcccaagcgggtggtttaaatttaaaaacattgtaattcttagacgaagttttgt

SEQ ID NO: 8957 - DNA, 220 bp, Diabrotica virgifera
  misc_feature (2)..(65): n is a, c, g, or t
  misc_feature (67)..(158): n is a, c, g, or t
  misc_feature (162)..(219): n is a, c, g, or t
tnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtannnnnnnnnnnnnnnnnnnnnnnnnnnnnnnnnnnnnnnnnnnnnnnnnnnnnnnnnnc

SEQ ID NO: 8958 - DNA, 820 bp, Diabrotica virgifera
  misc_feature (12)..(33): n is a, c, g, or t
  misc_feature (137)..(159): n is a, c, g, or t
  misc_feature (650)..(650): n is a, c, g, or t
  misc_feature (728)..(728): n is a, c, g, or t
  misc_feature (749)..(764): n is a, c, g, or t
  misc_feature (766)..(778): n is a, c, g, or t
ggaaagattacnnnnnnnnnnnnnnnnnnnnnncgtttctagattgatattctagtttttaacttaaattcagtaggatggataattccctaacaaattttgaattaactgagagcaccataaaaatcgatccagannnnnnnnnnnnnnnnnnnnnnnacaaaagtgacccaatggaaatagtaagtataggcgatgctgaatcttcttccagcaataagtctgatgatgatttcgataacaatttaccaaaaactgttacccttttgaaacacgaaaagactggagctaaggtttatcttattggtacagcacattttagtaaagaatcacaagaggatgtagcaaaagttataacaaatgttcttccacatatagttgtactagaattatgtagttcgaggacaaatattttatctttagatgaggagactgtcttggaagaggccaaaaatatcgatatgcagaaaattatatctacaattaggactaatggagcgtacaacggtttgatgtatttactattattaaatttgagtgcgaaccttacaaaggaaatcggaatggctcccggtggcgaattcagagttgcttataaggaggcctcaaagattcctcactgtagatacatttaggggatcggccgatanatattactcttcaaagagccttagcaaggcttacctggttccaaactataaaactgggcgtggcatctactcacatcnaaagatccctgtaagtgtagnnnnnnnnnnnnnnnngnnnnnnnnnnnnnatggtagagcattattaacagatttgtcgggagataccggat

SEQ ID NO: 8959 - DNA, 332 bp, Diabrotica virgifera
  misc_feature (244)..(261): n is a, c, g, or t
cccacgcgtccggtacattaactgctttgcagtggttcatctatgatgccttcaaggttgccatgagaatgccacgaccaccaccaccagaaatgccagaatcattaaagaagaagttggagggcaaatagagaattaatttattaacactaatatgtaatttatgactttatttccagaaaaacgaaatcgcagtatttccattagttcgttatagttattgattgtcatcaactttgcgaannnnnnnnnnnnnnnnnncataccagttatgtccgatattttagattgtaaatagataatcatcaatatacaactggaactccgttaat

SEQ ID NO: 8960 - DNA, 979 bp, Diabrotica virgifera
  misc_feature (29)..(52): n is a, c, g, or t
  misc_feature (941)..(941): n is a, c, g, or t
ctatttttctgaaaaaataattctgaagnnnnnnnnnnnnnnnnnnnnnnnnagcagcatggcagcttatggcgcatgcgtatacctaagaactttctattcggatgagaccatctcttgtgcattagtttcttccaaatcaaggataactccgttaaagacggtaacacttcctaggcttgagctgtgcgcaatggttcttctttcaaaacttaatgcaaaaataatttctatctttgaaaatcaatctataatttcattcagtcagcctctggtcagactcccaagtagctctgtcgtggtgtaaaagtcatccaagtcggtggtcggttttcgtggctcaccgggtagctcttgtccaagagttgactcaaaactttacatggcttcacataaagtctgcgcaaaatgccgcagaccttctttctcgaggaatgtctggttctgaaattctcagtagcgacttctggtggcaaggtcccaaatgcttgcgagataaaaatttcaatgtttccaatctagtaaatgacaaagttctcgaaaacctacccgaggaaagaaaaataagcctcgtggtaaattctaatgtggaaaatttctggataaaaattttctcacgtttctcaaatatttcacgcttaaaacgtacagtagcgtacgtatttcgttttatttctaattgtaaaaaacaaaaaatttctgaacctctttctgttgcggagttaaattatgcaatggatttcatcatcaagaaaatacagggtgatgcattttcaaaagaaatttcggcgcttaaaataacaaatttatttcgaataaaaacttcatgtcactaaaaacatttttagattcttctaattttctccagagtggaggcagacttacgaactgtcccgacatagactatttgcaaaaacatcccgatactgctcccatcccantaatcctatcgtcaatcttgtcatcaaaaatgaacatc

SEQ ID NO: 8961 - DNA, 376 bp, Diabrotica virgifera
  misc_feature (78)..(97): n is a, c, g, or t
agtgtgtgagcgagagtggtgttgtgtaccttcacaacccacttaaaattgtgaaataatttatttacaaatactatnnnnnnnnnnnnnnnnnnnnataaagaaacaatccagatcgcaaaatagtgtaacgaagtacaataacagaagaactgaaggcatacactccacagttcccgagggagtctttgataagcgtgcttcgtgacatcaacaggatgaatgattttgatgatgaaagtaatgctgatctgtaaattgtaaggtgaaatataagagaatgcgaatagatctatcataaatgtagaggaaaaggagtcaggataaagtgagtgattattgtgtattctcctatttgattgcaggagagtgataa

SEQ ID NO: 8962 - DNA, 953 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (777)..(777): n is a, c, g, or t
  misc_feature (783)..(795): n is a, c, g, or t
  misc_feature (798)..(843): n is a, c, g, or t
  misc_feature (851)..(937): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttanaatatnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaaa

SEQ ID NO: 8963 - DNA, 199 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngaaagg

SEQ ID NO: 8964 - DNA, 797 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 8965 - DNA, 974 bp, Diabrotica virgifera
  misc_feature (848)..(848): n is a, c, g, or t
  misc_feature (869)..(869): n is a, c, g, or t
  misc_feature (879)..(879): n is a, c, g, or t
  misc_feature (923)..(941): n is a, c, g, or t
cttaaagaaagtcagttaatcctgtgcggtatgacgcaactgattaagtccttaaaaatagtaataaaagaaggatgaagtaataaatcgtttacataaaaatataaagttttgatacgaataaaggccgagatagttcctacaattattcataacattgtagtttgttatgttacgtagtttgttaagtttccgcatttctagttttgaaggacacgatctcttatgacgataacattgagtcaataagtaatttttgtaaagtcagggcaataaatatttaaattggcgtacatataaaatcgctaaattcgcgatctttttttagtattatttagaatagaaaaaatagataggtaccaaaaatatgacgttcactataataaaggtggaaaaagttctagaaggaaaagactggccacaaattgtggctatattaataggatcatttgttgcatttaccagtggactgctctatgcttggccttcaacttttttacttaagattactcaagacaaggtacattacaacatatctgaaaatgaagcctcctattttactatcgtacacgcagctggaatgctaacattacccattttattggtgtcaattgcgcaaatcattggcagaaaaactcttcttaacttatctactattccttatattacaagctttgttttaaaagctgtatgtacaaatatatggttactgtatttggcgaggtttctagcaggagctggagacgcgatagtgtttgctgcccttcctgtctacataggagagatcgctacacctaaaatacgaggaatatggggaaactctttttatattgctgtctttctaggancatgtggaaatgacattattnggagttattngcatgtacaagtgacatctttatgtggtctagcaataccagtcnnnnnnnnnnnnnnnnnnngttttatgcctgaatctccgtattatttaatat

SEQ ID NO: 8966 - DNA, 1100 bp, Diabrotica virgifera
  misc_feature (699)..(699): n is a, c, g, or t
  misc_feature (735)..(735): n is a, c, g, or t
  misc_feature (1059)..(1099): n is a, c, g, or t
agcttcaattagttaaaatattgtatgactattttgattcagagcctagtgaatctgctaggaatactgtatttctttccttatttagtggcacaacagcaaactccaggattcaggtgctttccaaattggtttcccttgcgataggcattccatctacaaaaattttagtatctgcaagggcatggatgcagcagttaggaaatacttctgcaaatagctgcaaattggcagaggccatagttcaagactatttttacttttataaaagtaatacagataaaattacattattaccaaaaatttgtccacagtttaccgcaaatatcataactgcaattgcagagaactattttaatactagagggaaagaactagtatttccgccagatatactgatagaaactattacaaaatggttatcagaaaacccaagtctatgtagtgcagcgcagcaaaaacaagctttgcttccagtaggagctatttcaatggaggctacaacacccatagctggtcttgtacggtggtgtgttcttgcgcccatttttaaaaaggacaatgaatattataacaaactccatttagcattgttaactagtataatggaaatacccagagcagttccgccaaaagcagtatacgtccaacatttggtcatacctattaacccaattatagcgtatgtgaacgatttanaagacagacaagaattgagactagatcaaatcttanatgacgaatccctacaactctgtttggatagatttgctcagatcgtgcagattgcacagtcagtgaaagctatcaatggacatattgacgatctgtattatcaacttaaaatgttgccttttaacaactaatgagtattgtcataaataatcataacaaagaaaaaataattgttattatgataaaatttggtcttttttaccttctgttttcatttaaattttttagtgaaagctatcaatggaacatattgacgatctgtattatcaacttaaaatgttggccttttaccaaaccaatggagtatttggcataaataatcannnnnnnnnnnnnnnnnnnnnnnnnnnnnnnnnnnnnnnnng

SEQ ID NO: 8967 - DNA, 135 bp, Diabrotica virgifera
  misc_feature (2)..(17): n is a, c, g, or t
  misc_feature (119)..(134): n is a, c, g, or t
cnnnnnnnnnnnnnnnnccagttaggattacaaattttcatattttaacacatggtatcatttattcttatacatgactatgttccatgttatccagatgtagcagcaaaatttcgatnnnnnnnnnnnnnnnnc

SEQ ID NO: 8968 - DNA, 77 bp, Diabrotica virgifera
gtaccattagttaaacatattattttaaaggcttttttgcctcttggtactttttcgaaaagtcagtttttatcgag

SEQ ID NO: 8969 - DNA, 551 bp, Diabrotica virgifera
  misc_feature (149)..(174): n is a, c, g, or t
  misc_feature (181)..(210): n is a, c, g, or t
  misc_feature (217)..(236): n is a, c, g, or t
gttcatatcaaagttagtattgtttttcgcagccactgcgtgcgtgtcatccagcgtgcaggatgctgatctgactcttactgtgttttatgattgtcaatgaccaagatagatttagtaccttgtgaatcaggaataatcaacaaacnnnnnnnnnnnnnnnnnnnnnnnnnntaaaatnnnnnnnnnnnnnnnnnnnnnnnnnnnnnntaaatcnnnnnnnnnnnnnnnnnnnngttgaaatgaaattcgcttcgaaatatatctaattcttcaagactaaattaaattcatttattaacaacatattaataattaaatacttttatattatcaataccagatatccttagcggatgagcttagaaataacatttcatcacaatctaattgataaataaaaattagagatcaaaaatcttcatatccaaggacatggtattattcatttttatctctaatgatttttatttctccacaaatcttctattacaacatcaatttcacattattttaaattcataatcgacgataaatatctactgattaaa

SEQ ID NO: 8970 - DNA, 962 bp, Diabrotica virgifera
  misc_feature (167)..(206): n is a, c, g, or t
  misc_feature (279)..(293): n is a, c, g, or t
  misc_feature (770)..(770): n is a, c, g, or t
tctcgtccgaagcaagtcaaaataataataacaaataatgccgcagattattgaatgaatattgagtttttagtttttttgagttttgtgtactaagatggagattgacttagagatatctgacgaggattacgttattgaaaaagcaaaagcttcatttaaaaacnnnnnnnnnnnnnnnnnnnnnnnnnnnnnnnnnnnnnnnntaatgtaccccaacaatttcggagtgcaattcgaagcctatcatatagagaaaaatgctggacatgttaaagnnnnnnnnnnnnnnntcagcgagctgactatcaaatttcagcaacaccaagaactttggaaggaaatagagaaacttacaattgctttaagagctgaagctgacaacaacgatcctgaaaagcaatttttgtgcgaaatgtttaggcatttatcatcagatgttcagcataagttgttgctcttcactgctgatcattgtgaagatactatggaacactgtagactgcttttgctacttttgcaacgatttccaacagctatatctagcaatggtccgcgacttgtagatactttgatcagtgctgaaaaacatagtgttgatggcaactttccagttaatccatacagaaaacttttagtttgtgatttgttgccacttttggcaaacgaaaaggttaaagtagatttaccttcaaaacttctacacaaattgctacataagagtattgagttttatttttgctatttaggattaaataaaggtgctctgncagacagtgatacaaaaatagaagatccttgggctagcctgtttagtgtaatagagttcattgggacacaattgagttggggaccatacctaattaatttctcgaatatttggtctaaagaaagctactggcagaggatagtaactttttgtcaaactaaatccaaagaattatcctctaaatgaaaagcag

SEQ ID NO: 8971 - DNA, 186 bp, Diabrotica virgifera
  misc_feature (3)..(23): n is a, c, g, or t
  misc_feature (31)..(109): n is a, c, g, or t
  misc_feature (111)..(173): n is a, c, g, or t
agnnnnnnnnnnnnnnnnnnnnngagaagannnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnncatttttttgatt

SEQ ID NO: 8972 - DNA, 198 bp, Diabrotica virgifera
  misc_feature (7)..(44): n is a, c, g, or t
  misc_feature (79)..(101): n is a, c, g, or t
  misc_feature (109)..(131): n is a, c, g, or t
  misc_feature (161)..(192): n is a, c, g, or t
taacagnnnnnnnnnnnnnnnnnnnnnnnnnnnnnnnnnnnnnntgcgacctcgatgttggattaaagttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 8973 - DNA, 237 bp, Diabrotica virgifera
  misc_feature (2)..(40): n is a, c, g, or t
  misc_feature (42)..(82): n is a, c, g, or t
  misc_feature (132)..(156): n is a, c, g, or t
cnnnnnnnnnnnnnnnnnnnnnnnnnnnnnnnnnnnnnnngnnnnnnnnnnnnnnnnnnnnnnnnnnnnnnnnnnnnnnnnncaagaaatggaattattaatattagaattggtattggtaacataaataannnnnnnnnnnnnnnnnnnnnnnnntgcgttttcaaagtataaaaaagatttctagggttctgtgtgcttcccccgtcgtttttattacataatttattgaggatg

SEQ ID NO: 8974 - DNA, 245 bp, Diabrotica virgifera
  misc_feature (114)..(137): n is a, c, g, or t
  misc_feature (177)..(189): n is a, c, g, or t
  misc_feature (191)..(203): n is a, c, g, or t
ggcgaccccccgcgccccccgcacgcttccgtttattttataataattgagtatttctattagtagaagtatagaaaaatttgatttaatgatagtttagtaggattgtaagannnnnnnnnnnnnnnnnnnnnnnntattttgatgcttttggacctctgtgtatcaggagattgnnnnnnnnnnnnngnnnnnnnnnnnnncttagttgttcgaagttcgatataggagctacagaaaagtta

SEQ ID NO: 8975 - DNA, 858 bp, Diabrotica virgifera
  misc_feature (668)..(690): n is a, c, g, or t
  misc_feature (803)..(815): n is a, c, g, or t
  misc_feature (818)..(850): n is a, c, g, or t
cacaaactaatccattgaagctctgatatgtttattgagaatggaagattgaaaggaactccaaagtcctttggaacaaaggactttgaaacacaactcttgtattctatggcttgatgtccatggtgtaatcttctgttgatctttagagaagttttctttcatttattttgaaagtatgtaatttttatttattctcgataattggatgaaatattgtcaattgtctataggtttgttccaacatgaacttttggacggtccagaaaccgtcacgaaactacttgtaccgtttgttgtgcgcatgttcgtaattgtatcgcccagttatcgtcccatgacggtaatcatatatttgtcatttttgttggtgacagcttgtgtgcttttagtcgatcaaaggctcaaaaactttaaagaattaaatcctagtgcgcaagtcagtccaaccagcacattatgtatttgcccgattactgaaatgatcatcacgaaaccgtcaccgaaagatcacaattcttgttggaacagtggaaaaggacgatccgatgacgatcatatttttgttggaacggattttgtttactgcgcagaaagcgtaccgtttcgtgacgggtctcggtcgtgttggaacaaaccttataagatttatcgtgttatacatgccnnnnnnnnnnnnnnnnnnnnnnncgtcgccttcacattaaataatagttttcaattacaataataatgagttcactctatgaataatacataacatctattttagaataaaataaactataatttatttagggggnnnnnnnnnnnnnggnnnnnnnnnnnnnnnnnnnnnnnnnnnnnnnnngttataat

SEQ ID NO: 8976 - DNA, 590 bp, Diabrotica virgifera
  misc_feature (2)..(147): n is a, c, g, or t
  misc_feature (149)..(298): n is a, c, g, or t
  misc_feature (397)..(419): n is a, c, g, or t
  misc_feature (479)..(503): n is a, c, g, or t
  misc_feature (517)..(557): n is a, c, g, or t
  misc_feature (560)..(572): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaattaccttagggataacagcgtaattttattgaagagttcaaatcgataataaagattgcgacctcgatgttggattaaagattataattggnnnnnnnnnnnnnnnnnnnnnnntgttcgacttttataattttacatgatctgagtttaaaccggtgtgagccagattggttnnnnnnnnnnnnnnnnnnnnnnnnnctagtacgaaaggnnnnnnnnnnnnnnnnnnnnnnnnnnnnnnnnnnnnnnnnncgnnnnnnnnnnnnngcctgatcgacttttaaa

SEQ ID NO: 8977 - DNA, 1277 bp, Diabrotica virgifera
  misc_feature (218)..(263): n is a, c, g, or t
  misc_feature (443)..(464): n is a, c, g, or t
  misc_feature (516)..(533): n is a, c, g, or t
  misc_feature (747)..(747): n is a, c, g, or t
  misc_feature (771)..(791): n is a, c, g, or t
  misc_feature (885)..(885): n is a, c, g, or t
  misc_feature (1119)..(1158): n is a, c, g, or t
  misc_feature (1165)..(1191): n is a, c, g, or t
  misc_feature (1199)..(1248): n is a, c, g, or t
attttggagacaaaacatgttgagtgagaccgtatttggattatatcttacaataaaatgtacgcatcataaatatttgatactacaaacaatatataaatatcgtactgtgggaagtcaataaagtcagtatggccaaaattatagaggacatacaatcccagaatggcttcgaaaccttcgtcaatgcttatcagcagatgatttgttacatgacnnnnnnnnnnnnnnnnnnnnnnnnnnnnnnnnnnnnnnnnnnnnnnaagcctaaaatttgggaacggtactcaaagaagacacaacctcctgtttaaagtggataaagtccatggaagtagaccgatataccgacaatataataatacctaaaatacgtttagccgactttcattttatcaaatcaaggaatgcagataacattgagaaggcaagatcatagttcnnnnnnnnnnnnnnnnnnnnnncctttattatgaaacatgaacttttatgtgataaatgaataactacacaggnnnnnnnnnnnnnnnnnnttgaaaacattttgactgagctagctgatttttatctgccgaaagaaaagctggtctttttctgcgaagattcgcttatagagcctctcggtgaagtggtcaacaatagtccgccatcatgttaatgttccagcggccctggtagcacttttccatcaatttaatatcctggtgaaaacactcctcctgctccacattaacgtctcccaaattntcaaaagtgagcttttgaaaatcnnnnnnnnnnnnnnnnnnnnncatgttagttacagtagtaccatatcctatgtttttttgcatctctctcttttgtaaacacttgcttgaatgatacccatgcttattcctcagntatggtcattgtggttcaaagttaacgtcaacatcatttttccgatggacggtcctacaaagacgccttcgtctagtttggtttttgaaaggtttggggaccttttcgcaagaaaaactttgaaccccggtccatcttttagggaaatattctttacaaactggtttcatgaagccaaatttttatttgtgaaagggggggggaggaaaaaaaggtttaagggatatttcacannnnnnnnnnnnnnnnnnnnnnnnnnnnnnnnnnnnnnnngcggggnnnnnnnnnnnnnnnnnnnnnnnnnnnaacaaaannnnnnnnnnnnnnnnnnnnnnnnnnnnnnnnnnnnnnnnnnnnnnnnnnaaccccttccccccccccccaccatcgtt

SEQ ID NO: 8978 - DNA, 919 bp, Diabrotica virgifera
  misc_feature (525)..(543): n is a, c, g, or t
  misc_feature (769)..(769): n is a, c, g, or t
gcgggctgtatgacagttagacacgattttcaatatttttctattagtattttaatacattgattgagatacccgtcaattcttcttcaagttccatcttttatcgaatgttggaaatcatcatgactatgcgggctctgctaactgccactctaaatggttctgtaccgccatcattccctcaagtattaatctagaatattcttctttcccacatttcgctttcttcgaatttttccttacataataagtcctaagaatgactatctttgtccttaaaggcgggtaacttattcagatgaacttgtttttgtgtccacacttccaagccatagagaatagtagagaaaacgtaacattgaaacttcttaagttaattggatgatgtacatgctatttctacatttctttacatttgatgttatccatgttcgtaagtatttgaaggtatccacactctcaattacagtatcttcaataatcaattgggagtttgcatctgctgatttagatatgatcatgcannnnnnnnnnnnnnnnnnncatcttcagtccgtattcatgacagcatttattaaggcgttgcattacaatctgttaataattgatgttatccgtcattatcactgtatagtctgcaaaatgtaaatattcaaaacttgtccattgatagatatgtcttctataagaatctgaaaagagtagaggggatagcacgcaacactagcggactcctctcgtgtgttcaaaatgtcatccctttacttgncagtctgattccatatagatagatatattttctatcacgactgtaatattttgcttttatagatctatagcttttatgttaacttatcaatacctctcaaattataaacgtaagctatgtatgatgtcatgtgcatgtcatgcatctctg

SEQ ID NO: 8979 - DNA, 175 bp, Diabrotica virgifera
  misc_feature (16)..(174): n is a, c, g, or t
ctggaaatgagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8980 - DNA, 855 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
  misc_feature (476)..(496): n is a, c, g, or t
  misc_feature (634)..(683): n is a, c, g, or t
  misc_feature (688)..(796): n is a, c, g, or t
  misc_feature (799)..(818): n is a, c, g, or t
  misc_feature (820)..(846): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnannnnnnnnnnnnnnnnnnnnnnnnnnngctcatccc

SEQ ID NO: 8981 - DNA, 108 bp, Diabrotica virgifera
  misc_feature (57)..(102): n is a, c, g, or t
accgggtccgggatttcccggggtcggcccacggcgtccgggttcccgatcgcgtgnnnnnnnnnnnnnnnnnnnnnnnnnnnnnnnnnnnnnnnnnnnnnngaaagg

SEQ ID NO: 8982 - DNA, 718 bp, Diabrotica virgifera
  misc_feature (58)..(81): n is a, c, g, or t
  misc_feature (215)..(254): n is a, c, g, or t
  misc_feature (259)..(288): n is a, c, g, or t
  misc_feature (301)..(717): n is a, c, g, or t
gcggtccggatcttttcatctatctttacaaatcaatcaaaatcatctctttccagtnnnnnnnnnnnnnnnnnnnnnnnnttcatcttcaatcgatcagttcaattcagtaatcgcgatgagaatcactttcactttcctcaaatagaaaaatttcactttttcgtaccttcgcgtatccaggggattcctaattaataattcatatacttacnnnnnnnnnnnnnnnnnnnnnnnnnnnnnnnnnnnnnnnnatccnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 8983 - DNA, 884 bp, Diabrotica virgifera
  misc_feature (105)..(129): n is a, c, g, or t
  misc_feature (139)..(249): n is a, c, g, or t
  misc_feature (259)..(621): n is a, c, g, or t
  misc_feature (623)..(751): n is a, c, g, or t
  misc_feature (753)..(823): n is a, c, g, or t
  misc_feature (829)..(829): n is a, c, g, or t
  misc_feature (833)..(855): n is a, c, g, or t
  misc_feature (857)..(881): n is a, c, g, or t
attcattttaaaatcaataaaatctcttttcacgtaaaaggtaaatgaaaaatctttcactccaacgatcagttaattcagtatccgggagagaatccttcactnnnnnnnnnnnnnnnnnnnnnnnnngtacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnattttntttnnnnnnnnnnnnnnnnnnnnnnngnnnnnnnnnnnnnnnnnnnnnnnnngat

SEQ ID NO: 8984 - DNA, 847 bp, Diabrotica virgifera
  misc_feature (12)..(29): n is a, c, g, or t
  misc_feature (105)..(128): n is a, c, g, or t
  misc_feature (146)..(176): n is a, c, g, or t
  misc_feature (178)..(844): n is a, c, g, or t
tttttctctatnnnnnnnnnnnnnnnnnntcctttacgaaaagtaaagaaaaatctttcactcaacatcgttaattcagtatcgggagagaacactttcactttnnnnnnnnnnnnnnnnnnnnnnnncgtacctcgtgtatcagnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaga

SEQ ID NO: 8985 - DNA, 799 bp, Diabrotica virgifera
  misc_feature (2)..(44): n is a, c, g, or t
  misc_feature (52)..(724): n is a, c, g, or t
  misc_feature (734)..(769): n is a, c, g, or t
  misc_feature (777)..(797): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnngtttatannnnnnnnnnnnnnnnnnnnnag

SEQ ID NO: 8986 - DNA, 1037 bp, Diabrotica virgifera
  misc_feature (43)..(67): n is a, c, g, or t
  misc_feature (106)..(135): n is a, c, g, or t
  misc_feature (153)..(178): n is a, c, g, or t
  misc_feature (192)..(207): n is a, c, g, or t
  misc_feature (210)..(230): n is a, c, g, or t
  misc_feature (235)..(266): n is a, c, g, or t
  misc_feature (276)..(777): n is a, c, g, or t
  misc_feature (780)..(811): n is a, c, g, or t
  misc_feature (813)..(837): n is a, c, g, or t
  misc_feature (839)..(857): n is a, c, g, or t
  misc_feature (862)..(862): n is a, c, g, or t
  misc_feature (881)..(881): n is a, c, g, or t
  misc_feature (893)..(991): n is a, c, g, or t
  misc_feature (993)..(993): n is a, c, g, or t
  misc_feature (995)..(995): n is a, c, g, or t
  misc_feature (1007)..(1007): n is a, c, g, or t
  misc_feature (1011)..(1033): n is a, c, g, or t
gacttcactatcggggaaggctggtacgccttgctgggtaccnnnnnnnnnnnnnnnnnnnnnnnnngacccacagcagtccgtaattacgtattcgtgtgtgaannnnnnnnnnnnnnnnnnnnnnnnnnnnnncttttccgtacctccgcnnnnnnnnnnnnnnnnnnnnnnnnnncatatatttattcnnnnnnnnnnnnnnnngtnnnnnnnnnnnnnnnnnnnnnatccnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnntnnnnnnnnnnnnnnnnnnnnnnnnngnnnnnnnnnnnnnnnnnnncgagnaagacctatagagttttantaaattattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnanttttttgatccnattnnnnnnnnnnnnnnnnnnnnnnnacct

SEQ ID NO: 8987 - DNA, 928 bp, Diabrotica virgifera
  misc_feature (894)..(895): n is a, c, g, or t
gacccacgcgtccgatccgacgtcgtttgatgttcacgaatataaaaatataccctattgtaggtaggattcaaaataattagtaggtatattacttttattgcatacttttcatttcgtttttatcactcacagccttaataatattgctagaagttttgtacagaataacaaacaataaaacattgttctatatatttaaataaacgcttctatacagaacaacgtctggaagcaataaatattaaactgttcatttatttactgaatactctgtgtgaaacaataattattattctacaataatgaatagaaatgaaatattctattttatttagttagtacattgtatttatacttaataaaagaaatggtattgaaatgaaaacaaaataagtatcaagatttatatgatgcagttaagaaagcataggaactccaataaagctaattagttgtacagtgaattgagagaaaaaagtatgcggatattaatgagctacacagtaatactgatttggatattcgtaaataaactttaagagctaattttaaaatataaagaaataacatggaatttaaaaaaaatcactaaaaaggggggttatgagttgcaattgcgacgtcggaataagaggggggggtctactggtaaacgacgctttacgacgaaggggggagggtattaaaaagtccaaaatttttacgacgtagtttatggatgttccctaacagttagcaacaagtaccacctcgcagatacgtcaatgaatgaatgacaagcctggtcgtttcgcctgtcgaagaagtctggtaacttgaggcgaaagtacttcatttctttcgcgcagttcgccataagaatgtattgggtatgtcttcctgcattattannctaaaatcaaaaacagttttccattggatacta

SEQ ID NO: 8988 - DNA, 923 bp, Diabrotica virgifera
  misc_feature (827)..(845): n is a, c, g, or t
  misc_feature (917)..(917): n is a, c, g, or t
cggacgcgtggggaataattatcgacagtaacccaggccagaaaacgtcgagggagagtcctcacgttttaactcatcgtgtggactcagttatagctttcgccaattcacatttaacgcaaaaatctcaaaataaattagctattatcggcccgccattcaaaaactagtcaatttatatatcctcggtcctcggcaaaaatcgctcgatatacgacaagtcgatggacagtacgaagtatttacagcggtagaaaaaatcactaaaagaaatttggctaaggtgttaacaacagaaaaccaactcgttattacagaatctcttttagcaggtgccattgcaatgggccttatgttatattgcaagactgcaaagaacaaaacctcctggtgcaaagttaaactgcagagttctagttatcacaggaagtagttgttcagcctcacaatacatgaactatatgaatgttttcttcaccgcccagaagcaaaatgtggttatagatggatgtgctttggatcagcatttgagtttattgcagcagggttgtgatatcacaggagggatgtatctgaaagtaccccagttgcagggattattacagtatttattgtgggtgtttttgccagaaccgcctattagagaaaagttagtattacctcctcctctaaaggtggactaccgagcagcatgtttttgtcatagacagttaattgacataggatatgtatgttcagtatgtttgtcaattttctgcaaatttagtcccatctgtacaacttgtcacactgtattcaagatgcctgcactacccagtgtcaaaccnnnnnnnnnnnnnnnnnnntagcaataagttgaagtgcgattaattttttactttcaaaatgaattttattaaaccagttttacaaataanagagat

SEQ ID NO: 8989 - DNA, 665 bp, Diabrotica virgifera
  misc_feature (2)..(15): n is a, c, g, or t
  misc_feature (20)..(452): n is a, c, g, or t
  misc_feature (454)..(527): n is a, c, g, or t
  misc_feature (534)..(571): n is a, c, g, or t
  misc_feature (606)..(628): n is a, c, g, or t
  misc_feature (637)..(658): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntgttcgacnnnnnnnnnnnnnnnnnnnnnnagtttaa

SEQ ID NO: 8990 - DNA, 791 bp, Diabrotica virgifera
  misc_feature (3)..(15): n is a, c, g, or t
  misc_feature (17)..(44): n is a, c, g, or t
  misc_feature (52)..(778): n is a, c, g, or t
  misc_feature (787)..(788): n is a, c, g, or t
ccnnnnnnnnnnnnncnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaanntag

SEQ ID NO: 8991 - DNA, 843 bp, Diabrotica virgifera
  misc_feature (2)..(44): n is a, c, g, or t
  misc_feature (52)..(724): n is a, c, g, or t
  misc_feature (736)..(736): n is a, c, g, or t
  misc_feature (740)..(740): n is a, c, g, or t
  misc_feature (746)..(836): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaagcttanattnttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatta

SEQ ID NO: 8992 - DNA, 906 bp, Diabrotica virgifera
  misc_feature (2)..(50): n is a, c, g, or t
  misc_feature (52)..(656): n is a, c, g, or t
  misc_feature (672)..(695): n is a, c, g, or t
  misc_feature (699)..(856): n is a, c, g, or t
  misc_feature (858)..(898): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggaaatgaggggnnnnnnnnnnnnnnnnnnnnnnnnattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnncatttttt

SEQ ID NO: 8993 - DNA, 799 bp, Diabrotica virgifera
  misc_feature (2)..(43): n is a, c, g, or t
  misc_feature (51)..(727): n is a, c, g, or t
  misc_feature (733)..(787): n is a, c, g, or t
  misc_feature (792)..(792): n is a, c, g, or t
cnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnntagtnttttagt

SEQ ID NO: 8994 - DNA, 824 bp, Diabrotica virgifera
  misc_feature (21)..(38): n is a, c, g, or t
  misc_feature (396)..(411): n is a, c, g, or t
cgattctgctctctggattgnnnnnnnnnnnnnnnnnntaatcaaaatcaaatattcaacgaaaacagctagataatcgcgttagtagccgaacattgcgaattggggagcaaaaagctcatctgtaattcattttttttattggataaatccaaggcacaaattacatctctgacaagaccaaattattgacaaaaaggttatatacatgtaaaaagataccaaagactgaaataatgaacttaaaaataaagacttccaaccatctggcaaaaccagttcatatctttgataatggaattacttctagagattcacagactacattcatatcagataactatgcctaaggggaaaaatgatccaacgatgtgaaagacaataaacatcgtaacnnnnnnnnnnnnnnnncagacatcttgattgtaagatgaggccctgctgatatgaatctctatgcgctccaaacaactgctctgaaaaagatgtgaaggaacttaaggaatgattacatgaaaaagcctctcacgtaagcgtgcacatactgtctgcaccattgatacagcctacagctttagatgaattgataccatattgtcaagagaagggagcaccacttaacactcccgctactgaatataaatttgaatatctgacatactacgggaagatttaacattcctgattttacaggtgctccaatgcacaaccatgataactacatagacacattatgccatgatgtcgactgattgcgagaaccagcggatgcgttatgtgatgaaacgtatccagagtatgcagcttctgatattctataccat

SEQ ID NO: 8995 - DNA, 956 bp, Diabrotica virgifera
  misc_feature (684)..(684): n is a, c, g, or t
  misc_feature (801)..(801): n is a, c, g, or t
  misc_feature (841)..(843): n is a, c, g, or t
  misc_feature (894)..(894): n is a, c, g, or t
  misc_feature (897)..(897): n is a, c, g, or t
ggacgacgtagaagcgaaaagaaacataccctcaaattaattcgatatttctaaaacgttattagggaaacaggtggacttcaagtattttatactcgtgttaatatcgtattacaatatcggtacgtgtatatcaacaagataatatattttctcgaatcgagatcggcggaaacttagcaatagtagagaaaaaactcgatttaggagtctttacgataaatactcctggttgtaaaataccatattttcagccttttgataaaaatattttggattatttagagcaaccaggcacacatgtttgtaataatggtacaccagcgttatttgagtcagatagagattctatcaaaattatagaagattctttacctttctataatgtaaccaatataaataatctgacatgttgttacaaaatattttggagagaagatcctgctgatagtgctgcagacaataaaataagctacagtaaaggctgccaaacatttgtgaataaaactgaagtaaaagaagagtttataaaagttacgtgcagctacaataatcgtgatatttatactgatatgtttgttttcgttcctacaaaaaatatgtcacacgtaaaaaaagatctgaatgaagacgattctaatttaaatattttagtgataggcctagatgccatttcgagattanattttcatagacagatgccaaagactgtaaattatttgaaacaaattgggtgccgttgaaattataggatacaataaagttggagacaatacatttcccaatggtataccagtggtnacaggtaaacatatagaggaaatccagaaggattgctggnnncactgatatcactactttgatattggctctttcgtttggaagcgctacaancanaaggggtatgtacggtttttgacgaggatcatcatggatgggaatttttactatcaaaa

SEQ ID NO: 8996 - DNA, 903 bp, Diabrotica virgifera
  misc_feature (869)..(871): n is a, c, g, or t
  misc_feature (885)..(885): n is a, c, g, or t
gatgcagcatcatctcctcgcgcttaccacggtacccccgaccaatacgaagccggcgatttaagtgggaagtttggaagtcctattaatcacacaacgtacaaaacttactataacgacaccttattaagtttgtttgggccaaggagtattttagggagatccatagtgttgttcaaaaggaattcacgaagatgggcttgctcaactattgaacgaggctacagtccatcagaagcaagagaattacgagccatagcatccttccacaaccctaatggtcatgcttttggttacatgaaaatgagacaattaattcataaagatggcagccctagtgatacaactattgaagtcaagcttagacatcctggaaaaaatgataggaatgtgacaagggagcacaactgggctatatatgtcaatcctgtcggtgtagacgctacagtaaaaactctggcaactagatgtgtagctggtggatatgtatggaacccttatttcactcaactggccgatccattaaataccgacctgtaccaacaagaatgtggccctgagaatcctcttcgatgccacgtgggagatctctcagcccgactgggaactatagacattggcttagaaaggaaagtttttacccctagactatacgataaaatatcctcaaacgtgaaatggatcaaagacagtatgaacaatgacgaaagatgaaataaaacaataaaatagtgatataaacggacaaattgtcgggcaaataaacattgttttaattctgaaagttttcttcggaagaccagttttgtgatttgtagtttgagttgtgccaataagggaactgattttagggagataatacatgtcannngtaataaaatcatncataattttgcgctaagt

SEQ ID NO: 8997 - DNA, 649 bp, Diabrotica virgifera
  misc_feature (33)..(48): n is a, c, g, or t
  misc_feature (50)..(70): n is a, c, g, or t
  misc_feature (72)..(146): n is a, c, g, or t
  misc_feature (156)..(646): n is a, c, g, or t
aaaagaaaaaatcttatcttttccgtacctccnnnnnnnnnnnnnnnncnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 8998 - DNA, 924 bp, Diabrotica virgifera
  misc_feature (570)..(594): n is a, c, g, or t
  misc_feature (803)..(803): n is a, c, g, or t
  misc_feature (897)..(897): n is a, c, g, or t
gtaaaacgttagagagtaagggttgaagttaaataatagaagtatttacggtcaaaaattttagttatttactatacctttttaaaagataacagtccaacgaaaataataaggttcgtgatatctgtaaacgttctgtaggtattttaaagaatttcggtgtcacaagccttcgacattgaaacttaagattcatttcaaacatggatttagattctgaagatgaaaatgtaatggaagaggattattactcctttttaaacatacctagggaggcctccaaggaagaaattaataatgcttatagaagattaagtcgaatttaccaccctgataaacatgttgacccagaacttaaagaaaaagctgaaattatgtttaataaaaccaaaaaggcctatgaagttttgtcagatcctcatagaagagctatttatgactctcttggtaccaaaggcttagaaacagaaggttgggaaatagtacaaagaacgaaaactcctgcagaaatacgggctgaatatgaacagctagctgaagaacgagcagagaggcttaaaaaacaagctnnnnnnnnnnnnnnnnnnnnnnnnntagctgttaatgctactgatctttttaatccgtattatgatgagtttttggatgaagaatatgaaagtgactttctaactcaatttccaaatatagaagtatcttcaatgcaattcagtcaatctgtagatttccctctgactcaaaagactcttgtacactttctgggcaactgcagacccaaaatggaactggaggaggaggaattnattttagctggaggcatatattttcacataaaagctgggcagagatgggaatgacagcaggtagtggaccagcattatctttttaaggatttangacactcactcggaggtttttttggga

SEQ ID NO: 8999 - DNA, 769 bp, Diabrotica virgifera
  misc_feature (2)..(44): n is a, c, g, or t
  misc_feature (52)..(721): n is a, c, g, or t
  misc_feature (726)..(726): n is a, c, g, or t
  misc_feature (733)..(733): n is a, c, g, or t
  misc_feature (744)..(744): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttanaagcttnaatttttttanagacgagagaccctatagagtttat

SEQ ID NO: 9000 - DNA, 709 bp, Diabrotica virgifera
  misc_feature (46)..(68): n is a, c, g, or t
  misc_feature (86)..(128): n is a, c, g, or t
  misc_feature (136)..(708): n is a, c, g, or t
atttttcactattttaaaataatcaaaatcatctttttacgtaaannnnnnnnnnnnnnnnnnnnnnngatagttaatcagtatcnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 9001 - DNA, 727 bp, Diabrotica virgifera
  misc_feature (108)..(139): n is a, c, g, or t
  misc_feature (182)..(527): n is a, c, g, or t
  misc_feature (529)..(619): n is a, c, g, or t
  misc_feature (621)..(725): n is a, c, g, or t
tcgaaattaaaagagctcaaaaaatctaaaatctttctcatgtaaaataaatatctttaaatcaattttcttcgtaatcgaaacattactcgtttttcaaatatcatnnnnnnnnnnnnnnnnnnnnnnnnnnnnnnnncttatctaacaatatatcttatcaattaaatacttttatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 9002 - DNA, 289 bp, Diabrotica virgifera
  misc_feature (8)..(27): n is a, c, g, or t
  misc_feature (29)..(44): n is a, c, g, or t
  misc_feature (47)..(71): n is a, c, g, or t
  misc_feature (77)..(99): n is a, c, g, or t
cctccccnnnnnnnnnnnnnnnnnnnngnnnnnnnnnnnnnnnnccnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 9003 - DNA, 537 bp, Diabrotica virgifera
  misc_feature (57)..(83): n is a, c, g, or t
  misc_feature (141)..(189): n is a, c, g, or t
  misc_feature (206)..(227): n is a, c, g, or t
  misc_feature (254)..(274): n is a, c, g, or t
  misc_feature (276)..(289): n is a, c, g, or t
  misc_feature (345)..(363): n is a, c, g, or t
  misc_feature (366)..(382): n is a, c, g, or t
  misc_feature (427)..(445): n is a, c, g, or t
agtggtacgtctggaggtgaggggggaggaattagtggggcgaccccctttgagggnnnnnnnnnnnnnnnnnnnnnnnnnnngatccttatttaatagtaaaggtgaagaaaaatttgatttaatgagagataagtagtnnnnnnnnnnnnnnnnnnnnnnnnnnnnnnnnnnnnnnnnnnnnnnnnngggtagagaataagggnnnnnnnnnnnnnnnnnnnnnngtgattataatgaaagatgaaagaagnnnnnnnnnnnnnnnnnnnnngnnnnnnnnnnnnnngatataattgtgatgtaataggatgttattccttttaaataattagtggtggttgnnnnnnnnnnnnnnnnnnntgnnnnnnnnnnnnnnnnnaaggaagaggataatgaattgtcagatgaaataatgtttagacannnnnnnnnnnnnnnnnnngttagtaaaatttaattattaaggagatatataggataaaaatttttctagatttagggaagattgtaaattttggttatatattgtgtaat

SEQ ID NO: 9004 - DNA, 937 bp, Diabrotica virgifera
  misc_feature (571)..(596): n is a, c, g, or t
  misc_feature (889)..(889): n is a, c, g, or t
  misc_feature (900)..(900): n is a, c, g, or t
cccacgcgtccggttccatgctttcattcatggaacctctcttggatttgggttggaattccgcaaagtatgaccagattactggtccgctgccccctaatgccgccccgtttagaaatctgaagaccatgaacagctcatatgtttgacagaagctagaagctactatacatagagcattcatgaaggaactcacaataagcacctttttacgacccaatgagtctgctactgaaccttgggtaacttatttgtagctggattagcttggttgattattccagctgatattggtttcaagaaccagtattttgtgtataattcttggagaatatttcttctcatttgctcattcccatcctttatagtggcggctttactgtgcttcttgccagaaagtcccaagttcttacttacacaaggtaagagtgaagaagctcttgcaatctttaagtacatttaccatgtaaacaccgggaatgatcccgaagactatccagttaaacatctcatctacgaacaagaagagctcactcttgaacaaaaagccaaaattgcaaagagaggcaannnnnnnnnnnnnnnnnnnnnnnnnntagataatagtaaacagttgtttgtttcaccaattttgaaattcacagttatttcaattaccatcaactttacatttcacattggatactacggtcttatgatgtggttccccgaaatgtttaacagatttgacgaatacgctaaaattcacgatggtgcagaagctggtgtatgtgaagttgtggactacgttgtcagtagtggcagccacagtggcagtgttttatgcagtgacaagatttcatcatctgtatttttagaatcatttgatacagtgtctgctgcattaccnaagtacatcgntgctgtattgggaatggacaaactgggcagaaatttt

SEQ ID NO: 9005 - DNA, 302 bp, Diabrotica virgifera
  misc_feature (5)..(103): n is a, c, g, or t
  misc_feature (110)..(147): n is a, c, g, or t
  misc_feature (167)..(180): n is a, c, g, or t
  misc_feature (183)..(205): n is a, c, g, or t
  misc_feature (213)..(235): n is a, c, g, or t
  misc_feature (265)..(296): n is a, c, g, or t
ctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9006 - DNA, 703 bp, Diabrotica virgifera
  misc_feature (89)..(115): n is a, c, g, or t
ctgaaagtcttacagtaagtcataagttcgcagtgaagtgaaaatagtgaagcaggtttagcaactaaaatggggagtgacataaaggnnnnnnnnnnnnnnnnnnnnnnnnnnntcgaaggaaaattaggacaacttactccacaagaaagacagagacaatcccaaatagtaaaggaaaagttgtttggtctagaccaatttaaagacgcaaggaatatatctatttatcttagtcttgatactgaaatagacaccgaaccaattgttaggaaaatctttcaagaccaaaaacgatgttttgtcccaaggtataataagaaggtaatggaaatggtagaattacattccatggaagattggacaaacttacctgtcaccaagtggaatattaagcagccttcatttaaagatgaaagaaagaatgctttagatgagggtcttgatttgatcattcttccaggcgtagcatttacaaaaaatggcgacagattaggacatggtggtggctactatgatagattcctacgaacagtttgtaaaaaacaagctaagccaccggcgctcatagctgtaggttttaacgtccaagttgtagatagtataccaacagaagaaactgattataaactagatatggtactttattccgagtaaagttctgtaaaaaatgtgtacagttatttgaataaagatattaatt

SEQ ID NO: 9007 - DNA, 102 bp, Diabrotica virgifera
  misc_feature (2)..(51): n is a, c, g, or t
  misc_feature (54)..(95): n is a, c, g, or t
cnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnngtacctc

SEQ ID NO: 9008 - DNA, 929 bp, Diabrotica virgifera
  misc_feature (424)..(475): n is a, c, g, or t
  misc_feature (710)..(710): n is a, c, g, or t
  misc_feature (770)..(770): n is a, c, g, or t
  misc_feature (785)..(785): n is a, c, g, or t
  misc_feature (799)..(799): n is a, c, g, or t
  misc_feature (817)..(817): n is a, c, g, or t
  misc_feature (828)..(828): n is a, c, g, or t
  misc_feature (843)..(843): n is a, c, g, or t
  misc_feature (884)..(884): n is a, c, g, or t
atagagttaaaatatataaatcttagttttaccgtaaataacggtcagaactttaatcgtagacgataacccgttatcacatttatcagccgtagctcgatgaaaacgtatatcgctgtagggcttatcgtaggacagtcatcgtttagacaaagactatgtcgtccatttggccaagacaccgcctttccaaacggacgaggataaaaaggctggcaaatctgctcctacacctaaaagtctagaagatttcaatcctagttgggttgccgatcatgcaaaacaagcaactcgaatgttacccggtggattttatgtcctgggcattttcataacagcgccagatgacatcctaaacccattccattcaaaaataaagtcactactacaaacagtccagaattatctaaacacaaacaagtannnnnnnnnnnnnnnnnnnnnnnnnnnnnnnnnnnnnnnnnnnnnnnnnnnnacaaagaaatattacagtcgaagctatgatgttaatagtcataatgtacagaacgttgatgttaagtctgttgcgaaaagatggaccaatggtacagtgtgatatcaagcttaacaaattaaggtttttgctcaaagaagaaaatgattggcctttggagaaacatatcaagatcattatggatgaaatatgtgataatttatcaacagcagtatttttatttgatggagagttntaagacaaagacgagccattagaaggttctggaaagaagaagtcgagaaatactagatcncataaggggccaganagtggggatgctancaaaccagtggtagtgtncatcttacaanctcagtgcttactanatgatacagaagaaacataatcgaatcctgtggtagtttanacttctaggaaagtagctttctcattatgggtacagccaaagtta

SEQ ID NO: 9009 - DNA, 755 bp, Diabrotica virgifera
  misc_feature (368)..(385): n is a, c, g, or t
  misc_feature (421)..(438): n is a, c, g, or t
  misc_feature (453)..(478): n is a, c, g, or t
  misc_feature (558)..(578): n is a, c, g, or t
ggatacaccacaggtgcctctgaagacgctaaaaagcagaaaccacggtcagccgatggtggtagccccgaatcaattttaatctaaagatgtctttccttaaaagtaaaacattgaagagttttcattgttgactttttataaatgataattttcttgttactctctttccattctcgctttttgatataatccttttattaaaggtacattctacctttctttttatgatatttctgatattaatttcaagtcttcattattacattttacgatataattattgaaaggattctttattgaccatcttcagatttgacaaatttgtcagtaaatctaagggaagggctccaaaatttacttaccannnnnnnnnnnnnnnnnngttcgtagattccattatggagcagtttttaacgcnnnnnnnnnnnnnnnnnncagaatcatcttgtnnnnnnnnnnnnnnnnnnnnnnnnnngacacatttgcaaatttggtgaaagagccttcaagtggttatattgtctttatttttttctggttctctcagatattctnnnnnnnnnnnnnnnnnnnnnccgtcttctacttttacattatcatttgtaaagatatttttggttattatttaaatttactggaatgagttcgaatatgaaatttcaattgtgatagtctaagtgtttatcatattgtttaagtgttgcttttttgtaagatattattgttagagtttataataaacttttttgtgt

SEQ ID NO: 9010 - DNA, 1231 bp, Diabrotica virgifera
  misc_feature (658)..(747): n is a, c, g, or t
  misc_feature (749)..(749): n is a, c, g, or t
  misc_feature (771)..(771): n is a, c, g, or t
  misc_feature (894)..(895): n is a, c, g, or t
  misc_feature (910)..(910): n is a, c, g, or t
  misc_feature (932)..(932): n is a, c, g, or t
  misc_feature (960)..(960): n is a, c, g, or t
  misc_feature (962)..(962): n is a, c, g, or t
  misc_feature (971)..(971): n is a, c, g, or t
  misc_feature (1023)..(1023): n is a, c, g, or t
  misc_feature (1040)..(1040): n is a, c, g, or t
  misc_feature (1043)..(1043): n is a, c, g, or t
  misc_feature (1088)..(1119): n is a, c, g, or t
  misc_feature (1125)..(1183): n is a, c, g, or t
  misc_feature (1190)..(1230): n is a, c, g, or t
ttattagtgtatttttagtgaaaaatggaaagcgaacgaataaaagacctaaataatttattgaaaccagcacttggagaaaacgttgaaatagtggacaagactataacaaatctcactcagccaggtgagaattactttagtgacatcgctcagattgcaagtaacaactaggaataaggacaccaatgctacaaaaactgaacatttcgtagcgaaatgttgtatagtagacgaaagtttgccaaaagaattctctatggcgagtcgccacatgtttaaaccagaaattaccttctataatgaaataataccgacaatgcaaaagtttgcaaaagaacatggtctgaagaaagtcgatttttttgcaaaattgattgctgctagatataatcttgatggtaaagaagagcctgaccagaatgcaattctgcttttggaaaatcttcaagtggcaggatacagcaatgaagacagacataaaggattcgactttgatggtgcaaaattactattaactgacctggccaccttccacgcaattcctttagcaatcaaactaaaagacccagatttgttcaaaaaggtattcctcgacaactgcccaggcccaccaacttttatggacaaatccaatgataaaggtcctgggcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanaaggagataatttttgtagaanatatgtagataagttggatgctatactggatgctgacgaggaaaaatttaaaaaaggaaatatgtttgataaacctgatcctacaaaacggtcttttctggagtcgtacataaagacatgtgnngtaataatacgatgncaaagaagaacgaagatggaangatgataaaaaataaattcgtggacttncnagtgtactncgtggcagatattacattagatctattcttcttttctattactcagcagggncggattaacacttttgncgnccatggggccagagtctgctgcgctagggggggggggagagcgcnnnnnnnnnnnnnnnnnnnnnnnnnnnnnnnntaaaannnnnnnnnnnnnnnnnnnnnnnnnnnnnnnnnnnnnnnnnnnnnnnnnnnnnnnnnnnatggggnnnnnnnnnnnnnnnnnnnnnnnnnnnnnnnnnnnnnnnnnc

SEQ ID NO: 9011 - DNA, 175 bp, Diabrotica virgifera
  misc_feature (110)..(130): n is a, c, g, or t
  misc_feature (134)..(173): n is a, c, g, or t
tcaaaaggaaaaaaattctcatctctttcggtcaccttcgcggtaatccaggggaactcctaatctaatcaattcatcataacttcactactttcgaatcttaaaagtgnnnnnnnnnnnnnnnnnnnnnatcnnnnnnnnnnnnnnnnnnnnnnnnnnnnnnnnnnnnnnnngt

SEQ ID NO: 9012 - DNA, 950 bp, Diabrotica virgifera
  misc_feature (757)..(757): n is a, c, g, or t
  misc_feature (857)..(858): n is a, c, g, or t
  misc_feature (880)..(880): n is a, c, g, or t
  misc_feature (900)..(900): n is a, c, g, or t
gcagcccgatgggcacctggtgagtgacctacacctaaacctcgtgcttcaggtactattcgtcaaccagacggatcatcgccaacgtccaacacccgctccacgtccattcggtaccatcagacaacccgacggtagctcgcgagaaacctacacccagacctcgtcctagaggtactattcgccaaccagatggatcatcgtcaacgaccaactccggccccctgtcccttcggaacagtgagacaacctgacggtagctgcacaaagccaaaccgggattatttaccacctgtaacaacgcagcctcccacgaccgatgatggttaccactatgacagaccttctccaccctttgagctacctggcactgatagctctgtaactattcccggaccaacaaccgaacatgaaggtatggattccaaaatcaaagaatcaattcggttacccgatcacaaagaagaaaacgctgaatcttccaaaactaacaacgtcttaataaaacctactaccgaaggttctacgaaaggaggaaccagacctgttaagacacctactaggagacctccaccagacaacggaggagacgaagtccaagccccagcaggttgtgctgccgccttgaaatgtgtccaagagatttattgtacagctgaaggagtggtctcaccggtgcctgttgttcttaccaaagatcaagaattattacgagtcccgacaaccgtatgcagagacatagaaactggtatcttgngtaaatgctgtcgcgatcccaactacaaagatccatggccatctgcgaacttagtcgacggggttgatgacggtcagtacaaggaagatgacttctacgnngcacaccaactttgtgacttcnatagactggcgaggatgctnacagaggagtaaagggatcagaaagcagactggtaaaaaagtcgaggatg

SEQ ID NO: 9013 - DNA, 215 bp, Diabrotica virgifera
  misc_feature (7)..(44): n is a, c, g, or t
  misc_feature (79)..(101): n is a, c, g, or t
  misc_feature (109)..(130): n is a, c, g, or t
  misc_feature (137)..(137): n is a, c, g, or t
  misc_feature (154)..(154): n is a, c, g, or t
  misc_feature (165)..(165): n is a, c, g, or t
  misc_feature (169)..(170): n is a, c, g, or t
  misc_feature (172)..(191): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagtttanaccggtgtgagccaggntggtttctatncttnnannnnnnnnnnnnnnnnnnnngaaaggaccaatatataaaataat

SEQ ID NO: 9014 - DNA, 335 bp, Diabrotica virgifera
  misc_feature (10)..(35): n is a, c, g, or t
  misc_feature (43)..(136): n is a, c, g, or t
  misc_feature (143)..(180): n is a, c, g, or t
  misc_feature (200)..(213): n is a, c, g, or t
  misc_feature (216)..(238): n is a, c, g, or t
  misc_feature (246)..(268): n is a, c, g, or t
  misc_feature (298)..(329): n is a, c, g, or t
ccccggccgnnnnnnnnnnnnnnnnnnnnnnnnnnggggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9015 - DNA, 752 bp, Diabrotica virgifera
  misc_feature (2)..(222): n is a, c, g, or t
  misc_feature (224)..(714): n is a, c, g, or t
  misc_feature (718)..(749): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgnnnnnnnnnnnnnnnnnnnnnnnnnnnnnnnntat

SEQ ID NO: 9016 - DNA, 952 bp, Diabrotica virgifera
  misc_feature (2)..(51): n is a, c, g, or t
  misc_feature (53)..(95): n is a, c, g, or t
  misc_feature (103)..(869): n is a, c, g, or t
  misc_feature (881)..(881): n is a, c, g, or t
  misc_feature (885)..(885): n is a, c, g, or t
  misc_feature (887)..(889): n is a, c, g, or t
  misc_feature (891)..(937): n is a, c, g, or t
cnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatttattnattngnnngnnnnnnnnnnnnnnnnnnnnnnnnnnnnnnnnnnnnnnnnnnnnnnntttgatccatttttt

SEQ ID NO: 9017 - DNA, 471 bp, Diabrotica virgifera
ctactttacttatatagtagataatacagtggactctctctataacgaacacggatattacgaggtttcgcttataacgaggtacattagacaacaataatattgaaacgggttgatgcctcttacgtagtttattaagtgtcaatggtcgacatgaataagggcagacttcgccatcgtaaattgtaaatgtcctacaatattcaatatcggtcgatagataaacaagaagtttattacgggcggcgagtttattacagcacttgcctcgataataacacagatgttgggaatttttatatacaagcagttggggtgtttatttatagccattacacccctaaaaacaggtaaaaaacatattcatcggattcgttttcttcgatataatccaatatgccacgatatagagaggaacaatccatttcgaatttcatgagacgctataaagtaattcttatataatagaaa

SEQ ID NO: 9018 - DNA, 542 bp, Diabrotica virgifera
  misc_feature (99)..(131): n is a, c, g, or t
  misc_feature (134)..(165): n is a, c, g, or t
  misc_feature (180)..(541): n is a, c, g, or t
gcgagagaacacctcattttctcaaagaaaaatctcacttttcgtaccttccgtatcagggattcataattaataattctcatcactcataatcctcgnnnnnnnnnnnnnnnnnnnnnnnnnnnnnnnnntcnnnnnnnnnnnnnnnnnnnnnnnnnnnnnnnntaatgaaacattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9019 - DNA, 913 bp, Diabrotica virgifera
  misc_feature (194)..(214): n is a, c, g, or t
  misc_feature (689)..(716): n is a, c, g, or t
  misc_feature (798)..(798): n is a, c, g, or t
  misc_feature (816)..(816): n is a, c, g, or t
  misc_feature (841)..(841): n is a, c, g, or t
  misc_feature (848)..(848): n is a, c, g, or t
  misc_feature (902)..(902): n is a, c, g, or t
gtccgtggggttaatatccgttcagttcggaatatcattcttcacgggcgtaaaccgtcagtgaattcattcgatacataaatcatcagaaacgcgataaaaacgttatttttacgttaaaacaaattcattttcggtattatcgtgagacttttctagatacgaagttaattaaattcgtgtcacacggtgcnnnnnnnnnnnnnnnnnnnnnaagagaattacatcgatgatggtatttaattacaaaaactttataaacaatggatgtcgaagataacaaattggtattcagagatttgcccgtaggaccacttaccccttatagaagactatccaaattcgattggagaaagttgaagttattctttgaagatgcagaaatggttaaaagtacaaattcaagtatggaagacgctagaagcagatccactattccaaagaccacgggttgaaataagtacagacgaaaagcaaaggatggcagcgttgcagttgaagaaatatatagattataattttgtaaacccggatataaacaaagtaccgtataaaaaaaggactcgaatacaattgggcgtgcaatcaggcaatagcagtaacgtttccagaagtctctatcaaactagccctaggccaaggtctatttactaatacaatagtcacattaggaacagaaagacatttcnnnnnnnnnnnnnnnnnnnnnnnnnnnnttgtcatgtctggcgctaacagaaatctcacatggaagtaatacgaaacagatgcgaacaactgccacatacgacccacaanatcaagaattcgtaatanacacgccagattttgaagctgcaangtgctgngtaggaaatttaggtaaacatgcacgcacgcactactttttgcccactgtatanccaaggggaat

SEQ ID NO: 9020 - DNA, 927 bp, Diabrotica virgifera
  misc_feature (754)..(754): n is a, c, g, or t
  misc_feature (763)..(813): n is a, c, g, or t
gagggcttgtataagcaagaaaagactatctgccgatgaaaggttgaattcaagctgcaaaacctactacaaagttgaagtggtcactcctaagctacgccaaaactcaacaaccaagagccaggagtctacaaagaggcaacagtctcaatctccaaagagggacgatgaaaaggaaaaaggtttaatagtgaaatttaagaaattgcgtaattctgaattgattcaactaaacaatgaagccaccaactttttgtttccaaagaaggatgacagtagcgaggaggaagacgacgaggccaatactacagcaagctcggcggatagttgtagtaataccgagatagaagactgtaaaacgtccacacccaacattaggaacgaagatgagacctctatggacagtacgggtagaaagaagaggaggaggacgcacgctgaggctttcatcatggacaatcaaaagtattataaatttgagactccgggctccagtcattgcaggttaaggtaccaaggatcctacctaccgctagtgatgaaatcaccagaacggcctgccaaaactgaggaggatgtaaagatcgaagaaccagaggagaagaagacgaaacatgtacagagttcaaaaataaagttgtccaagtacaaattcgccttcgaacaagtaccggttcatatgggatggtaccaggctttcaagaggctggacaatactgaacaaacatacccttgctttagtaattacctttgngaagaaaannnnnnnnnnnnnnnnnnnnnnnnnnnnnnnnnnnnnnnnnnnnnnnnnnncctaagtcattatcaagaacttctaaaaggtttgatggcggtagcatcggtgaaatctgaatcgtctactcgaagttcttccccccgaagaatgtcatcttcttcgtcactcta

SEQ ID NO: 9021 - DNA, 888 bp, Diabrotica virgifera
  misc_feature (341)..(364): n is a, c, g, or t
  misc_feature (377)..(394): n is a, c, g, or t
  misc_feature (428)..(450): n is a, c, g, or t
  misc_feature (676)..(696): n is a, c, g, or t
  misc_feature (775)..(794): n is a, c, g, or t
  misc_feature (833)..(833): n is a, c, g, or t
  misc_feature (859)..(886): n is a, c, g, or t
gaatggggggtcggtaccggacgaacagtttacccgcctcagtcatcaaatatcgcccacggaggtccatcagtagatttagctatttttagattacatttagccggtatcttcttcaattttaggtgcaattaattttattacaacagtaattaatatacgaccaataggaataaccttcgatcgaatacccctattcgttcgagctcgtcgtaattacagcaatccttcttctattatctttaccagttttagctcggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccnaatgatttctttatttacaggtatannnnnnnnnnnnnnnnnnnnnnnnnnnnaa

SEQ ID NO: 9022 - DNA, 783 bp, Diabrotica virgifera
  misc_feature (181)..(211): n is a, c, g, or t
  misc_feature (295)..(315): n is a, c, g, or t
  misc_feature (324)..(378): n is a, c, g, or t
  misc_feature (384)..(773): n is a, c, g, or t
  misc_feature (775)..(775): n is a, c, g, or t
atttttctttcttttcaaaacatcaaacatttttcgtaaaaggtaaagaaaaaatttcaccacacgattgttcatctcagtatcgcgagagaatcctcctttttctcaaagaaaatctcatttttctcccttctgtctccagggatcataatctcataatatcatcactcactatcttcgnnnnnnnnnnnnnnnnnnnnnnnnnnnnnnnctcatgtaaaatcaaatatctttcaaataatttttttcgtaatcgaaacgttactcgtttttaaataatcatctaattttttcnnnnnnnnnnnnnnnnnnnnncttatctcnnnnnnnnnnnnnnnnnnnnnnnnnnnnnnnnnnnnnnnnnnnnnnnnnnnnnnnggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnttggatga

SEQ ID NO: 9023 - DNA, 376 bp, Diabrotica virgifera
  misc_feature (101)..(130): n is a, c, g, or t
  misc_feature (134)..(153): n is a, c, g, or t
  misc_feature (169)..(375): n is a, c, g, or t
tgcggtccggattctttacttctctctttacaaaatcaatcagaaatcatcttctctccagtcaaaaggtaatagaaaaaatctttatcttcatcgatcannnnnnnnnnnnnnnnnnnnnnnnnnnnnnactnnnnnnnnnnnnnnnnnnnncttttcctacctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9024 - DNA, 880 bp, Diabrotica virgifera
  misc_feature (39)..(67): n is a, c, g, or t
  misc_feature (221)..(246): n is a, c, g, or t
  misc_feature (778)..(778): n is a, c, g, or t
cggacgcgtgggttttcagaataataccgtacgtgatgnnnnnnnnnnnnnnnnnnnnnnnnnnnnncaacctcataatatgtataacaaattacgaagacttgggaagtgcaacaccagaggtgtacaaaatgggcgctcatgaaaatatgatatataaaaaattatcaattcatcacatgaagatcaacataatgataaacgaggtaatactgaaacannnnnnnnnnnnnnnnnnnnnnnnnnttggctttacctctattggtgtagccatatagaggaaaattctggaaaatattagatgttggaatcatcaggaagaaataatcatttccaaaaaatatgacaaaaccaaaaagaatagaagaggatgacaaaaatataaaacctgcctcgaaagtaacttggtggatgtgttaaaagttgccttggaatttagtagctggacattcgaagacgatgtggttgattgtttgttcaacagtgctgtattgtcacacagagctggcagtaatactccattggtttagcgaatgtgtaacttgtattatgttcagattgcaccattgacgtcgaaggagagaaaaaccgtttggttagtttatggggttctctacaaaatccgaatttctgatttcatgatttaatttcccgatccagcactgctaaaatgtggaatattttagtagcagttcttggttggaggttgccaggattttagtcgcagtcatccttgactgaattcatggatgactacatttatcggcagtattataangtgtggcggacaattttaagtgaggtaagtaggggatggagtcgatcagagccgagctccagatagaaactcggcatgaacttcgagctgctagttgagctc

SEQ ID NO: 9025 - DNA, 364 bp, Diabrotica virgifera
ttatatatcttttatttgttcaaataaatatacacaattttaacattaatggatctttttcgtcagacctctctttaccaagcatgaacagctggtacgtgagcataataatcaactggggtaacatgaccaacatggcaatattctacagctgggaaagagaaataggtaacaatggtctgtagaatatcacttctgtaattgttgtcaacatcgaaacataaatcaccatgatatgtgaaaagtgcatcaaacacatcagaaattccttgtcccactatactataactacgaagatcatctaacgacccacataattcaattttgagtatatatgtacgacaacaaattacctcattacaaa

SEQ ID NO: 9026 - DNA, 960 bp, Diabrotica virgifera
  misc_feature (20)..(80): n is a, c, g, or t
  misc_feature (82)..(125): n is a, c, g, or t
  misc_feature (133)..(804): n is a, c, g, or t
  misc_feature (815)..(886): n is a, c, g, or t
  misc_feature (895)..(916): n is a, c, g, or t
  misc_feature (924)..(959): n is a, c, g, or t
ttcttcacccactccaaatnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaaaagcnnnnnnnnnnnnnnnnnnnnnnnnnnnnnnnnnnnnnnnnnnnnnnnnnnnnnnnnnnnnnnnnnnnnnnnnatttatttnnnnnnnnnnnnnnnnnnnnnngggtgatnnnnnnnnnnnnnnnnnnnnnnnnnnnnnnnnnnnna

SEQ ID NO: 9027 - DNA, 918 bp, Diabrotica virgifera
  misc_feature (73)..(94): n is a, c, g, or t
  misc_feature (775)..(775): n is a, c, g, or t
  misc_feature (810)..(810): n is a, c, g, or t
  misc_feature (812)..(813): n is a, c, g, or t
  misc_feature (860)..(860): n is a, c, g, or t
  misc_feature (877)..(877): n is a, c, g, or t
caccattcgtaatgtgcagtcaaaataagaatcatcaaagtggtagatcatcggatttaaaaatatctttcgnnnnnnnnnnnnnnnnnnnnnncaaaattaaccaacgtcctttctatagaaaataaaggaaataatcgacactacagaagattttcggaacatctccatacagagtcgacaaaagattttatcgtcaggtcaaaacagtattaaattctatccatatcccaagaaatatcaaataccaaattatataaagtatggtatcgtatggacagcctaatttttacaaaccagcatattactatcccaaccaagtgtatccaaatttccaaaagtatggttccccaaatgaccaaaagtatggttccccaaatataacacagtcaataatggatgtgttatattcagtcgccagaaatgatgatctacaatgcattccaagaatattatgcgagatgactacaggtacctttaatgggtcgtcagatcggtacaaatttacctttaaatatagatatgcagtctctgttggggttcttatcatcactgaatggtttatcaataagccccttggtctatttcggaagagcagcattgttggggtatacatcaaagggcaacaaaggatcttgtaccagtgcttatccaaactgcccttcggacgcagataagttggttcagtatctaaataattacaacggagggttttttagattctttcacgggttgaaatcacaaagctacgttcctcaccagcataatgatgcanttttacataaattttggacagaactattatggttncnnaaagtcagctgaacgaagaatttcaaacaacctattgtttacatttnccagtatagtatagagncaaatagtatattcaaattttcagaaaagacagtccactac

SEQ ID NO: 9028 - DNA, 173 bp, Diabrotica virgifera
  misc_feature (2)..(44): n is a, c, g, or t
  misc_feature (52)..(170): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagt

SEQ ID NO: 9029 - DNA, 428 bp, Diabrotica virgifera
  misc_feature (6)..(28): n is a, c, g, or t
  misc_feature (219)..(292): n is a, c, g, or t
  misc_feature (297)..(331): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnctaaaattacttattaataatcttctcaaactctatagggacttctcgtgcattataatgatttaagtgttttagcttataatgtaaattatttata

SEQ ID NO: 9030 - DNA, 115 bp, Diabrotica virgifera
  misc_feature (10)..(10): n is a, c, g, or t
  misc_feature (14)..(15): n is a, c, g, or t
  misc_feature (21)..(46): n is a, c, g, or t
  misc_feature (50)..(51): n is a, c, g, or t
  misc_feature (58)..(58): n is a, c, g, or t
  misc_feature (62)..(108): n is a, c, g, or t
taaaagcttnaatnnttttannnnnnnnnnnnnnnnnnnnnnnnnnatannattattnatannnnnnnnnnnnnnnnnnnnnnnnnnnnnnnnnnnnnnnnnnnnnnnggggtga

SEQ ID NO: 9031 - DNA, 412 bp, Diabrotica virgifera
  misc_feature (6)..(28): n is a, c, g, or t
tcgtannnnnnnnnnnnnnnnnnnnnnngatagaaaccaacctgggctcacaccggtttaaactcagatcatgtaaaattttaaaagtcgaacagacttaataatatagctgctacaccaattataaactttaatccaacatcgaggtgctaaacaatagtaacgcattgaactaccaaataaaataagaatggctaagcgggagatctgattttcttatatgacaaaatttgactagatgtaagattaatctaaatgatattgttaaattaaaaagtagaatatgaatagcctgtaccaaaaattgtattaactgaactgccaatgatagattcttacgaaattatgaagcaagagcataaatactctttgtcgaattgctacagacagttactaaacaactctttacttg

SEQ ID NO: 9032 - DNA, 915 bp, Diabrotica virgifera
  misc_feature (14)..(33): n is a, c, g, or t
  misc_feature (249)..(278): n is a, c, g, or t
  misc_feature (761)..(777): n is a, c, g, or t
  misc_feature (845)..(845): n is a, c, g, or t
  misc_feature (874)..(874): n is a, c, g, or t
  misc_feature (876)..(877): n is a, c, g, or t
  misc_feature (904)..(904): n is a, c, g, or t
  misc_feature (912)..(913): n is a, c, g, or t
aaataaacacactnnnnnnnnnnnnnnnnnnnnataatcttgatttattaacaaagcaaattatcaataaggacaacttttgcctgatgttacaaaaagcaaaaataactagtatgggattatgtgtgtaactaacataattgttttactaatattgtaagactatgaccaaactatagaattaatgtttgaactaaaatacctcaccacaaatcaaaaatgagtctacacattcctgtcaccagcaannnnnnnnnnnnnnnnnnnnnnnnnnnnnngaagaatggatatgtgatagctgtcccaacagatactgtgtatggcatagcatgtgacgccacaaataaatcggctataggtaatatgtatgacatcaaatgcagaaatgaaaacaaaccactagcattatgcttaagccaagtcagcgatgttaaaaaaattggatatgtcagccaccttccacaaaaactcctggattccttactccctggacctataacgataatactaccatgtgtagataaaacgttggaccattcacttagcatcgaaggaaaagtcggggtaagaatacctgattgtagtttcataagaagtttatcctcaggactagggaagccattggcgttaacaagtgccaatttaagcaacgaaaagaatgctatagaaatcgatgacttcaaaaacatctggcaaaagctaccagttatttttgacggtggtaagttaaaggaagataataatgcgtccactgtggtagnnnnnnnnnnnnnnnnnatttttaatatagtcaggaaaggtgtttcctggtgaagtatagtggatgtgttaactcggtttagttnaaaaataaacacaatgaatgtgatattananncagtggtaattattgtattaggaattnatttttcnnat

SEQ ID NO: 9033 - DNA, 897 bp, Diabrotica virgifera
  misc_feature (686)..(686): n is a, c, g, or t
  misc_feature (720)..(720): n is a, c, g, or t
  misc_feature (768)..(792): n is a, c, g, or t
  misc_feature (867)..(867): n is a, c, g, or t
  misc_feature (887)..(887): n is a, c, g, or t
cgtctgaagtcagctacgtaaattttacacggaaggccggaaataaaaagtattattatcattttgaccgtcttcaatcctacgaccaaagtattctagaggcaccagttatttctattaaaactaaaggcagggttccaagacgccccaaagaatttagcatctttttaccatgcattggtaatagttctggtatagctaagtttggcattggactgctaattgaaactagaaaaggaaagcctctaaatggaacacccttaagactgaaacttaaaaaggaatgtgcccaaaggaatccagatcctgaatgtgacaagaaatgtgccaatcaaggcagatgtaaccatgaaaaaatatgccagtgccctgaggggtatatggggccttattgcagaactgctttatgctatcctcagtgtatgaatggaggcaactgtacttcccctggaatttgcagctgtcctccaggatttcaaggaagacattgtgaaggaggtatttgtggtgagaaatgtctaaatggtggaaagtgtatccaaaaagacacatgtgaatgttctaaaggatactatggaccccactgtgaatattctcgttgcattatcccttgcctaaatggtggaaagtgcaaagctgtaaataagtgcaggtgtccaagaggattccgtggtgatcactgcganattggaagagcaaaacctgccagaagcaactgcncattggcatggcaacatggtacttgtgtagatgattcttgtgtctgtnnnnnnnnnnnnnnnnnnnnnnnnngccatcacatgatcatgtaggatgctcgggcctccaggctagaagtacttaaaccatctgtgacttccgttattngacattactgttattgtgcntatattttaa

SEQ ID NO: 9034 - DNA, 684 bp, Diabrotica virgifera
  misc_feature (67)..(88): n is a, c, g, or t
  misc_feature (109)..(130): n is a, c, g, or t
  misc_feature (164)..(194): n is a, c, g, or t
  misc_feature (204)..(683): n is a, c, g, or t
taaaagaggcaaaaaataaaattttctctaaaatcaaatactttcaaatcaatctttttcggtaacnnnnnnnnnnnnnnnnnnnnnnaataatcatctaattttttcnnnnnnnnnnnnnnnnnnnnnncttatctaacaatatatttatcaattaaatatcnnnnnnnnnnnnnnnnnnnnnnnnnnnnnnngggatgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 9035 - DNA, 428 bp, Diabrotica virgifera
  misc_feature (177)..(249): n is a, c, g, or t
  misc_feature (262)..(427): n is a, c, g, or t
attcttacaacatcaaatctctctctcttcgtaaatgtaaagaaaaatctctcactcaacatcgttaatcagtactcggagtgaatccttcacttttatcaaaagaaaaatctctatcttttcgtacctcgcgtatccaggatctatctcaatctcaataattatcatcatttatcnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 9036 - DNA, 917 bp, Diabrotica virgifera
  misc_feature (209)..(226): n is a, c, g, or t
  misc_feature (312)..(324): n is a, c, g, or t
  misc_feature (326)..(338): n is a, c, g, or t
  misc_feature (411)..(434): n is a, c, g, or t
  misc_feature (693)..(712): n is a, c, g, or t
  misc_feature (790)..(790): n is a, c, g, or t
  misc_feature (802)..(802): n is a, c, g, or t
  misc_feature (813)..(813): n is a, c, g, or t
  misc_feature (827)..(827): n is a, c, g, or t
cgataaaaaccctaatagagtataactccatcaggggctaatatcctattcgagtcctcgttacggaggtagggcatccgataaacgtatatttttaaacgaaaaagttttattaaaattagaccctaacgatgcagttatggtggacaagggatttttgatcgaaaaggagtgtcaagaacatttggtcaaattaataagacctcccnnnnnnnnnnnnnnnnnncaactgtctaaacaagaatcagttcagacagctgaaattgcaagggctagggtacatgttgaacgtgcaattcagaggataaaggnnnnnnnnnnnnngnnnnnnnnnnnnngtacttaccttttgccatattgtgatgacattttaaaaataatttgtgccattataaacatctctagccctannnnnnnnnnnnnnnnnnnnnnnngtctttaatgtaattgactgtaatgtaattcttttttctatgaccgttcaataatatcctcattattcactatttttgaatagatagtaacacccattactttacccatgagtaatagttcattactcaccggctcaagttaggttcaagtggtgaatgtcacgtttaatattagtcttatataaactgcaaataaaattatttaacttgtttatttataacaatgattattgtaatttatatcaataattaacttcgnnnnnnnnnnnnnnnnnnnntaattataacactgggtcagtatattttttacttttataccttgtttactattatgaattttgatgtttatcattttncatgatagtgtnaagggatttanataagcatccatanaataagggtatttaatccactagtaaataatagatcagtttattttttaagtctcaaataacatatttacatctttagtcatgttttgat

SEQ ID NO: 9037 - DNA, 956 bp, Diabrotica virgifera
  misc_feature (44)..(65): n is a, c, g, or t
  misc_feature (796)..(796): n is a, c, g, or t
  misc_feature (850)..(850): n is a, c, g, or t
  misc_feature (908)..(908): n is a, c, g, or t
  misc_feature (912)..(912): n is a, c, g, or t
cggacgcgtgggcttaaacgaaaacgacgtaaagaacgaacttnnnnnnnnnnnnnnnnnnnnnncctattccgtaccataccgaaacgacgataataagaccgataaagtatacgaagacatctatgaagataatcgtagaatacgccgaacccagtgcgtttcaaaacaaagaagaaaagagtaaaacgaagaagaagaaatcacgcgaaaagatgaaggaaaacgccgatgaagagaaaccaaacaagaaagtcaagaagaggcaaagttttattaaaagagtgtggaagaagaaagataaacacaaagacaaacatgaggagaaggtggaaaataaagttgaagaggaggatgaggaggaaatatatgaaactgtacctccgacagtagtagaaaaagtagctgttacggataataaaacagttcagatgttatcggaactgcataatatattggaacataagatgccaattatcatagaaagaatgtcgaatgaaacgcattcaccaaaattacaatctccaacaggcagtatctctcctaccatagcagaaacacaagaaaatgttatacaaagtaacgtagaaaatgtgacagaaccaccttgcccgcttttaccaccgaaggctcaaaaacaagatgcgctgtcacctttccacgacgtccccaccaacaacaaaccagtcgcattacccccaaagagaagaaacacagaacctgtcaaaagtttagaccagatcttggacgaactcgacaacgaacaacaagagacaaacaagaaaaacaaagttanaaaactgattaagaaattcagcgaacctgatttttacgacactgatgttgtttntaggacccaaaagagcggtatccataggcccgacatacattcagatgaactgagtagngtgntagaaagagtagtgaagggtactaatgctcctatgctgatacct

SEQ ID NO: 9038 - DNA, 867 bp, Diabrotica virgifera
  misc_feature (330)..(346): n is a, c, g, or t
gatacaccaactcgagttggccgaaactaatcagagagtcgataacataaaagtagtagtaagactttttaattcaatatataacaccagatcgattcccacagatcggctcaaatccatcttcgtcgcaatacctaaaaaacacaatgcgagaaaatggctcagaatatcgattaattagtctaatggagccacactcttaaaatttttctaaggatacttcacaacagaattagacgcaaatgcgaagaagatctcgaagatacccaatttggttttagaaatactatggaaaccagagaggcacattttgcgcttaacattctattnnnnnnnnnnnnnnnnnaaagaaaagatgtatttgcatgttttgtggacttcgaaaaagcattcgataaagtacagcatgtaaaattaatgcaaatactgaaaaatatcggaatagatgacaaggatattcgtgtcattaaaaatttgtactggaatcaaactgctatcgtaaaaattgaagataactacaccgatgaaatctccatacaacgaggagtcagacaagggtgcattttgtcgccaacattgttcaatatttacttggaccagttatttaaaaaggcactcgagagtacatacagtacataaagtaattctgtcagataatattgaaggtctctaaattctgcttgatcgtattcatgaggtaggagaagaaatgggcattaaaataaactcaaacaaaaccaaatttttagtgtttagtcgtgactcacatcccgatgcaaagcttcaattaaacggagtccaaattgagaaagttcacaaaatgacatatttgggaactatgataacggacccactagatccagacat

SEQ ID NO: 9039 - DNA, 874 bp, Diabrotica virgifera
  misc_feature (17)..(34): n is a, c, g, or t
  misc_feature (121)..(139): n is a, c, g, or t
  misc_feature (208)..(275): n is a, c, g, or t
  misc_feature (277)..(688): n is a, c, g, or t
  misc_feature (690)..(780): n is a, c, g, or t
  misc_feature (782)..(871): n is a, c, g, or t
cccacgtccgatttatnnnnnnnnnnnnnnnnnnattttttacgtaaaacgtaatagaaaaaatctttatcttcaacgatcagttcaattcagtatccgtggagatgaatcaccttctctnnnnnnnnnnnnnnnnnnncttttcgtacctcgcgtatccaggggattcataattaatcattatatatttcataattttcgaattttnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntat

SEQ ID NO: 9040 - DNA, 879 bp, Diabrotica virgifera
  misc_feature (8)..(71): n is a, c, g, or t
  misc_feature (73)..(229): n is a, c, g, or t
  misc_feature (231)..(266): n is a, c, g, or t
  misc_feature (273)..(878): n is a, c, g, or t
tatttatnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnntttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9041 - DNA, 538 bp, Diabrotica virgifera
  misc_feature (7)..(45): n is a, c, g, or t
  misc_feature (319)..(336): n is a, c, g, or t
  misc_feature (463)..(486): n is a, c, g, or t
gccgccnnnnnnnnnnnnnnnnnnnnnnnnnnnnnnnnnnnnnnncaagaaattgactagattgtttcattattttgcaacacgttggatggtccattgctgctgtagttgctgatgttgttgtggataatattgttgctgttgtaggtgtagacggagctgtaggcgttggatcagaaggtaatgatgctcacctcgcaggatatgctgatgttttgtgacaaaaggttaatgtccatggtgatattctcgatgcacacgctatcgaccaacaccaactctaagcttacagagacagcagaggtcgtcactatacccnnnnnnnnnnnnnnnnnngctcctactcggacttgttcatataatacctagaagacgtatacatctacgactaaggcaaaaacgactactcaagaaatcctactcaaaaaatcagactcccgatactactgtaatgtcacaactnnnnnnnnnnnnnnnnnnnnnnnntataatctcgcacaaaacaacattatcatacatatagaactcactctaaact

SEQ ID NO: 9042 - DNA, 471 bp, Diabrotica virgifera
  misc_feature (163)..(181): n is a, c, g, or t
tcttgcccggttattctaattatatataatatactataggcatttgagagaagaattgtatgaagagatcgacgtgtctggaacgtaagacagtatacgtgttgaaagattacatgctctacatcgttcttccctcgcgatatcgagcattgggaatgagccnnnnnnnnnnnnnnnnnnncttttgcaaatgagacgaatctctaagcgtatgctcttgtgagactacctatcgttggtaagacattttgcctcgcacgattgcccgtggatgatgtagcgtatttcataatggaaataatgcaccacaaattgacttatattaattttcaacccatatacttatctttgacttctattataatactagcagatctggctcagcaggcgtaatgtaatgacatttttctggtgatacttcatttaggattgaacaatagtgaatgcctgagtactacctccctcaggtgt

SEQ ID NO: 9043 - DNA, 895 bp, Diabrotica virgifera
  misc_feature (203)..(224): n is a, c, g, or t
  misc_feature (731)..(731): n is a, c, g, or t
  misc_feature (870)..(870): n is a, c, g, or t
gtttttacccaaactattttggtggctcaggcatgctcattttggcttttagtaacactgatgatggatttcttaattcgaaaacgttctatgatttaatgtaacccttatttagggaattttaaatatacctttcacaaaaaatcttgtattcttttaatttatggtatacagccatacaggaattttattttcctcctggnnnnnnnnnnnnnnnnnnnnnncgttgaaatcataaaaatggaagtataacttcttacgcgtgaacaaaatacacactctttttttaatatctttagcagaattaatacactattttacagagcttcaaaaacctttgtaattgactaaaataattatactaattttaacaatttttgaattaaaattaaacccggaaaagttctaacataaattatttcaaacgtcgttttctcgatactttgcttttttgacttatgacactgtttgagcggaggtgcgatataatatgtactaaattttatttaaatacaataataaatcacataaaataaacatgttttaaaacctacgaaataaaccacacgaaatctatttactgatttttactgaattaaatactgaaagtctggtctacttatctattagtcatttaatattagattataacacaggcctacagtgtttttggtgccgcagtatttaaagctgattttgggtatctttggggtgctgattccgaatatggncttagttttgctctatcagctctagtttttcagataacatagatcatgccagcttttatgcattaaatttcgatatgctgatatgaatatactaaattaaaataaaaaccaaaccattaaaaaacacgtatattttaangcatttcatcatcatcgtcatcatc

SEQ ID NO: 9044 - DNA, 602 bp, Diabrotica virgifera
  misc_feature (266)..(284): n is a, c, g, or t
tctcacggccggcaatatcggctaacaattatttagtttccttattactagagggcgcctacaagtctttatggtattgtgaatttgtcaaatattttgatgcattaacgacgaaagcacaccaaactttctatcaatactggcgaatctgtaattacgccgtgcctacatgtatttgaaatattagatattttattaaagatagtagtacaatgtgcaatagtggcgaatgagcacttttgtgtgtgtggtcgtttttgcttttnnnnnnnnnnnnnnnnnnnttcttacagagaaactaagtttcaatcgttcttaggtacttagaaatagcaaatcaagaaagcgtctatccactttggatcaatattgtttaattccacactatcgagaaccaatattcatttctaaaaagaaatcttacaaaataaatcaattccttctacccacaataatttctttagtagtttgaaatacgaaacatacgtgagtgaaatcatgaatttaattttactattcatagttcttttgcttactttttatcttatatcatgtttaccgttttcataataattacttaagatcttattttgttatttttc

SEQ ID NO: 9045 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9046 - DNA, 70 bp, Diabrotica virgifera
  misc_feature (4)..(21): n is a, c, g, or t
tttnnnnnnnnnnnnnnnnnncttttctacctcgctatcagggattcataattaataattatacacttac

SEQ ID NO: 9047 - DNA, 761 bp, Diabrotica virgifera
ctaatagtggaggacggtgtcacaaacgagctccaattaaggacctcaatcactactatgggagatagtcttccgctgcatatccagcttttaggaagctgactctcaaccgccagcgaaattctggacggacaggaactggtgacccaactggaggttctgatgactgacaacaactgtgcatttttcagaccatccaggttaaccttctcccttttgaaatctgaagccgacaaacaactatctcatactataaacaaaacagcaaaacctgcagacgtcaaccatacattaactgtgatgaaggagctactgctgacatgtgacacctcatctgctgacttgaatatgtcgtccctattcacatccaaagtgactatacgctacaacaaccatgaaccctgcggaaacaatgcatacctgaaatggaactttattccatcattccacatacatgaccgctcctccccatctaccctgagggtaatcctggataaacctactgttcaaatcagaaatgacagaaaccagatgaatatgaatcgtactaactacttgccaaatttctatgacacactattgtaagcatcaactgctgtaaattcttataacaacatgatcttaactactcatgcatatcgtgagctctctgcaagtgtcttcatgtgaaattaattcccagaatctgatctctattaatttatatatccttattcatcctcattcgtattgagcaatcttgcattgacacacacttacct

SEQ ID NO: 9048 - DNA, 718 bp, Diabrotica virgifera
  misc_feature (16)..(88): n is a, c, g, or t
  misc_feature (128)..(147): n is a, c, g, or t
  misc_feature (149)..(161): n is a, c, g, or t
  misc_feature (200)..(243): n is a, c, g, or t
  misc_feature (245)..(257): n is a, c, g, or t
  misc_feature (259)..(322): n is a, c, g, or t
  misc_feature (355)..(370): n is a, c, g, or t
  misc_feature (372)..(429): n is a, c, g, or t
  misc_feature (459)..(484): n is a, c, g, or t
  misc_feature (486)..(501): n is a, c, g, or t
  misc_feature (503)..(520): n is a, c, g, or t
  misc_feature (522)..(557): n is a, c, g, or t
  misc_feature (605)..(626): n is a, c, g, or t
  misc_feature (628)..(658): n is a, c, g, or t
  misc_feature (662)..(694): n is a, c, g, or t
tagtttattagaatannnnnnnnnnnnnnnnnnnnnnnnnnnnnnnnnnnnnnnnnnnnnnnnnnnnnnnnnnnnnnnnnnnnnnnnngaattatatctggatcattctcgaattaaccagagctatnnnnnnnnnnnnnnnnnnnncnnnnnnnnnnnnnaactagtttttttgaaatgaaatgttattcgtttttagnnnnnnnnnnnnnnnnnnnnnnnnnnnnnnnnnnnnnnnnnnnngnnnnnnnnnnnnntnnnnnnnnnnnnnnnnnnnnnnnnnnnnnnnnnnnnnnnnnnnnnnnnnnnnnnnnnnnnnnnngaatttgatttttaaataaccattaggagtatnnnnnnnnnnnnnnnncnnnnnnnnnnnnnnnnnnnnnnnnnnnnnnnnnnnnnnnnnnnnnnnnnnnnnnnnnncagatataaatttaccttatttacatttcnnnnnnnnnnnnnnnnnnnnnnnnnngnnnnnnnnnnnnnnnngnnnnnnnnnnnnnnnnnncnnnnnnnnnnnnnnnnnnnnnnnnnnnnnnnnnnnncaacccgtctgtttgaactaaatataaagactcgcccgcccactgagnnnnnnnnnnnnnnnnnnnnnncnnnnnnnnnnnnnnnnnnnnnnnnnnnnnnnctcnnnnnnnnnnnnnnnnnnnnnnnnnnnnnnnnngaaagactgtctttatttagttta

SEQ ID NO: 9049 - DNA, 935 bp, Diabrotica virgifera
  misc_feature (104)..(140): n is a, c, g, or t
  misc_feature (148)..(928): n is a, c, g, or t
  misc_feature (931)..(931): n is a, c, g, or t
  misc_feature (933)..(934): n is a, c, g, or t
gcggtccgtttctcctcaaatcataaaatctctctctcttcgtaaatgtaaagaaaaaatctttatctctaacggatagttaatctagtatccgtcgagagaannnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttngnng

SEQ ID NO: 9050 - DNA, 957 bp, Diabrotica virgifera
  misc_feature (838)..(838): n is a, c, g, or t
ccaaaggtgctagtcagagttggtggtcaacttaacctatttatatgaaacaacgtcctcaaaaacttgggaattgactatgaactttgaacacatcaactgctgctactttaaattttagggtgactagttatgttcacatgtgttaacttctcattctaacattttttcttacgcctgtactacaactgttcttttaacctttttttcagttttctaatattttgtgaaacgtttggttcttcatattttttcttgtagaaaatatgcagatgactttgctataagatgcagatttgcagaaatatttctagaagtgtcctcttagattcacataaatgcttgtttgaatgtgtgatatctgattttataatcttgtatattttgatatgctgatatgtactattttcattttaagtaattagggtccggtattaacagcactcagacggccatcttatgttttatatgcagttctgttacgtgctctaagtcagtgctaagtagtcgcatgaaaataatttacagtatgcagcagggttatgaattcacgccgtcagttttttggaaacctaactcttcttctttttcttcattaaaaatctgttttttggtttctcatttggaagtgtatttcgtgagatattagaccgtttctataatttacctatgggatcaggataaatcgtttttcccaattttagcgccatctatccatagttcgaaaaaatgtcttgaataaaagttgactacttttacgtaaagaatccaaatttgcaagaaaaactgggggtttctatttgagattttaaagttaccccccaccccacctccaggngatgtaatgggggattgggtggttcggtgtcatttggatagaatttttgaaaatgggtgaacacgttatttttcagtttttttgatcccgatctttagttcgcgaaacatccgaccgtt

SEQ ID NO: 9051 - DNA, 65 bp, Diabrotica virgifera
  misc_feature (3)..(17): n is a, c, g, or t
  misc_feature (29)..(58): n is a, c, g, or t
gcnnnnnnnnnnnnnnnagacgagaaacnnnnnnnnnnnnnnnnnnnnnnnnnnnnnngtttttt

SEQ ID NO: 9052 - DNA, 719 bp, Diabrotica virgifera
accaaatatatcatactcacagactctctaagttcggtacagtcaatccaatatgtctacccatctaatcctttggtcatcaaaataaaacaagaagttcataccgctcaactgaatggaaaaattatcatattcctctggataccatcccatattggaattcaaggaaatgaagaggcagacaacgctgcaaaagaagctgcaactagtgatagtgcggagtgtactgaaacatttacgagtgcggatgtgaaagcggcgatcaaacgtaaagtgcggtatatgtgggaagaaaagtggaaagtgtcatcggccaagctacgcgaaattaaaaaatcgataaaaccctggccaacattaccaacaagtcggagagaccaggtaatattaacgcgactccgattgggtcatacgcgattaactaatagtcatgtgttttcctacaaacaagaaccaagatgtgacaactgtgaagaaaagttaacaatcaaacatttattggagaattgcgcagcattaacgccaaagcgcatattgtacaatataccaaacaaactgagtgacattttaggcctacagtgcaatatgtcaaatttaaagaggttcctaagtgcaattaacattttatacaatatataaaaacacaaatgtaataaaaattattgttcaccactattgtttcgctaatagccaatttggctgatgcgatttttgttaat

SEQ ID NO: 9053 - DNA, 514 bp, Diabrotica virgifera
ggccttaagttatttacttcgatgcgacaataatctatagctgaacagcgaataaatatatatccgaatctattttctctaataaaaagagactaatgtactctacgatctatattagcaaaatgcaattattcattatcataaaagcttttagctgaccccttgcttgctaaccaatggtgtttatgacagttggggacataaaatgttctcttattgtagagaatgggtgttgttaacttatctactgcgtctcttttggtatagaatagagttatgcgagattattatcacagtagcaatattgacttatgaaaggggagatcctcacgattattgcggaagcagatcgtgagttggataggattgaaatgtgatctagatgtaaagatggcgcatcagaataatgtgtattctacgacatgcatagattgcattgatcatggggtcggttatggaataataagcaatattaatcgaatcaaggaatgcagagcattgtatgatagtaact

SEQ ID NO: 9054 - DNA, 70 bp, Diabrotica virgifera
  misc_feature (4)..(42): n is a, c, g, or t
  misc_feature (44)..(45): n is a, c, g, or t
ggtnnnnnnnnnnnnnnnnnnnnnnnnnnnnnnnnnnnnnnntnnatatttttgatccatttttttgata

SEQ ID NO: 9055 - DNA, 800 bp, Diabrotica virgifera
  misc_feature (2)..(44): n is a, c, g, or t
  misc_feature (52)..(791): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttag

SEQ ID NO: 9056 - DNA, 929 bp, Diabrotica virgifera
  misc_feature (7)..(29): n is a, c, g, or t
  misc_feature (126)..(148): n is a, c, g, or t
  misc_feature (841)..(859): n is a, c, g, or t
ctttcgnnnnnnnnnnnnnnnnnnnnnnngtactcaagtctggactcaagtgtagctacaaattttgagtacctaaattacaaagtgatcatcaacaaattaagaagtgggataccctgtacattnnnnnnnnnnnnnnnnnnnnnnngtgacccatttttatgtggatattacttttataaatacatggtaataattaagaaaacaaacatacaaacaagcatacatttgggaaatgtaccgatagaaagggttgataaatacaaatacctaggaacctggatttcagagaaaaatgatcaaacaacagaaataaggaccaggatagaaatagcaagaaatgcgtttgtaaaaatgaaaacagttctctgcaacaaagaccttagcttagaactgagagtaagagctttgagatgctacgtgttctcgatactacaatatggacttgaaagctggacattaaagcaagaacacataaataagctacagtcatttgaaatgtggtgttacagaaggatgcttagaatagcatggacacagaggaaaacgaacacggaagtactgcgagaaatgggtaaagaatgcgaaataataaacacaataaaaataagaaagttacaatatctgggacacgtaataaggggaccgcgatatgaaatgctaagactgataatacagggaaagataagaggcggaaggagtatatagaaagaaggagagtgtcatggttaaaaaatttaagggactggtttagatgcagttctatagaactctttagagcagcggtggatagagtaaaggtagtaatgatgttatccaacctccgattaggagacggcannnnnnnnnnnnnnnnnnnacttttttgtatctttaacaaactgaatatctaactctggagtaccacttgatcaacctgtatgtataat

SEQ ID NO: 9057 - DNA, 618 bp, Diabrotica virgifera
  misc_feature (83)..(102): n is a, c, g, or t
  misc_feature (120)..(152): n is a, c, g, or t
  misc_feature (220)..(241): n is a, c, g, or t
  misc_feature (284)..(304): n is a, c, g, or t
  misc_feature (380)..(397): n is a, c, g, or t
  misc_feature (505)..(524): n is a, c, g, or t
catttattttaaaataagaaaataccccttaacaagacgaacgcataaatttattgagagctacttcatatactattgagacnnnnnnnnnnnnnnnnnnnncacatgatttatttttcnnnnnnnnnnnnnnnnnnnnnnnnnnnnnnnnncttatatattatgttactttctaacttcaactcacctactaaatttttctcttgattgctacctatcnnnnnnnnnnnnnnnnnnnnnnactgcactgtcgttctcctatatctctatctacttagcaaacnnnnnnnnnnnnnnnnnnnnncaacaacatatttataactatatatatgtacattatcacaaccactcatacgttccgggcttccttatccataccnnnnnnnnnnnnnnnnnntattagaaaaaaataatgaccattaacgtacctaaccaaacacatgcaatcatttatttatatatctaattatctttcttgtagatcatgtcttcatcaacacatacnnnnnnnnnnnnnnnnnnnnctactagtgcatctacactaattaaacgtttgtgtattaaccataactatataggatcaagaacggcactcgccattatttcctcccgactgtt

SEQ ID NO: 9058 - DNA, 465 bp, Diabrotica virgifera
ttgctacctcgagattcttaatgaatgtagatatatataacagactatgaagatctgaagatagtctcgcacgcgattagatagtcgagacatcaaacctgatctcctgttatgaagcgagccgatttatatttttggcctctagagtattataccatcaatcctggtagcgtgagagacagtatgtcctttaattcctccttactacgctcacagacactgtatacttatatggggagatgcggcttctcaaacttatatagtgctattatggcggacaggagggcgagatatagtgtgtaactatgtctatcggagtcggtagcacccttgtatgggagaaatcgcccgatgctatgtggtgacaatgcacacgcatcttggattaagataagcgtttaccgagatcccttgagatcagaatttctggatattttcatgatactcagcttgtaatgttatcca

SEQ ID NO: 9059 - DNA, 81 bp, Diabrotica virgifera
  misc_feature (7)..(7): n is a, c, g, or t
  misc_feature (10)..(10): n is a, c, g, or t
  misc_feature (24)..(24): n is a, c, g, or t
  misc_feature (30)..(31): n is a, c, g, or t
  misc_feature (66)..(66): n is a, c, g, or t
accttanggnatacagcgtaattntattgnnagagtcaaatcgataataaagatgcgacctcgatngtggataaagtttat

SEQ ID NO: 9060 - DNA, 964 bp, Diabrotica virgifera
  misc_feature (8)..(51): n is a, c, g, or t
  misc_feature (54)..(67): n is a, c, g, or t
  misc_feature (69)..(98): n is a, c, g, or t
  misc_feature (105)..(218): n is a, c, g, or t
  misc_feature (228)..(834): n is a, c, g, or t
  misc_feature (841)..(842): n is a, c, g, or t
  misc_feature (846)..(846): n is a, c, g, or t
  misc_feature (848)..(881): n is a, c, g, or t
  misc_feature (888)..(955): n is a, c, g, or t
cttttccnnnnnnnnnnnnnnnnnnnnnnnnnnnnnnnnnnnnnnnnnnnnccnnnnnnnnnnnnnncnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattnnatangnnnnnnnnnnnnnnnnnnnnnnnnnnnnnnnnnnttatttnnnnnnnnnnnnnnnnnnnnnnnnnnnnnnnnnnnnnnnnnnnnnnnnnnnnnnnnnnnnnnnnnnnncaatttttt

SEQ ID NO: 9061 - DNA, 52 bp, Diabrotica virgifera
  misc_feature (2)..(46): n is a, c, g, or t
cnnnnnnnnnnnnnnnnnnnnnnnnnnnnnnnnnnnnnnnnnnnnntacctc

SEQ ID NO: 9062 - DNA, 556 bp, Diabrotica virgifera
  misc_feature (2)..(122): n is a, c, g, or t
  misc_feature (136)..(289): n is a, c, g, or t
  misc_feature (404)..(421): n is a, c, g, or t
  misc_feature (466)..(485): n is a, c, g, or t
  misc_feature (495)..(542): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaaataaccttaaggataacaggggaatttttattggggaggttcaaatcgataataaagatgtggaccccccagggtgggatttaagttttttatttggtgggggcaacnnnnnnnnnnnnnnnnnngtttcggctttttaaaaattttatatggatttggggggtttaaannnnnnnnnnnnnnnnnnnngtgggggtgnnnnnnnnnnnnnnnnnnnnnnnnnnnnnnnnnnnnnnnnnnnnnnnncggggggggccgcc

SEQ ID NO: 9063 - DNA, 462 bp, Diabrotica virgifera
cctgtctttaaataaataataatggattaaatctaagagctaaatttaccaattaggtggagaattttagattaaaagtgacatttcaagcgagatttaaatgcaggttcttaaaccgtattacatatttaacatattattaagtctgacctatgtaactttgaaaaggacgccaggaggatgcactgatgtatatcccactaatgtattgcgaatttggacggaaagaatactcaatttggaaccttgttatacttgattaaatacataggactagtatggctagaagagtggtttttgtgttaaaatatgtgttgtaggttcatttataggtgagaggtgaatcctatttcttgtagcagtgggagctctatgtgtgggatagtaagtacgtaagaataacctactagaagggcgatttattatcagatatagttaataacaatcataagtgagtattta

SEQ ID NO: 9064 - DNA, 921 bp, Diabrotica virgifera
  misc_feature (62)..(79): n is a, c, g, or t
atataatgcctttcttaaggctctatgtttaatgtttagtatttaatttttagttgatgtgnnnnnnnnnnnnnnnnnngagaataatggatttccaaaacagacctggaggaaagaccggtggaggcggggtcgcctcttggtcggaaactaacagggatcgtagagaaaggcttcgacaactagctttagaaactatagatctacaaaaagatccctattttatgaaaaaccacttgggctcatacgagtgtaaactttgtttgacgttgcacaacaacgaaggaagttacttagcccatactcagggtaaaaaacatcaggcaaatttagctagaagagcagccaaagaggctaaggatgctcctacgcttttgcaaccagagaaacccagagtagaacctaagaagtttgtgaagattggtcgacctggttatagagtaacgaaacaaagagatgccgaaagtggacaacagagtcttctgttccagattgattatccagaaataagtgatatgattctaccccgtcaccgttttatgtcagcttatgaacaaaaaatcgaaccaccagatcgtaaatggcagtatcttctatttgcagcagaaccgtacgaaacaattgccttcaaagtaccaagcagagaagtagagaaaaccgacagcaaattttggactcattggaacaaggatactaagcaattcttcctacaatttgcatttaaaaatgacaataagagaactgttaatacagtggtccaaagacatacgattgttggtgcagcaccaccacccccaatgctacctgttccaccaccaccaagaccaccgatgttcaatcctattcctcctccacctccataatgagagctgtattaccagtgcctcctccacattaattatggtaaatctgtaatggtct

SEQ ID NO: 9065 - DNA, 661 bp, Diabrotica virgifera
  misc_feature (250)..(270): n is a, c, g, or t
  misc_feature (490)..(625): n is a, c, g, or t
gaagtaaagaatatacatctacaccaggagtggtaaatagaagcgttctggtaaaactttgggaattttgggactgggaagaattggaaaagaagtcgccattagaatgcaagcttggggaatgacgacaatagggtacgatcccattgtaccagcatcagaagccaagaaatttaatgtggaggctttggaactggagcaaatttggcctcgagtagattatattacagttcacactcctcttataccnnnnnnnnnnnnnnnnnnnnntgaagcagtactcaacaaatgtaagaaaggagtaaagatcgttaacgtagcaagaggaggtatcattaatgaatcagatcttctaaaggccctcaaatcaggacagtgtggaggagcggctttagatgtatttgaacaagaacctcctaaagatccagtcactttagacttgatccaacacgaaaaagttgtagctactcctcacttgggtgctagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatcatatgtatggtacgtacagcatccactctgt

SEQ ID NO: 9066 - DNA, 960 bp, Diabrotica virgifera
  misc_feature (847)..(847): n is a, c, g, or t
  misc_feature (856)..(856): n is a, c, g, or t
tgcaaaaactaagtccaatatcatgttaatatttatatttttgtactccgtggtatatttcctaggctgtgttcactcaaaatttaccactacaaagattggtccgcaaccgatttggaatgcaacatttacggacaaacttcgccaagatctgttgctgaattatgataaattttctagacctgcccaacattacaatgtaacaactgtaaaatttggcatgggtatacgacatcttgagttcaatgaattaaaatcatcacttacagtttacgcttggttgcggatgacttggaatgatgaaaagttaaagtgggatcctgaagcttatggaaatctttcagttttacacctagctgagcatgaactgtggcaaccggacatttatttatataacagtgccactagtactgccgttaaccaatttggaaatacgcacttcctagcttattcggatggaaaagttttatgggttcctccagcacaattggtggtactatgtggattgaacctaaaatattggccgttcgatacgcaagaatgttctttgaaattcgggtcttggacttacagtggagatcaaattgatctgctacattataatgataatgccgaggttgggctagaatttataataagcaactcagaatgggaactaactaacgctgtccaaacacgacacgtaaaatattattcatgttgcgctgaggcttatccagacataacagtaaatttaacgttaaataggatatctacctcgtacaaagcaatcatagtgacgcctgcatttgtggtgattatgttaaacgatgtaagttttactctacctccctcagctggtgagaanatatcatanatgcttgtacagcgatagtagtaagccttttttacgtatattttacacaaaagctaccaattatgggcaccgaacacccgtgatttgtgatgtctataccagct

SEQ ID NO: 9067 - DNA, 943 bp, Diabrotica virgifera
  misc_feature (420)..(438): n is a, c, g, or t
  misc_feature (562)..(600): n is a, c, g, or t
  misc_feature (729)..(729): n is a, c, g, or t
  misc_feature (897)..(897): n is a, c, g, or t
cttactgaagagataaaaataccgtgagaggtctataaaaaaatctctacgcagttgggtcagacagatagctgtttaccacaaaatacgtgattatcattctatagaagtcaatacaaatacaagaattttgtcttccgtttcacaacagatacgaaaatgaggtactgtcacctattattagcgacactttgtgtagttgtagtaactcttactaccgctactcctacttcgtttaatacacgtggaactatagaaaacgcaatacccactgacgaaacgtgttgctctatatctcactgtaaagaagtaccactcaacactgaaggccattcggtgttccaatgttacaaaactaaagtatgcggagaagaatgtctgcacaaacagaacaagaatatacctccattgccaacttannnnnnnnnnnnnnnnnnngtgaggaagatgtgtcggggttatgactgttatgattatgcctacgattgcagaaaatgtcctgatcctagtaaaccaagttttagtccttatactattgatgcagattgtataaactgttacnnnnnnnnnnnnnnnnnnnnnnnnnnnnnnnnnnnnnnnctcatatttttagataaatttgtttctttctttctttctttctttctttcttcccttccttttaccctaacagggtgtcggatttggtctagctattttacctgtcaactgtctatcttcctggtctanatgccgcttgttcttcttaaaacttcgtttctacttcttctattagtatcttctatattatttttgtataatatattttataacataccgacgaccgacagatagctctataaaggttatcgcagtttacaagttctccttttttgtataccgccattgatgatgttngtctgccatcttcaggtaattgtttgtttttccatgactctttata

SEQ ID NO: 9068 - DNA, 550 bp, Diabrotica virgifera
  misc_feature (464)..(511): n is a, c, g, or t
aaattagcgagtggtatacgattcttcagttcgataacgttcgtttactagaaactttcaagggtggaccaatgatactacaaaatgaacgacagtaagataaaagttcgcgatattatattcgatgggaatcgagttctcgcgggtgtgattagtcgcgagaggtatacgagtatatggataacccggacagggatcggggggataggaggaaaatgatgctcgtggttacgtcgacccgactagtaaaggggagcgagactcagatgttaggtcaagagggactactaatgggcgaggccggtaagcgtctcgtgtgagaagaatcagaaagaatagtgacaatagatgctcctcaaatatggggagagtgtgccgcctgagcggcgctgaatacagggggcatcggaggaagaaccttttcctcccgcatgaactcgtatggaatgattggattaggaggnnnnnnnnnnnnnnnnnnnnnnnnnnnnnnnnnnnnnnnnnnnnnnnnaaagtaggatcggaattgattgaatcctattctgttatg

SEQ ID NO: 9069 - DNA, 824 bp, Diabrotica virgifera
gaagaactaaaaaatttaaggttaatattttaaaacctatttttctaaggttttctaatatttctcaaaaataaaaatatagatagttgatttctttatggcatcaaaggctgtcaaaactcttgcgtttatttcaaaaacctactctgattggataaaggagtagctgctttacttccagaaccgtacaaaaatttttacaaggaatggagatttgctcaacctactgctgttcattatgtaccagaatctggaaattggaaaagaaatgatgtaacaggtgaagtatttcctgttcaaaatattccaattcctgtacattttccaaaagaatcaagttcacatatatggggtggagagggtgtagtgcaaggctttgaagagcgaaataaatttaagagaagagttcctcatttttgggatccacatttaaagagatcagtagtttattcggaagttttaaataaacacatctcagttataatcacagatagagcaatttctttgatcaatgcacactatggatttgatcactacttattgaagtcaccagcttgcgatcttcaatcattattatcactgagtataaaaagaaaaattcttcaagaacttgaaaatggttgccctacttatgcaaatagacctgaaaagcagaaggagatattggagcaatacgaaaaatatttaagcgcgtatacatctgaagaaattgagtggtatggctattcattgacagaagcctgtaagcgacttcaacgacaaatggaagcagaagaataagacaaagtagttcctttataacacgtatatagggctgaactgat

SEQ ID NO: 9070 - DNA, 520 bp, Diabrotica virgifera; identical to SEQ ID NO: 8614
  misc_feature (22)..(321): n is a, c, g, or t
  misc_feature (328)..(365): n is a, c, g, or t
  misc_feature (385)..(398): n is a, c, g, or t
  misc_feature (401)..(423): n is a, c, g, or t
  misc_feature (431)..(453): n is a, c, g, or t
  misc_feature (483)..(514): n is a, c, g, or t

SEQ ID NO: 9071 - DNA, 723 bp, Diabrotica virgifera
  misc_feature (27)..(45): n is a, c, g, or t
agtttgtagtaggtgtaataataatgnnnnnnnnnnnnnnnnnnnggaaagataattgtactacacatgagaagaaaggaaaaagtatggttctttgtgtttagttacttctgctttatttcgtctttctgaatgtgtgtatatcttcttactttcttacaaggggtagcgtcgttctaccacattgtatgtctattaacaattacagctgatctttaacagggtgactagctataaatactaaaaaatggcaaaagctaaagttaacgtggactggaagaggcgagttaagcaggaatacatgagattgcgacagattaaaagatataagagagccgatgatgtaaagctagcatggaatcaaaacagatcaaagatgagtgaaattcttattgaagaacagaaacgttggactgatggtaaagccttttggggaaacactccggaattaccagcccactcaacatgcatgaagaaagcagaagttattggcaatgaaggggatatacaggtgactaccattaaaataatgaacgcagtaacacctattccaaccatgtacacttgggcgccaatacagcaaaattttatggtggaggatgagactgtattgcataatattccttacatgggagatgaaattttggatgaagatggtacgtttaaagaggagcttattaaatacttatgatgaggaagcacatggtgaacgaatataaagga

SEQ ID NO: 9072 - DNA, 1249 bp, Diabrotica virgifera
  misc_feature (29)..(47): n is a, c, g, or t
  misc_feature (57)..(200): n is a, c, g, or t
  misc_feature (206)..(269): n is a, c, g, or t
  misc_feature (290)..(376): n is a, c, g, or t
  misc_feature (378)..(838): n is a, c, g, or t
  misc_feature (852)..(925): n is a, c, g, or t
  misc_feature (931)..(1013): n is a, c, g, or t
  misc_feature (1031)..(1048): n is a, c, g, or t
  misc_feature (1133)..(1151): n is a, c, g, or t
  misc_feature (1196)..(1245): n is a, c, g, or t
ccctccccgccccctgtattttttttacnnnnnnnnnnnnnnnnnnngtaaccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagnnnnnnnnnnnnnnnnnnnnnnnnnnnnnnnnnnnnnnnnnnnnnnnnnnnnnnnnnnnnnnnntttttagatatatctaattgnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaagannnnnnnnnnnnnnnnnnnnnnnnnnnnnnnnnnnnnnnnnnnnnnnnnnnnnnnnnnnnnnnnnnnnnnnnnnggggtnnnnnnnnnnnnnnnnnnnnnnnnnnnnnnnnnnnnnnnnnnnnnnnnnnnnnnnnnnnnnnnnnnnnnnnnnnnnnnnnnnnaccttaaggataacgggnnnnnnnnnnnnnnnnnngtcaatggataataagattggaaccccagggtgggattaaagtttaaaatggggggaaagaattttttatttaagtttggttcgnnnnnnnnnnnnnnnnnnntggttttgtgggtttaaacggggggggggggaagcagggggtggnnnnnnnnnnnnnnnnnnnnnnnnnnnnnnnnnnnnnnnnnnnnnnnnnngggg

SEQ ID NO: 9073 - DNA, 635 bp, Diabrotica virgifera
  misc_feature (21)..(39): n is a, c, g, or t
  misc_feature (120)..(150): n is a, c, g, or t
  misc_feature (156)..(309): n is a, c, g, or t
  misc_feature (327)..(356): n is a, c, g, or t
  misc_feature (359)..(378): n is a, c, g, or t
  misc_feature (577)..(597): n is a, c, g, or t
gctattagtttaggttgtacnnnnnnnnnnnnnnnnnnncttacgtaagctactcgatcgttatacaattctttacacaaactatatgacacgtttacatattgtttttattgaatttgnnnnnnnnnnnnnnnnnnnnnnnnnnnnnnnctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggcctttgaggnnnnnnnnnnnnnnnnnnnnnnnnnnnnnntannnnnnnnnnnnnnnnnnnnccccaaaatttacccccttgggcccctttttaaaaattccccatttggaaaaccgggggattacccaaaattgtcccccctggcccccccccccttttgccggggggggaaaagggaaaaggggcccccccctttccccttcccaaaaattgggggggtgggggggaaaaggggacccccccctttaccgttctattannnnnnnnnnnnnnnnnnnnnaatttcttggattcctttatcttcggggggcccgggtg

SEQ ID NO: 9074 - DNA, 71 bp, Diabrotica virgifera
  misc_feature (5)..(20): n is a, c, g, or t
  misc_feature (22)..(53): n is a, c, g, or t
cggtnnnnnnnnnnnnnnnncnnnnnnnnnnnnnnnnnnnnnnnnnnnnnnnncttttgatccattttttt

SEQ ID NO: 9075 - DNA, 723 bp, Diabrotica virgifera
  misc_feature (2)..(493): n is a, c, g, or t
  misc_feature (495)..(659): n is a, c, g, or t
  misc_feature (676)..(703): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtcattttannnnnnnnnnnnnnnnnnnnnnnnnnnntgcgacctccatgttggatt

SEQ ID NO: 9076 - DNA, 564 bp, Diabrotica virgifera
  misc_feature (15)..(339): n is a, c, g, or t
  misc_feature (362)..(399): n is a, c, g, or t
  misc_feature (419)..(432): n is a, c, g, or t
  misc_feature (435)..(457): n is a, c, g, or t
  misc_feature (465)..(487): n is a, c, g, or t
  misc_feature (523)..(547): n is a, c, g, or t
cccttcattccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatcnnnnnnnnnnnnnnnnnnnnnnnnncgaaaggaccaaatatg

SEQ ID NO: 9077 - DNA, 969 bp, Diabrotica virgifera
  misc_feature (335)..(352): n is a, c, g, or t
  misc_feature (373)..(392): n is a, c, g, or t
  misc_feature (686)..(708): n is a, c, g, or t
  misc_feature (858)..(859): n is a, c, g, or t
  misc_feature (882)..(882): n is a, c, g, or t
cctgatgatacatgaagtacgagtttcatccagcgaagataccaccccagaatatgaaagagtatttcagtatatctctgtaaaccgtcttcatttcactacattcgttaatagtactaaaataatgttatttatattgtttttattctgccttttgttattctacttatttatttatatttgacaaatattaactaaacgtaatagtatgacatatggaggaatattcataaccaatagcgttctttttgtgacttattttggactttacagggtattaaataaacttcctttaaacacaataacataaattttagatgaaggtatttctggcnnnnnnnnnnnnnnnnnngtacctgcataagtggcgatnnnnnnnnnnnnnnnnnnnncattgctacaaccactaaaaaatttaagaaaagtttgaatctaaacaaaggcactgtatatacactcaccggcacgaaaaacgggcaccccaaaaagtgggtcatttttgatgtcttgtatctcctaaacctgttatccgttttaagtaattttttcaacactttattctttaacgatatcgctgtaataatattgttgctagacaggtaaattttcgttgtatagcgggtgtaccaatcaaactgtttttttttttctcaattttcgcaacaccctgtggaatattctagtcnnnnnnnnnnnnnnnnnnnnnnncccaattatagccccgactgtgactgtaggttttcttaacgttttgtttttttacttattcgcttatgttagataataaaaaagtcagggactttaacaactagccaggttctttatcaatacagggtatttctaaataagtgcgacaannctttaggggtaattctgcatganaaaataatgaccgtttgcttgataaacctatgtctgcaaatgcttcgttttcgagatacgggatattgaattttttcttacaaactt

SEQ ID NO: 9078 - DNA, 181 bp, Diabrotica virgifera
  misc_feature (5)..(60): n is a, c, g, or t
  misc_feature (62)..(76): n is a, c, g, or t
  misc_feature (81)..(122): n is a, c, g, or t
  misc_feature (131)..(178): n is a, c, g, or t
taagnnnnnnnnnnnnnnnnnnnnnnnnnnnnnnnnnnnnnnnnnnnnnnnnnnnnnnnngnnnnnnnnnnnnnnntaagnnnnnnnnnnnnnnnnnnnnnnnnnnnnnnnnnnnnnnnnnnggggtgatnnnnnnnnnnnnnnnnnnnnnnnnnnnnnnnnnnnnnnnnnnnnnnnngat

SEQ ID NO: 9079 - DNA, 761 bp, Diabrotica virgifera
  misc_feature (122)..(142): n is a, c, g, or t
  misc_feature (448)..(466): n is a, c, g, or t
cggacgcgcgtcgccatttgagaataataagatatttttcaggaatcgcaccgacaactttgatttcctggtttactcagaattgcgccagaatatcctctttgtatatccgaacaatcccnnnnnnnnnnnnnnnnnnnnncgcattattagttagtaatcatatattcatccttctcgaatgtaaacgacctaaacaatcacaccttgtattgtacagtacatatctcagataatttttttgacacgaaatgtgatgtcgccctcacctatatctacttctttaaggaactaactaccctcatctaccaccaatatatctataacgaacattcttatattattaccatctagatatttctagggatgagctgaaacacatactcctactccgatttaatgtttaaagaccaagtcggattaaaaattctcatatatgacaacctgnnnnnnnnnnnnnnnnnnnactacgatgctgattcctcctccctcttttattacactataagtctgaattatttaacttcaccaatgatgacaatataatcattagcccattgtacctctaccaccaatattcaggtttatgaaaggaagtcggctacattttttccacctgttctatcatcaacatgtctttctgtattatccataaagacccgcctgcccactggttctctcgcatggccgcgccatgttgaccgtgctagcgtaccataagcattagttttctcctgccagctgcaatgaccggctggatg

SEQ ID NO: 9080 - DNA, 293 bp, Diabrotica virgifera
  misc_feature (2)..(3): n is a, c, g, or t
  misc_feature (7)..(8): n is a, c, g, or t
  misc_feature (19)..(19): n is a, c, g, or t
  misc_feature (21)..(45): n is a, c, g, or t
  misc_feature (62)..(62): n is a, c, g, or t
  misc_feature (144)..(144): n is a, c, g, or t
  misc_feature (180)..(197): n is a, c, g, or t
  misc_feature (240)..(282): n is a, c, g, or t
tnnatanntttttgatccnannnnnnnnnnnnnnnnnnnnnnnnntaccttagggataacangcgtaatttatttgggagaggttccaatcgaataataaagattgccgacctccgatgttgggataaaagtttattaattggnggtagcagcctttattattttagatcttgttccacnnnnnnnnnnnnnnnnnngatttgggagtttaaacccgggggggggggcaggggtgggggnnnnnnnnnnnnnnnnnnnnnnnnnnnnnnnnnnnnnnnnnnnaaagggacccc

SEQ ID NO: 9081 - DNA, 855 bp, Diabrotica virgifera
  misc_feature (11)..(91): n is a, c, g, or t
  misc_feature (93)..(396): n is a, c, g, or t
  misc_feature (398)..(747): n is a, c, g, or t
  misc_feature (774)..(774): n is a, c, g, or t
  misc_feature (826)..(848): n is a, c, g, or t
taattttttcnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttncaatcgataataaagattgcgacctcgatgttggattaagtttataattggnnnnnnnnnnnnnnnnnnnnnnntgttcga

SEQ ID NO: 9082 - DNA, 276 bp, Diabrotica virgifera
  misc_feature (16)..(34): n is a, c, g, or t
gtcagtgcaataaatnnnnnnnnnnnnnnnnnnncttatgtctttgcaattttgtacccatttttgaatactacttcaattatacaggatgtaccaagaaacgacaagacgagatttcccggactttttcactgaaaaggggcccctgcaacttaacgtaacccctatcaacttcggcaattccacatactggatgtcgtccctagcatgcaaacagaacgagggttttgcgccagcccccctccgtccatacgaaagacacgacactggtttact

SEQ ID NO: 9083 - DNA, 156 bp, Diabrotica virgifera
  misc_feature (5)..(149): n is a, c, g, or t
actcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacctc

SEQ ID NO: 9084 - DNA, 238 bp, Diabrotica virgifera
  misc_feature (133)..(155): n is a, c, g, or t
attcatgaacgaacataattattgcagtaatttttgaactgttaccaaaaacgttgtttaacaattgaaaaattgtgtaaaaaaagtaattttaaaaagctttgtctgcaagtaatactgcacaacggttaannnnnnnnnnnnnnnnnnnnnnnatagtttaatcgacttcttcaatggttggtccagcacctccagcggcgcctgcagctcctggagctgctccacctgggaaacc

SEQ ID NO: 9085 - DNA, 840 bp, Diabrotica virgifera
  misc_feature (771)..(799): n is a, c, g, or t
cagactgaaatctgccttaatggcgttaggattgaaatgtggaggtactttggaagaaagagctcaaagattattctcaacaaaaggaaaaggttccttggatccttcacttatgacgaaaaataacaaaggcaaagccaacaaagaaaaggagttattgagacaaagagaacttgcaactttagaagcccaagtgtacagattagcagagtgggtctcaccgcagagagctgcgacaaaagaaaatgtgcaaagaaaacaagctcgtactgacggagaaagagacgacagcgaaaatgaagaaagcgaagatgatagtcctgatgaaggtgacgatgatgttccgtataatccaaagaatcttcctttgggatgggatggaaaacctataccgtactggctgtataaactacatggtttaaacatcagctataattgtgagatatgtggaaattacgtttataaaggcccaaaagcattccaaagacattttgcagaatggagacacgcccacggaatgagatgccttggtattcctaacactgcacattttgcaaatgttacacagattgaggatgctttggcactgtgggaaaagctgaaagtccaaaaacaaagtgagcgttggcaacctgaaacagaggaagagtatgaagattctcaaggcaatgtggtaaatagaaagacttacgaggatcttaagagacaagggttattataggttatgagtagttgtagaaattatgtattgtatcaaaataaaccttttcnnnnnnnnnnnnnnnnnnnnnnnnnnnnncgacaaaaagtttttcgcgacctcctctttctgagtaaccc

SEQ ID NO: 9086 - DNA, 946 bp, Diabrotica virgifera
  misc_feature (694)..(713): n is a, c, g, or t
  misc_feature (816)..(836): n is a, c, g, or t
  misc_feature (888)..(888): n is a, c, g, or t
  misc_feature (911)..(911): n is a, c, g, or t
gtcttccaccacaaacttacgatgccttcgtgatgttcagtgacgacgatatcaactttgctattgagatcatcaacaaattagaagtacaatataaaatgaagttgtgtgttacttatagagacgtcatcggaggagaaaacagtcacgatgctgtgattaggttgatttctaccaggtgcaatagagtggttgttgtagtatctccttcatttttggaatgtccaactcacaaatatttttatactttggcccgaatggaatctattgaaacgagaagacgaaaaattattccgtgcatatacaagaagtgctttgacttgcctatagaatttcgagcatatcatctgctagactacactagaatggagtctacgttcggaaacttttgggatcatctttacaaatcactcaaagttgtgatacctccgtccacaccaagtgatgttacgtcgtccacgcaacgtgatgttacgtcgtctacgcaacgtgttcctccaataccccaagctgccatagcaccaaggaaaagcattgaatcaacaaagtccacgaatcacgtcaaattcgaatttttggaccaacctacagaagtgcctaaagttgagaataaaacaccacccgtagaaattcctgtagaaactccagcagctcctcaaccgactccatccactgatgaactcacccacacggnnnnnnnnnnnnnnnnnnnntttattcgaaagttcatgaaaatcgttcaaaaacacgatgataaatcagtaaaagaagtaccacaaatcaacggagtcgctccgaagaaaaaacgattctggnnnnnnnnnnnnnnnnnnnnnccggtggctaattgatgaacgtggagcatataattgagggtatgattattangtatccatgtaatttctcacagntattttgtgattctatgaaaaaaaaaacaaggtac

SEQ ID NO: 9087 - DNA, 702 bp, Diabrotica virgifera
  misc_feature (332)..(349): n is a, c, g, or t
cttatttattacgtatatttaaactgcttccgctaatcctacacgattattaccaaagtcaaattcggtgtagaactttccaatgaatacatctcctaggatccattccacatgagttctagtgttgaggtctaatcccatgaatccagaaatacatatgtcaataccgccgttagattgctttaaaacataatcatttccggaaagtgtgaattcttttcctccaaaaacaaaacttatttcccaagatgttgttgattttgggggtttacaagctaaggatcaattatttgctgaagctacccaggaacccggtttagctttccttgtgnnnnnnnnnnnnnnnnnnttaggaatgggataccctgaaatttccgttaacggaattactccagtatttaattcactggttgaacaaggcgctgtgcaagaaccagtcttctccttttacttgaacagagaccctgatggagaagttggtggtgaattgttgcttggaggatcagacccaaactattacaaaggtgactttacttatgtagatgtttcagctaaaggctattggcaagatgtatatggacagtcttaatgttggatcttccttaaaactatgttcaaatggatgtcacattgtctgagacactggtaccagtttgatcgctggacctatcgatgaagtcgaaaagttagataaagaaaaag

SEQ ID NO: 9088 - DNA, 167 bp, Diabrotica virgifera
  misc_feature (2)..(164): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgt

SEQ ID NO: 9089 - DNA, 783 bp, Diabrotica virgifera
  misc_feature (2)..(652): n is a, c, g, or t
  misc_feature (659)..(696): n is a, c, g, or t
  misc_feature (731)..(753): n is a, c, g, or t
  misc_feature (763)..(763): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntgttcgactnttaaattttacatgatctga

SEQ ID NO: 9090 - DNA, 79 bp, Diabrotica virgifera
  misc_feature (2)..(3): n is a, c, g, or t
  misc_feature (14)..(14): n is a, c, g, or t
  misc_feature (27)..(27): n is a, c, g, or t
  misc_feature (46)..(48): n is a, c, g, or t
anncatacaaaccnagggaaacagaanataatcactcaccccaatnnncagagtctacagaaacacaacgtttttgtac

SEQ ID NO: 9091 - DNA, 631 bp, Diabrotica virgifera
  misc_feature (4)..(609): n is a, c, g, or t
agtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaaatagtttttttagt

SEQ ID NO: 9092 - DNA, 639 bp, Diabrotica virgifera
  misc_feature (73)..(73): n is a, c, g, or t
  misc_feature (125)..(148): n is a, c, g, or t
cattcggccctcgcgacccatgcacgccctttgactgctgatcccgatgatggcgaagcgggagactattaantcttcaatcctgttgccatattatagagcgggagggatatccgccgtcagannnnnnnnnnnnnnnnnnnnnnnntttacctcagttgatatctatagatcgtgccgcaataacctcttctctgactgctgactgaagccgccgtgcacatctgatactccgtactgtacgtgatcctgacggcagatgtctgcggacgcaaccataccttgaccctccgtctgttgcatctcccgcccatgacgtctccgtcacagggagtattaaatgggactcatggattgcggccttccgcttccaagacaactcacttccaactgagtgatgcagctgcagcatgtaaaagacactggaatggctaccttggaagagacactgccccataaagaaaggatgaaacgacaagatttactcggtgccaacgacaaaatcttcaaagtacgacgggaagatacatacatgctcgccagaaaagatgacagaagattatacgcaggatatcctgccaacacctgtgctctaagttgctccaatacatctccctccattccataagaattgtcaca

SEQ ID NO: 9093 - DNA, 946 bp, Diabrotica virgifera
  misc_feature (155)..(174): n is a, c, g, or t
  misc_feature (490)..(508): n is a, c, g, or t
  misc_feature (563)..(582): n is a, c, g, or t
  misc_feature (712)..(729): n is a, c, g, or t
  misc_feature (820)..(820): n is a, c, g, or t
  misc_feature (845)..(845): n is a, c, g, or t
  misc_feature (860)..(861): n is a, c, g, or t
  misc_feature (864)..(882): n is a, c, g, or t
  misc_feature (894)..(894): n is a, c, g, or t
  misc_feature (904)..(904): n is a, c, g, or t
ggggctcctatttaagattttaaagtaaccctccaccccacctccgtggaagctcgtgtttggtgccattcgatagatttttcaaacatgttgaataagtgtatttttcagtttttcgatctgatgttcatttcgcgaaatatcgcgggattcgnnnnnnnnnnnnnnnnnnnnccccccacccctcttcgtgggaagtcgtgtttggtatcattcgatagatttttgattgggtgatagaaaccaaagaggagataggttgatacaattctgccaagataataatatgattgttacaaacacgttctttgaattacctaatagacgtttgtacacgtggaattcgccaagagataatgaacataagataatgagaaatcaaatagatcatataatgatcaaagaaagatatcgaaatagtattacagcagtcaaaatacaacctggagcagatatacatctaatcataatctcttagtagttcacatgnnnnnnnnnnnnnnnnnnntagagaaaacagcaaaagaagaaagaactgatataagtgcaccaagaaatccagnnnnnnnnnnnnnnnnnnnngaaagaattaacgaacgtctaaacaccgtacagattgagggcgaatgtagtgaagaaaatatcaacaaaaactgggaaaaaataaaggctgacttaatagaaccttcaaaaaaagtatctacgcaaaccnnnnnnnnnnnnnnnnnnttggatgacagacgaaatactaaacttaatgaacaaaagaagagcatataaggacaaaaataaatcgttataccagcaaacacaaaacganatacggcgacaaattcgcatagcanaagaaaatttggtannagnnnnnnnnnnnnnnnnnnngaatgggcacanattttatgangttagtatacactggcactatttcccataatctttttttttt

SEQ ID NO: 9094 - DNA, 795 bp, Diabrotica virgifera
  misc_feature (31)..(52): n is a, c, g, or t
  misc_feature (59)..(73): n is a, c, g, or t
  misc_feature (169)..(194): n is a, c, g, or t
  misc_feature (196)..(265): n is a, c, g, or t
  misc_feature (278)..(687): n is a, c, g, or t
  misc_feature (695)..(786): n is a, c, g, or t
aaatcaatcaaatatcatcttctctccagtnnnnnnnnnnnnnnnnnnnnnnctttcannnnnnnnnnnnnnnttcaattcagtatctcgcgaggcgaaatcatctttcactctttcatcaaatagaaaaaatcttatcttttccgtacctccgcgtatcaggggatcnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnntaacgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacg

SEQ ID NO: 9095 - DNA, 665 bp, Diabrotica virgifera
  misc_feature (62)..(82): n is a, c, g, or t
gcttagcgaggaactaatgaaaacgtctatccttttttgaatttaataccaacagatattgnnnnnnnnnnnnnnnnnnnnncaactccaagtcaacgtctagaaacaatataaatgaaagtattgaactaactaatgacattctaacaaccagtacatgtggtggaatcattttgtgcttttggcgtgatgtgatatattggaatctgtgagaattaggattgacgagataaagacggatgagaagtttccgagaagacatagaccaatgatataggaaaaatgatacaagagttagagaaaagaaagaacatcgacgaagcgagatgtggagggagccacattttataaccacttctgcctcgagatcatattcgtttactaacagcatgtcttcacatttgataaataagcaaactctgggatctctaccattaattgctaaaaaggaagaattcagagccaattctatgagcgtcatggatagcattcctacgttgaatggtgaacgtgattcgagaacgaaactattataagaaatttaaatgtattaagtggttgatattaagactaaggataaatggatatgaatctatgtaaaaatgagttacattgagagattgtgaattgagtgtactgctttgaaagatgtgtggatagtttac

SEQ ID NO: 9096 - DNA, 272 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggatggttnnnnnnnnnnnnnnnnnnnnnnnnnnnnnnnngaaaggacccaatatataaaataattctcatatttagataaatattacgaacagtgagatgacaaaatcctacaggaat

SEQ ID NO: 9097 - DNA, 674 bp, Diabrotica virgifera
  misc_feature (5)..(22): n is a, c, g, or t
  misc_feature (27)..(56): n is a, c, g, or t
  misc_feature (85)..(238): n is a, c, g, or t
  misc_feature (240)..(256): n is a, c, g, or t
  misc_feature (258)..(272): n is a, c, g, or t
  misc_feature (274)..(479): n is a, c, g, or t
  misc_feature (481)..(556): n is a, c, g, or t
  misc_feature (565)..(606): n is a, c, g, or t
  misc_feature (614)..(630): n is a, c, g, or t
  misc_feature (632)..(658): n is a, c, g, or t
gaggnnnnnnnnnnnnnnnnnncatcnnnnnnnnnnnnnnnnnnnnnnnnnnnnnncgaaagttattcgttttaaattatctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnngnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnntggaatgannnnnnnnnnnnnnnnnnnnnnnnnnnnnnnnnnnnnnnnnnaagaatcnnnnnnnnnnnnnnnnngnnnnnnnnnnnnnnnnnnnnnnnnnnntatagagtttataaat

SEQ ID NO: 9098 - DNA, 859 bp, Diabrotica virgifera
  misc_feature (140)..(157): n is a, c, g, or t
  misc_feature (167)..(236): n is a, c, g, or t
  misc_feature (248)..(681): n is a, c, g, or t
  misc_feature (684)..(739): n is a, c, g, or t
  misc_feature (741)..(771): n is a, c, g, or t
  misc_feature (773)..(796): n is a, c, g, or t
  misc_feature (798)..(854): n is a, c, g, or t
tctttttacgtaaatggtaaagaaaaaatctttctcttcaacgataagttaaattcagtattcggtcgagatgaatctctttctcctttctcaaaagtaaaaatcttatctttctcgtacctccgcgtatcagggattcnnnnnnnnnnnnnnnnnncttattcacnnnnnnnnnnnnnnnnnnnnnnnnnnnnnnnnnnnnnnnnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnnnnnnnnnnnnnnnnnnnnnnnnngnnnnnnnnnnnnnnnnnnnnnnnnnnnnnnntnnnnnnnnnnnnnnnnnnnnnnnncnnnnnnnnnnnnnnnnnnnnnnnnnnnnnnnnnnnnnnnnnnnnnnnnnnnnnnnnnataaa

SEQ ID NO: 9099 - DNA, 890 bp, Diabrotica virgifera
  misc_feature (372)..(386): n is a, c, g, or t
  misc_feature (389)..(401): n is a, c, g, or t
  misc_feature (405)..(439): n is a, c, g, or t
  misc_feature (475)..(494): n is a, c, g, or t
ataatcggaacaaattttattcgaaacatttttttatctcttttagtttatcgagccagagccttataaacaactaaatcgtttataacaatttttcgaccactcggatcgaaatccaccctcaaattcgtaatcagcagccaaggatccacggggggccgttgagtttgtccatcagaattggaaaggacacggtgacctctatttggcgcctagactagaactcgccaatgctgtaatctcatactcgtttcctaaaaaagttatcaagagttacaaattcaaacttttagggactacattgtgttcttaagttgtgcagaaaatcaaatacttaaatacaatgtggtacagaccaaaaaaaagatttgnnnnnnnnnnnnnnnctnnnnnnnnnnnnnaacnnnnnnnnnnnnnnnnnnnnnnnnnnnnnnnnnnnaggtaaactaaacaagaagaaaagattgttcgttannnnnnnnnnnnnnnnnnnngaagtaaaaaccgtaatttgtaaagttaaagttaactctaattttagatcgcatatataaactagttccctttcattaataggtgcacgtaattactcattgctcattaaattaatagtttcaacactaactgaaaaattcaaaagtagtattgttattacatttaaaaactggttggttaaaaaatatacaaagcaaaacagaagaacaaaacaggtttattagattaacagaagctaattcttaattaatctgcacaatatgtttgcaatattagttaaaacaaccaaatggacttctagcatagcgcgtcgaataatatattgcttgtagatactatgttagcgactctaaaacagttcttccgggtgcagatatagacattataattcaaag

SEQ ID NO: 9100 - DNA, 896 bp, Diabrotica virgifera
ggaaaatatagcttgttttatatgttcgttcatgggtattctttaatttttctgactaagacactgtaccaagttattctgaccaagaattttttgaacattttcgcctgtccaggaatgtggtcaatgacatttcagacagattcgaaaggagcacctactaccataataacactggaccctttggaaaaataccaggattacaccaagtacttatatttttatggtatgcggggcatcaaacatcaagttttcgagatgtaggagatcgttttgatgtaacagttagttctgtcaatagaattttatatagattgaccatgttcttgagtaacctatctccagagattataaaatggccaacagcagctgaaaaacatgtcagccaacaacattttgcaaataaaggatttccgaatgttataggagcaattgatggctgtcatataaaaattgatagacctgacaatgatcctgattcgtatatcaaccgtaaaggattttattctgttcagatgcaagctgtatgcgaccacaaaaaaaagataatagatttatttttgggttatcctggatccgtgcatgatagtcgtgttttcagaaattctcctctaaatgccaatttagaaagaaaatgtcagcagtattttcttttaggggatagtggatatccattaaggaataatttgcttaccccttataaaaataggggtaaccttacaaggcagcaacagaattataatgtaaaattgtctaaaaatcgttacgttatagaacactcgttttggtattgtaaaacaaaagtttcgtcaactttaccatgtaaagttgagaaacatacgttttatagtacattttattcgagctgcatgtgttctacacaatattgcattgga

SEQ ID NO: 9101 - DNA, 913 bp, Diabrotica virgifera
  misc_feature (683)..(683): n is a, c, g, or t
  misc_feature (696)..(696): n is a, c, g, or t
  misc_feature (702)..(702): n is a, c, g, or t
  misc_feature (711)..(712): n is a, c, g, or t
  misc_feature (737)..(737): n is a, c, g, or t
  misc_feature (760)..(760): n is a, c, g, or t
  misc_feature (846)..(846): n is a, c, g, or t
  misc_feature (885)..(885): n is a, c, g, or t
gttattatgattgggcttatttcgttaattttattttcacgaatccaccaatcctcaattaatttttcgcacttgtatatacagttccgccatacttctggagttgcaattgaaagtgcttctcgccaagtttcccaaaccgcttcgtctgtatacccattaggcccaatatggttgtcgtaatattattttgctattccccatatatattcgatgggattaaactggcagtggtatggtggaagacgtaaaacttgatgcccgtaactttcagtaacctgatccaccacaaagatttttggttttgcatgttcttttgccaaacgtaacaactcagactttaatatatgctgtggaatagatatgcgttcatttgttagccattctttaatcttatctacattccacgaatttgttggacttttgtttagtatttctgaatgataaggcgcattgtctaaaataattacgctgggctcacttaatccgggaagaagtttttcacgcaaccatttcacaaacatttccgtgttcatattgtcacgatagtcactgttttttgatgtagacgaaaatattaaatcagcaccttctataaagcctgtcttccctcccgcgtgcagattatatgtcgctttccttctccactagcatgcttgatcgattttatgttgtcatcttgncatattctcttgntagcanccttagaannatatcatgttcgtctaatatacaanagtgacccttcttctttaatatngtatatttattttctcagaaactcaattctcttgtgtacaacagaacttctttcacaaagcgcttttctgttatcctcttttttanatttgaatccctatgtatgtaggacttgccataaacttngtctgccgatgtcaccaaatttcctctc

SEQ ID NO: 9102 - DNA, 775 bp, Diabrotica virgifera
  misc_feature (100)..(115): n is a, c, g, or t
  misc_feature (684)..(706): n is a, c, g, or t
cccacgcgtccgcataaagataattaacgcccttaggcatgatatagaatatgaagtacagggtgagatgatcctaattccaaatttttatgtaaatcgnnnnnnnnnnnnnnnnttcttttaggataagtaaattttttatatatagctccaacaagggtggttttaagggttgaaatattatgatagtatatcttaaagcataaaacattcattatgtaactaataagaaccaaatgttgacaatattaaagtttaaaatgttattttataattttttacaactaggggtagttttcacccttacaaaaccaaaagcgtacaacggctcaatatagaaaatgaactagggggtgtaatgagcctaattccaaatttttgtacaaatcgatgctggacgaaaaaattgcgaggttttgccattttttcagcttcatttcctcgactactacggttgatcttgagctgtgatggctcataggtactgcgattatttaaatcagttcgtattaaactgttcaccggaggtgggtgaaattgcgcaatattgttctagcgatacgtggtaactattggcactgctagtatgtactactggtttttctcagatccaaattattttgtcactgtagattcgtaagagtatgtagtttcattgcatcagatctgattttctgttaatannnnnnnnnnnnnnnnnnnnnnnataaaaaatgcaccttgggggtaatgagagccactgtggcctccattacccccatatggtaaatacaat

SEQ ID NO: 9103 - DNA, 575 bp, Diabrotica virgifera
  misc_feature (3)..(27): n is a, c, g, or t
agnnnnnnnnnnnnnnnnnnnnnnnnncattcagaactttattacatattcttcagatttgtgttaatatcactcatacttaatacagcttacatacagattcttaataatcttcatcttcttcttcagttatattgctcattggctaccatttgcctcaaaagtggaaaacggctcccagaacttactggaaaagaaaatttccaccaaaaaagaaactactcacaaatgatgaatactatcaccaaggagtggaggaaacagagaaagcattgaaatcgttgagggactattgttcaagcccagactgcaatcaatggaagacagttttaaagctaaaagatgtgaagagggttgcttcattcgttgaggtttaatctcatttaagtgatgatgaagttatagaatatgactcctcttgttcatggacatgactgacgatgatgatcgggaggaaataacaggattagtagatgaagattatttagaaaatgaaagatagttgatttgagaatatgcgtgttgaaacaatgcttatagaaaagtagtatatatgtgaaagaaatataggcgtc

SEQ ID NO: 9104 - DNA, 649 bp, Diabrotica virgifera
  misc_feature (29)..(50): n is a, c, g, or t
  misc_feature (77)..(94): n is a, c, g, or t
  misc_feature (326)..(340): n is a, c, g, or t
  misc_feature (342)..(356): n is a, c, g, or t
  misc_feature (629)..(646): n is a, c, g, or t
gttatttcatgtcattgtgcaactttgcnnnnnnnnnnnnnnnnnnnnnnccactttatctaatatttaaatacttnnnnnnnnnnnnnnnnnnatgaatcgggaacttaatgaaagaaagctagccacaaaacaattctttctagtatttgtatacatgttcaccagtaaggaccaatatcttcgtaaaattttgcatcctggtggctctacacaactttgtactgcgttacttcatcttaaaaatttgtagtcagttgaagttcttattttgggcattaaatataattaccaggcaaagcaaataaacttatctgttaaagcgnnnnnnnnnnnnnnncnnnnnnnnnnnnnnnacatggtgttcagggatcttttgagttttcgttggtttttctagtacacgagacttagcggtcagatcgatgtaaaaatcagtgttatacacttttttacttttaagcaaaaaatagttaatttatacaagatttattttatacaaaaaagatatgtatatactctattgaggaatttttgtgaatttattttgacttggattcaatcggaacaccacgttccagagtttggttcggaaaaatgtcagttttgcatgtgtatagtctactacnnnnnnnnnnnnnnnnnnctg

SEQ ID NO: 9105 - DNA, 864 bp, Diabrotica virgifera
  misc_feature (380)..(401): n is a, c, g, or t
  misc_feature (606)..(628): n is a, c, g, or t
  misc_feature (742)..(742): n is a, c, g, or t
  misc_feature (747)..(747): n is a, c, g, or t
  misc_feature (755)..(755): n is a, c, g, or t
  misc_feature (759)..(759): n is a, c, g, or t
  misc_feature (799)..(799): n is a, c, g, or t
  misc_feature (808)..(808): n is a, c, g, or t
  misc_feature (810)..(811): n is a, c, g, or t
ctcgttcgttcgctttttctagataatcaatcattcgacacttaaaatatctacatatcggtacttatatcgccgaagtaaacgggatctcgggtgagtacttaaagagatttatttgtgttagttgtttttcaatagtgttcctatctcttttccggataatatgtattaattttagcattatcgttaccacggtttcctgaaatacagtatcctgtatgttctttgtttgtctactaactgtctacagtaaaaatatcctggtttttgttcacagctggtcgttccctagtatgttaataccagatagttctttgtttgccatccactttataaaacctcaatgaacctttgagatgcccttggtggatggtttctannnnnnnnnnnnnnnnnnnnnngcctactattagttataagtacctaagtatgtatatgtagttttccacagttttcactgtattccttcactcaaccgttctccccagttctttctgtttgcgagcccctttcctacagatttcttctttccattgcttcgtccacttcgtctctgaaagatcttcggggtctgcctctctcctttcttcctattattaaattccnnnnnnnnnnnnnnnnnnnnnnngttaccctggcagtgccattttatttaattctataaagacatgctttttatttatttgtaaagaatgttcacagaaatatagggttcattatcctaagcctaagggccccttanacttnaaaatggntggntaagtcataaacataatcccctctttataatcttctattngtagaaagntnngtagtatcaggaccactttgcatccctaattaataatctttctaacccccact

SEQ ID NO: 9106 - DNA, 96 bp, Diabrotica virgifera
  misc_feature (18)..(18): n is a, c, g, or t
  misc_feature (66)..(66): n is a, c, g, or t
aagttttgattaatttantaaggggataacactggagcattatctcgaccccgaaagacaaatacnatgtctttacacagtgctcatctaatacgt

SEQ ID NO: 9107 - DNA, 198 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnngaaagg

SEQ ID NO: 9108 - DNA, 188 bp, Diabrotica virgifera
cccccccacgccgcgagaatgaatagtttatcgacagtctagtccccacacgtgcctgatagttttggcaacactgatctgtataagccaaacgttccgttcttaacgtgaaataaagtataatattgtacatttttttaagaagtcagtaaatgtaacactgtttttaaataaagttgttagtgttt

SEQ ID NO: 9109 - DNA, 448 bp, Diabrotica virgifera
catttatttagttatcatgtaatatggtgcccttttttacatttgcagtctacattgaagacgaaattgtagctttggacggtctcgacaaatattaataacatatacaataatgtgtagagcgctgcaaaatcgtgggttgtgactcagcctcattttccatatgtgtcttgcaacaaaatgaacctaatcaacatcttcacctccttgtatgatatagaatcttgcccaatatacgaaaaatgactagtactcccttatatcatgtatccgattgtttaccaaggtgaacatccatcatctcacgcaatgaatgtatacgtggattttgatgacatattaactctacctaacctcgtcgaatacataaacggagacgaggaaattagatagctaccaaatcgaccatctgatctcgacgaacacattatagaataaattaagttag

SEQ ID NO: 9110 - DNA, 522 bp, Diabrotica virgifera
  misc_feature (23)..(323): n is a, c, g, or t
  misc_feature (330)..(367): n is a, c, g, or t
  misc_feature (387)..(400): n is a, c, g, or t
  misc_feature (403)..(425): n is a, c, g, or t
  misc_feature (433)..(455): n is a, c, g, or t
  misc_feature (485)..(516): n is a, c, g, or t
tgattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9111 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9112 - DNA, 776 bp, Diabrotica virgifera
  misc_feature (2)..(44): n is a, c, g, or t
  misc_feature (52)..(775): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 9113 - DNA, 1162 bp, Diabrotica virgifera
  misc_feature (3)..(45): n is a, c, g, or t
  misc_feature (53)..(583): n is a, c, g, or t
  misc_feature (592)..(674): n is a, c, g, or t
  misc_feature (676)..(778): n is a, c, g, or t
  misc_feature (780)..(817): n is a, c, g, or t
  misc_feature (821)..(888): n is a, c, g, or t
  misc_feature (890)..(890): n is a, c, g, or t
  misc_feature (904)..(928): n is a, c, g, or t
  misc_feature (951)..(951): n is a, c, g, or t
  misc_feature (1031)..(1050): n is a, c, g, or t
  misc_feature (1088)..(1153): n is a, c, g, or t
ccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnatannnnnnnnnnnnnnnnnnnnnnnnnnnnnnnnnnnnnnnnnnnnnnnnnnnnnnnnnnnnnnnnnnnnanttttttgattccannnnnnnnnnnnnnnnnnnnnnnnnaccttaggggtaacaccgtaaantatttgggggaggttcaatcgataataaagattggggacctcccaggtgtgggtgaaagtttttaaatgggtgtggcgcnnnnnnnnnnnnnnnnnnnnccactttttaaattttttctgattttggggtttaaacnnnnnnnnnnnnnnnnnnnnnnnnnnnnnnnnnnnnnnnnnnnnnnnnnnnnnnnnnnnnnnnnnncgcgcgccg

SEQ ID NO: 9114 - DNA, 327 bp, Diabrotica virgifera
  misc_feature (2)..(128): n is a, c, g, or t
  misc_feature (135)..(172): n is a, c, g, or t
  misc_feature (192)..(205): n is a, c, g, or t
  misc_feature (208)..(230): n is a, c, g, or t
  misc_feature (238)..(260): n is a, c, g, or t
  misc_feature (290)..(321): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9115 - DNA, 908 bp, Diabrotica virgifera
  misc_feature (496)..(523): n is a, c, g, or t
gaatgccagtagctaggtattctcggctattatacacgtaagtcacggagataaacgttcgacatattttataataagttgtagcgtttttccatcaagtttcacattttaccttttctcgcctaaaatccccggtttcgggccagctcgacacattatttgttaataagctttggaacacctaactaaataaaaagaaaacagccatactaaaatgctccggttaaatttgacactacctcccgggctattacaatattacaatttcatttacttatttagagaacgttgattataaacaaattccatgttctaggtataggatgagtacaggaccggtaaaagcatctgtgatgggaatttatcttgaagtcattaaaactggtcacatttctttaggggacactggtttacatttcaactactttagaaacaagaaaacacaaatggtttaatggtaatttgtacaagcataatattatgtacatcgtatacnnnnnnnnnnnnnnnnnnnnnnnnnnnnctttattacattttaaaatccattttaaatacaataaatgggtactattcattgggttttttgtataattggttattttatgcgcccatcttcatttcaccctccctagtatcaagatgatagtttaaatttttatatacttcagctttagcttttggcactgctatttttttatttcttataacacttttcaactctttcgagtctttctcagcaaatcgttcgagcccagacctatcctatctcatatgtatttaagagtttttaggcaaggagcacttgtcttcatcctggtccaccttcgcgtagcttcgcgtagccaccagcactcagtattaccatcgattaagagctgcagaaaatcgtatttgtcatttctcagtac

SEQ ID NO: 9116 - DNA, 193 bp, Diabrotica virgifera
  misc_feature (2)..(40): n is a, c, g, or t
  misc_feature (46)..(87): n is a, c, g, or t
  misc_feature (106)..(142): n is a, c, g, or t
  misc_feature (166)..(185): n is a, c, g, or t
gnnnnnnnnnnnnnnnnnnnnnnnnnnnnnnnnnnnnnnnctcttnnnnnnnnnnnnnnnnnnnnnnnnnnnnnnnnnnnnnnnnnnccctgatacacaagggacnnnnnnnnnnnnnnnnnnnnnnnnnnnnnnnnnnnnntctcacaatactaattaactatcnnnnnnnnnnnnnnnnnnnnacttttac

SEQ ID NO: 9117 - DNA, 277 bp, Diabrotica virgifera
  misc_feature (5)..(31): n is a, c, g, or t
  misc_feature (153)..(175): n is a, c, g, or t
  misc_feature (222)..(262): n is a, c, g, or t
ccacnnnnnnnnnnnnnnnnnnnnnnnnnnnccttaggaatacggcgaattttttttggagaattcaaatcaataataaagattgccgaccccgatggtggaataaaagttttttatttgggggaaaagctaaatttattaaggtttggttcnnnnnnnnnnnnnnnnnnnnnnngaatttgaggtttaaaacccgggggggggcccccggggtgggttttnnnnnnnnnnnnnnnnnnnnnnnnnnnnnnnnnnnnnnnnncgcaaaagggacccc

SEQ ID NO: 9118 - DNA, 1192 bp, Diabrotica virgifera
  misc_feature (82)..(103): n is a, c, g, or t
  misc_feature (122)..(652): n is a, c, g, or t
  misc_feature (654)..(845): n is a, c, g, or t
  misc_feature (847)..(937): n is a, c, g, or t
  misc_feature (1069)..(1087): n is a, c, g, or t
  misc_feature (1146)..(1179): n is a, c, g, or t
cttgtaatagcttcttataatttcaaataaatcataaactgattttttttctgaaccttgagcctcaaggaatattaaatcnnnnnnnnnnnnnnnnnnnnnncatctttaaaacatctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggataacagcgtaaattttattggagaagtccaaatccattattaaaaaaatgccgacccccaatggtgggatttaaagttttataattgggtggaagcacctaaattattaaagttttgttccnnnnnnnnnnnnnnnnnnnttgaatttgtgggtttaaaaaccgcggggggggccccgggttgtgggtttccttttctnnnnnnnnnnnnnnnnnnnnnnnnnnnnnnnnnnaaaaggcgccccc

SEQ ID NO: 9119 - DNA, 744 bp, Diabrotica virgifera
  misc_feature (387)..(400): n is a, c, g, or t
  misc_feature (402)..(414): n is a, c, g, or t
ggaatagaacatgttggttatggtcgtagtaaaataaatgcaaagaacacagctgccgaagctgcattaaaacattatgtaaagactaataaattgactgaggtgaaggtgaccaaaagagaaagagtacgtaggcgcaatgttagattaagcaaaatattacaacccaagaatgctgttatgatattaaacgaactagtgagaaacactagttatacagttgatgaattatcccagaaatatgatggcaaccaatttaaagctacagtgttatatgaaggaatagaacatgttggttatggtcgtagtaaaataaatgcaaagaacacagctgccgaagctgcattaaaacattatgtaaagactaataaattgactgaggtgaannnnnnnnnnnnnngnnnnnnnnnnnnngatgtatctgaagatgacgcaactcaagcacctttaccatggcaacatgttgcttcatttgctctgtacaaactgttttcctcatggggagaagatctcaatgtcaatcaaaatcagtcaatacctagaggagaaaaactgcatgaaaacaagcctgctaagaaaatgcctgaaaatccagatactattaatccattaatgcttgcgaatcagatgctaccacaagcacaatttgaggaaattggaaaaactggaaatcctccaaatgttcttttttcatccaaatgtattgttgacggagaatcatgtattggtacaggttcgaccgag

SEQ ID NO: 9120 - DNA, 172 bp, Diabrotica virgifera
  misc_feature (3)..(44): n is a, c, g, or t
  misc_feature (52)..(169): n is a, c, g, or t
ccnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgt

SEQ ID NO: 9121 - DNA, 841 bp, Diabrotica virgifera
  misc_feature (14)..(35): n is a, c, g, or t
  misc_feature (564)..(582): n is a, c, g, or t
ggcgtttagcctgnnnnnnnnnnnnnnnnnnnnnngtaaattgaattttaaattcaaccattgtttggttctggggctatttagcaagtatgcacacacatctgaacgaaaatgcccagatgaggaattttattctttggataagttcaactggttaattcacttacaacatgtaacaggaggcattcaggcttgtaaatctttaattattaaggaaattgaaagaagcaaaggaaaaaatgaatttgctttgtacaaacagggagagatttatcgagaggaagaaaagtttcaagaagctttagaatcgttccaaacgtgtttacgattaaatcccgagaatccggaatatctaaaagaagttgcgaaatgtctgttcgaaatgaaaagatataaattagctatggaagcttatttagaagctgaaaggctgtcaaccaatgcagactgtcaaatatactattatttaggacaatgcttacttaaattaggagatatcaacaaagctcaagaatatgcccagaaagctgtagaagccggaagccatgaattctgttttgagcnnnnnnnnnnnnnnnnnnngttacaaaaggaagttaaagctgcagtagctgtatcaaatgcggccgtagaattttcagatcttgtccagatagtgtgaacatgttaaccgaatcggggcttttatttctaaaaataggacaaagtgaatacgcctttgagagattaagctcagcgcttgcattagaacggcccatacaaaagctttgctggctattggatgtattatacagaaacacgaagactacgacgtggctctgtcaaaatataaaatggcgat

SEQ ID NO: 9122 - DNA, 857 bp, Diabrotica virgifera
  misc_feature (37)..(59): n is a, c, g, or t
  misc_feature (61)..(76): n is a, c, g, or t
  misc_feature (92)..(124): n is a, c, g, or t
  misc_feature (132)..(854): n is a, c, g, or t
  misc_feature (856)..(856): n is a, c, g, or t
gtccggtaaaataataaaatatctttttcgtaaatgnnnnnnnnnnnnnnnnnnnnnnngnnnnnnnnnnnnnnnncgtggagagaatcatnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnant

SEQ ID NO: 9123 - DNA, 51 bp, Diabrotica virgifera
  misc_feature (2)..(44): n is a, c, g, or t
cnnnnnnnnnnnnnnnnnnnnnnnnnnnnnnnnnnnnnnnnnnngtacctc

SEQ ID NO: 9124 - DNA, 81 bp, Diabrotica virgifera
attaggtcttatacacgtttatattttcggaaaacgcaatatatctatagaaaacaagcggtttattcgccgccatttcga

SEQ ID NO: 9125 - DNA, 822 bp, Diabrotica virgifera
  misc_feature (8)..(27): n is a, c, g, or t
  misc_feature (36)..(51): n is a, c, g, or t
  misc_feature (54)..(72): n is a, c, g, or t
  misc_feature (74)..(95): n is a, c, g, or t
  misc_feature (103)..(221): n is a, c, g, or t
  misc_feature (225)..(782): n is a, c, g, or t
  misc_feature (784)..(797): n is a, c, g, or t
ctttttcnnnnnnnnnnnnnnnnnnnncatttaacnnnnnnnnnnnnnnnnccnnnnnnnnnnnnnnnnnnncnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnagacgagagaccctatagagtttat

SEQ ID NO: 9126 - DNA, 194 bp, Diabrotica virgifera
gcggtccggcgagaacggcggcgggtttctcttcactctcaaaatcaatcaataatcactctccctcggtacaatggtcaaaagacaaaaaatccctacacctcgatcgatcagttaaatctcagtaactcggagagaaatatctttcatctcttcataaaagaaaaatttaatcttttcgtacctcgggtatc

SEQ ID NO: 9127 - DNA, 766 bp, Diabrotica virgifera
  misc_feature (69)..(93): n is a, c, g, or t
  misc_feature (96)..(112): n is a, c, g, or t
  misc_feature (176)..(199): n is a, c, g, or t
  misc_feature (274)..(297): n is a, c, g, or t
  misc_feature (313)..(358): n is a, c, g, or t
  misc_feature (426)..(501): n is a, c, g, or t
  misc_feature (503)..(518): n is a, c, g, or t
  misc_feature (587)..(612): n is a, c, g, or t
  misc_feature (718)..(730): n is a, c, g, or t
  misc_feature (732)..(748): n is a, c, g, or t
atattataacaataatttttagtaatagtgaagataattttatataatcggtagttagttaagattggnnnnnnnnnnnnnnnnnnnnnnnnngannnnnnnnnnnnnnnnnccccgggtatctagtagtattagttaataattatatagttattcgtttccgaattcgcaagagnnnnnnnnnnnnnnnnnnnnnnnncctaatatatatgttggataatttttttcgaatcgacacgttattcgttgttgcacatatctaattttttcctannnnnnnnnnnnnnnnnnnnnnnnctgatattcctattcnnnnnnnnnnnnnnnnnnnnnnnnnnnnnnnnnnnnnnnnnnnnnngaaatgaaattttattacaactcaatttttaaataagaattaggatgaccaatctttcatattttacnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnngatgatactattaccattataagattgaatatttagtaatactatatacgttcaataatggtattcacnnnnnnnnnnnnnnnnnnnnnnnnnntaacatgcctatctgtattaaatatcatgactcgcctgtccactggttgatttgaatgcacgtgtcattctgaccgtgctatggtatcatgatcattatgtattannnnnnnnnnnnntnnnnnnnnnnnnnnnnntatctcactgtgtttatt

SEQ ID NO: 9128 - DNA, 167 bp, Diabrotica virgifera
acacaatacttgttatttacaatgttttatatattttgtgaacatgtacactaaatacacaatacttgttatttagtgtacatgttcacaaatatttttgagatgaactatgtttctattaggtacgtaagtttttgttaaatattgagctctctatttcaatttat

SEQ ID NO: 9129 - DNA, 986 bp, Diabrotica virgifera
  misc_feature (71)..(83): n is a, c, g, or t
  misc_feature (85)..(103): n is a, c, g, or t
  misc_feature (846)..(846): n is a, c, g, or t
caataagtactcaccagtgacaacgtattaacgaagacatcatagttatataatttttaaccacaatatcnnnnnnnnnnnnngnnnnnnnnnnnnnnnnnnngatggtagcccttaacctaccctatctatatgtagtatataccctgtaaaatatattaagcttatattaaaacttactcttaaataaccaagggtaaattttgcgacactgccaagtcgtgaaataatacctctaggtactttccctacaacatttacagttaaaattaccttaattcgaccattaaattggtcgaacattttacatgatcaatttcaaataggattatttacttccaattattttcctattatttaaagtggaaaataaaactaaagtcatttagaagtcaatattgggttgacgaaatattttttaccaataggttaaaatgactaataagaaaatatttaactgtttgggtcattatttaacagcaatcctttagttctattgcatcatctaaatctgacctaagcctggattaagtgtgaaggaaagttaaagtatgcaaatgaaaacatattttctgacgcgatcttttttcgcgcgatcaattgcacgcgaccttatttcgtcggcgctgttttttcgccggcgaccttttgatacgcgctcaaatgtgcgcgacattttttcgctcgaccaattgttggcgaccttttttcgtagatccattatttatactactaaaagtatttaagaaacagatggtattttaatggagtaatatggtgaatatatggttggttgcatatgtttcaggagactaataaataaaataagaaaatactattaaattnctgtaattgtgagaggtattgaaataggttagaactgatattaaatgaggaaaattgagttgaaagaaatgtacatgtctttcacaaaaaaaaatattctgaatgtaaaaaagttgccacatattgaactattgaaaatt

SEQ ID NO: 9130 - DNA, 816 bp, Diabrotica virgifera
  misc_feature (44)..(63): n is a, c, g, or t
  misc_feature (79)..(114): n is a, c, g, or t
  misc_feature (117)..(187): n is a, c, g, or t
  misc_feature (199)..(561): n is a, c, g, or t
  misc_feature (563)..(814): n is a, c, g, or t
cttaacgatagttaatcagtaccgtgagagaatcactttatctnnnnnnnnnnnnnnnnnnnncttttcctacctccgnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 9131 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (135)..(135): n is a, c, g, or t
  misc_feature (171)..(171): n is a, c, g, or t
  misc_feature (173)..(174): n is a, c, g, or t
  misc_feature (176)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagnttaaaccggtgtgagccaggttggtttctatctttnanntnnnnnnnnnnnnnnnnnngaaaggac

SEQ ID NO: 9132 - DNA, 486 bp, Diabrotica virgifera
  misc_feature (325)..(342): n is a, c, g, or t
  misc_feature (347)..(365): n is a, c, g, or t
ataatttattataatacatattaatatacaaaatatatatttttaacgtaagtgtataacattcagttaatttttcttcaattgactaaaaaagttaagtactctaaagcacatttttgattaaaaagaagtaaaagtgagatttctacctgtaaatatatgtatattcattaaatttcttgcaatgcatcaaagaatatatttctgaagacgatcatgaacataatttgcttcatgtgaagaaaagataatatatttcttctttatatgaacaagctttaacaccaaatgtaaatatgtttatgtaatgtaaaaggaagccccnnnnnnnnnnnnnnnnnngaacnnnnnnnnnnnnnnnnnnngaatttaccacatcagattaaaaacagatgtataacctatgtgaggtgaagtatggaatttatccactaagtacatatacagatgactagacctctgagctggatttttaccatcaatatg

SEQ ID NO: 9133 - DNA, 680 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(405): n is a, c, g, or t
  misc_feature (407)..(420): n is a, c, g, or t
  misc_feature (427)..(460): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnntttatannnnnnnnnnnnnnnnnnnnnnnnnnnnnnnnnnggccccaaaatttttttccgggggggcttttttaaaacgggggggggggaaaaaccgggggttacccccattttatccctttgggaactcccccccttttcccgaggggggaataaaaaaagaggccccccccctcccccctccaccaaagatgggcctcttgaaggggaatggggaccccccctgtagcgggcttttaagggcggggggggtgggggtt

SEQ ID NO: 9134 - DNA, 864 bp, Diabrotica virgifera
  misc_feature (73)..(110): n is a, c, g, or t
  misc_feature (182)..(205): n is a, c, g, or t
  misc_feature (713)..(713): n is a, c, g, or t
  misc_feature (767)..(767): n is a, c, g, or t
gtttttcaataaagataccattttccttgaaatatgattccctgtgtgtataattagtgcattacgttttaannnnnnnnnnnnnnnnnnnnnnnnnnnnnnnnnnnnnntgacctgctatgcttgaaattgacaagatttgattaaggaagcaacattgtaatcttaaaaaaatatgccannnnnnnnnnnnnnnnnnnnnnnncacacctttattgcaaaaatgacaagttcaaattcgcacataacattgtccacttgttcttattcccttttatatacagtaagtattttatgacagaaagtgtgaaatacacattttcgccttcttgtccacttgccaaaggatagttttggcattcagtgaatgttgtatctgagggtcttaaacttgtgccttgttaaagtgtttatgttataccaagagaactgcttagtacatatagtaaggtaatcggtgctgccttgagtctactgaatgtcgagaagatgtaagtgctacacttttacatgtttcagggttttcttccctgaggtcagaattgcatcatcaattccagttattctgtagacacccttgtgcatcaatttgtatctaacatggagtttcatgtgaagatgttctgtgaaaattcgtttttaccccgttggttcctatctcacattagttctcctaatatgatggtcccaaaatgaagacgaaagaccactanatcacttatctttgatttgatttatttaattcaagaatttccaaataagcttanactatttttggaatacctaatttgttaatgttattgtatagacttggtcttgcaatggtgtcctatgctgctttttaagttaccaatataatcattg

SEQ ID NO: 9135 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (134)..(135): n is a, c, g, or t
  misc_feature (156)..(156): n is a, c, g, or t
  misc_feature (180)..(180): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanattttacatgatctgagnnttaaccggtgtgagcccaggntggtttctatctttaaattattantatattttagtacgaaagga

SEQ ID NO: 9136 - DNA, 69 bp, Diabrotica virgifera
  misc_feature (2)..(18): n is a, c, g, or t
  misc_feature (20)..(62): n is a, c, g, or t
cnnnnnnnnnnnnnnnnncnnnnnnnnnnnnnnnnnnnnnnnnnnnnnnnnnnnnnnnnnnngtacctc

SEQ ID NO: 9137 - DNA, 234 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (116)..(116): n is a, c, g, or t
  misc_feature (134)..(134): n is a, c, g, or t
  misc_feature (160)..(191): n is a, c, g, or t
  misc_feature (200)..(230): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgacttttanattttacatgatctgagnttaaccggtgtgagcccaggtgggtnnnnnnnnnnnnnnnnnnnnnnnnnnnnnnnngaaaggacnnnnnnnnnnnnnnnnnnnnnnnnnnnnnnntact

SEQ ID NO: 9138 - DNA, 333 bp, Diabrotica virgifera
  misc_feature (119)..(140): n is a, c, g, or t
  misc_feature (172)..(201): n is a, c, g, or t
  misc_feature (211)..(331): n is a, c, g, or t
accttagggatacagcgtaattttattggaaagttaaatcaataataaagatgcgacctccatgttggaataaaagttataaatgggggtaacagctatattattaaatctggtccaannnnnnnnnnnnnnnnnnnnnnaatttaaacccggggggaaccaaggttggttnnnnnnnnnnnnnnnnnnnnnnnnnnnnnnccaaaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 9139 - DNA, 348 bp, Diabrotica virgifera
  misc_feature (2)..(140): n is a, c, g, or t
  misc_feature (167)..(167): n is a, c, g, or t
  misc_feature (269)..(288): n is a, c, g, or t
  misc_feature (296)..(319): n is a, c, g, or t
  misc_feature (334)..(347): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattataagaaataaataccctcaggngataacagcgtattttttattgtgaagaggtccaatccaataataagatgtggggacccccaggggttggggattaaggtttttaatattggggtagcgcgnnnnnnnnnnnnnnnnnnnngttctccnnnnnnnnnnnnnnnnnnnnnnnntggggggtttaaacnnnnnnnnnnnnnnc

SEQ ID NO: 9140 - DNA, 477 bp, Diabrotica virgifera
  misc_feature (34)..(63): n is a, c, g, or t
ccccccccccggccggcggacgggggtgaatagnnnnnnnnnnnnnnnnnnnnnnnnnnnnnnagtatccttggatgatttttatgtgatggagaccagaaatacattgtacagacgaggagaaattcattgtcctgaactttgactcaagtgcaagtagacctgcatgcaatatatctcctctgggacagaacattatgctcaccgaaaaggacgattactatcacgacaaattcatggctctgcgacagaccggggatgggtgctggtaaatggtaacagcaggtgcgcctaccaaactatggcactatgtgtgacaccgcggtcattctgagatacatggctaaaccctatgttcatcagattatgatggaaagctgagaaggcttatgaaaattatagaaagtgggtgtgatggaaagggggagtcactatcgcggccttgttcctgccgtgcatatctagagtgtcagccaa

SEQ ID NO: 9141 - DNA, 50 bp, Diabrotica virgifera
  misc_feature (2)..(29): n is a, c, g, or t
  misc_feature (39)..(40): n is a, c, g, or t
  misc_feature (46)..(47): n is a, c, g, or t
gnnnnnnnnnnnnnnnnnnnnnnnnnnnnataatttatnntattgnnggt

SEQ ID NO: 9142 - DNA, 1057 bp, Diabrotica virgifera
  misc_feature (10)..(844): n is a, c, g, or t
  misc_feature (846)..(867): n is a, c, g, or t
  misc_feature (889)..(907): n is a, c, g, or t
  misc_feature (924)..(964): n is a, c, g, or t
  misc_feature (967)..(992): n is a, c, g, or t
  misc_feature (994)..(1036): n is a, c, g, or t
gatgaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnncacgaacacaccccacaagacnnnnnnnnnnnnnnnnnnngtaagttttttttcacnnnnnnnnnnnnnnnnnnnnnnnnnnnnnnnnnnnnnnnnnggnnnnnnnnnnnnnnnnnnnnnnnnnncnnnnnnnnnnnnnnnnnnnnnnnnnnnnnnnnnnnnnnnnnnnaacccagttttttttggaatt

SEQ ID NO: 9143 - DNA, 346 bp, Diabrotica virgifera
  misc_feature (9)..(31): n is a, c, g, or t
  misc_feature (33)..(52): n is a, c, g, or t
cccttagannnnnnnnnnnnnnnnnnnnnnncnnnnnnnnnnnnnnnnnnnncgagagaagtctaactttataaaccggaagacgtgtcttggccactcggtactattaaccgatgtcgagacaacctgtccatctcaaacttgcccatctcctagttctaacaggtagatttgctcatcgtgacatcgccattgctccgaatccacttgtgtcaagcggcaactcaggtctaccgccagcatcaggaccaaactcaccacgtgtgctggccccagagttattaccttatatctatactctcataattggttactatccgaatgcacgagaccttccatatactat

SEQ ID NO: 9144 - DNA, 578 bp, Diabrotica virgifera
  misc_feature (14)..(30): n is a, c, g, or t
  misc_feature (33)..(45): n is a, c, g, or t
tatcgcgtaccgcnnnnnnnnnnnnnnnnngtnnnnnnnnnnnnntttaacccacaaagttaaagcaagaaattgttaatttataatgcgaaagtttatttaacaaatggggaaaggaaatattgtaattttgggatccagcagaaataggttgtgggagatacattttccatgggcaaaaatgttcaaaagggcgaccaaagcagatagaatcgatcttcctttctcctagtgaagttgcagctaatctatgtgctgccctggctaaagcctctggctagtctccaagctgactacctatgagtacggacgatactgtaatgtttataggatcatgcaaattgcgaagcttctacaatcctggcatgggggtccaccattcccaactgtatgaagctggaagggctcagtcatagaaaccgacacagagagcgcgaaatgatatgtagcagatgatatagaatatgaccaataaaaaccggatacttaaagaagatgcatacataagatgaaatgcaaaagactatgcgcaaggaagacctaaatcaccgcgaataaccaagaccaaactctagaac

SEQ ID NO: 9145 - DNA, 274 bp, Diabrotica virgifera
  misc_feature (206)..(227): n is a, c, g, or t
cccgcccctctcgcgtccgcccaccctttcagaatgttctcatctcttcatcaaaagagccggaacttttttctctagatatagaattcgaagcaggaatgggatagacctattcttataaaatatagtactagctacataaccgagagtctcgacgctaattggttaaccaccacatatttcttgttctggaataaacacgagcnnnnnnnnnnnnnnnnnnnnnnagccatacgactcaaaaagaccggctttgtcatcgagacgttctgcc

SEQ ID NO: 9146 - DNA, 217 bp, Diabrotica virgifera
  misc_feature (2)..(48): n is a, c, g, or t
  misc_feature (55)..(203): n is a, c, g, or t
  misc_feature (214)..(214): n is a, c, g, or t
cnnnnnnnnnnnnnnnnnnnnnnnnnnnnnnnnnnnnnnnnnnnnnnnatgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattatttanttg

SEQ ID NO: 9147 - DNA, 290 bp, Diabrotica virgifera
cccccgcaaccgagaagatatcgcagcagagtggtttcatccgaaccatgatttcgttgtcacaagagaacggaagacaatgaggctgacacattactatcatcctcatatacttcataaatacttacgcgtgtagtcaccaatattgatgctacaatttgagatcgacttataaagttgaatctcttataacacaaccgcagattaccacagttcaacaaaaagtactgcttctgtttcccaaagctgtttatgttctgagatttacaataatgttcaatacactatcg

SEQ ID NO: 9148 - DNA, 929 bp, Diabrotica virgifera
  misc_feature (12)..(35): n is a, c, g, or t
  misc_feature (161)..(181): n is a, c, g, or t
  misc_feature (605)..(630): n is a, c, g, or t
  misc_feature (645)..(664): n is a, c, g, or t
  misc_feature (706)..(734): n is a, c, g, or t
  misc_feature (845)..(845): n is a, c, g, or t
  misc_feature (889)..(906): n is a, c, g, or t
gcataatctttnnnnnnnnnnnnnnnnnnnnnnnnaatacgctggtctaattagtaaagtacaaagagaggttatttaccagcaatttcattgctggaactaaattacaagatcatatatattatcaatacaggtatgcaaagttcgcagatagtgtgccnnnnnnnnnnnnnnnnnnnnngcgccgacaaatcgtatttttttcaattattgctctataactcagaagatcttaacttttcaccaaaaacactcaaataaaaattcaccccaattcaattctacatagaggcatgtttttcccgatttgctccgacgtataattttcctcggaaaatgggggctttcccaacaaaatctcgaattttcaaataatttttttgggccagtaattatttatcaataattacatagcccggtgaaataaaagccttcttggtagagattataaatttagaagccggtgaaaatgaaacgaatactctagcaacaattcaattgccaatcaacaatttacagtcgcagtaacaaccaaaacaatcatgagacattgatcaaacttaaaaagatcataaaggtgtgatgcctatttaacattttgtcgnnnnnnnnnnnnnnnnnnnnnnnnnngcataatctccaaannnnnnnnnnnnnnnnnnnnaaacaaattaacattaattatttatatgggaaataagccacnnnnnnnnnnnnnnnnnnnnnnnnnnnnncgtttcgacgcccaaatcgggtgccgttgtcaaaatacaaaatgccacaaggaaatagcttcagaacaaattaacatttctcagaaattgtttattatattctaattttanaaatacttaaaatgcgtatttaataggtctttgaaatgaatgcnnnnnnnnnnnnnnnnnncatctgcaaaaaagctatgaaac

SEQ ID NO: 9149 - DNA, 567 bp, Diabrotica virgifera
  misc_feature (55)..(77): n is a, c, g, or t
  misc_feature (91)..(91): n is a, c, g, or t
  misc_feature (107)..(141): n is a, c, g, or t
  misc_feature (163)..(203): n is a, c, g, or t
  misc_feature (205)..(232): n is a, c, g, or t
  misc_feature (234)..(249): n is a, c, g, or t
  misc_feature (251)..(268): n is a, c, g, or t
  misc_feature (305)..(327): n is a, c, g, or t
gcgccctcacggccgcggacgcgcgggaggaatttaaaaaaaagaacttttaagnnnnnnnnnnnnnnnnnnnnnnngatagaaagagagnaaaggaggatagggannnnnnnnnnnnnnnnnnnnnnnnnnnnnnnnnnnctttggaccttgcgaatcaggnnnnnnnnnnnnnnnnnnnnnnnnnnnnnnnnnnnnnnnnntnnnnnnnnnnnnnnnnnnnnnnnnnnnngnnnnnnnnnnnnnnnncnnnnnnnnnnnnnnnnnntctgcttttcttttatatagatatctaaatttttaannnnnnnnnnnnnnnnnnnnnnncttgatatatgataatttatttatttctatataattaatattcaatcttgtgagggatgtattacgatacctatatttatgaattcttagtttataattataggttacttctgctcaaatttgatgccataggatcaggtatctttttattttatagattttctcctgtatatgctgaaaattatgtattacacataagatataatttatgtaaaggtgatgatgttcaatcttattaac

SEQ ID NO: 9150 - DNA, 786 bp, Diabrotica virgifera
  misc_feature (2)..(46): n is a, c, g, or t
  misc_feature (53)..(165): n is a, c, g, or t
  misc_feature (176)..(779): n is a, c, g, or t
  misc_feature (782)..(782): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntanatta

SEQ ID NO: 9151 - DNA, 105 bp, Diabrotica virgifera
  misc_feature (47)..(47): n is a, c, g, or t
attaaggaaaatctaaatatgcaatcaaatttaatcaagaatagacncatcaaaagcagcctttttgaaagataggaaattactaagtatgagtaaccaaaaact

SEQ ID NO: 9152 - DNA, 934 bp, Diabrotica virgifera
  misc_feature (91)..(105): n is a, c, g, or t
  misc_feature (778)..(778): n is a, c, g, or t
  misc_feature (835)..(836): n is a, c, g, or t
  misc_feature (853)..(853): n is a, c, g, or t
  misc_feature (861)..(861): n is a, c, g, or t
  misc_feature (867)..(867): n is a, c, g, or t
ctagacgtaactggacctactacagaaactttgatgttacggaagatattctgaacaatgataatgttaacctggttttcgaaggtctcgnnnnnnnnnnnnnnntggttgtaaacgatgtcattgtgggttccagcagaaatatgtttgtgagatacattttcgatgtgaagaaagctttaaaagtgggacaaaacaaaatagaagtaagcttcctttctcctattgaagttgcagctaatctagctgctgaacaagctaaagcctatgtcgtacctccaacctgtccacccaatgagtacagaggagaatgtaacgttaatatgatcagaaaaatgcaagcttcttattcttgggattggggtccagcattcgcatctgtaggaatctggaaggacgcatacattgaatcctacgcagagagtgtaataagatatgtagcagttgatatagaagatgacgatcagaactggatacttaaagtcgatacttacctaggagacaatgcaaaacaccatgtgcaaggaaaacttacattacaacaaaaaaccgaagaccagactcttgaacaaagtgtggatattgacattgtgcctaatgaccacagtgaactacttcatagcagggtgatatccgtatccaaaaacgctgtcactccttggtggccaaatggatatggtggacaacaactttatgatttgacagtcacctttgatagcaaaagtggtgatgaatctaatagtaaggtcactcgaattgcatcaaagtttggttttgngttctacttgccctccacttcaaagtttatcttgtgccgttggttgcttttacttgnngggtgacagtcaacccnttcttggnggtganaagagcacgtttaaaaatgggtcccgcaatgggataattgactaattctgagcagcttcgttctaca

SEQ ID NO: 9153 - DNA, 750 bp, Diabrotica virgifera
  misc_feature (2)..(19): n is a, c, g, or t
  misc_feature (516)..(533): n is a, c, g, or t
gnnnnnnnnnnnnnnnnnngtaaataaacattaatttaatcagttaaatagttaataattgtaaatattttgtgtatgcatatgcatatatacatataataattagatcatgaagttttacaaagctaaagtggccgatgtattacggctgcaccaaagggacgaattatttataatggatgcagaacaaaaaatgcatctgtttttaaaattgatgggatcaggaaattatcacaggctgaattcttccatttctactatagcaagagtttggtattattttatgacatctatggaaaaattacaaaccttgggtgaagagtacactggaactataagatctaatactagtcatcagattccttccaaatctttgtcacttttatggttgatactgcacgttggaggagaacctatgttcgataggatattaaattattccaagaaaaagattttagcaagccaagatttaaggagtgacgtaaagtctttgctactgaagtgtattgcaatacnnnnnnnnnnnnnnnnnncacttaaaaggatacacaatgcattattctacatggatggaagatattacaatatttctaatagagtcacaggaattcagtatgtactactgagacaatggttggaagatgatacttttacaggaagtttttctatcttgggtaatttatctttattctatgtcctattaagttttgttatgaagatgtttactccaagtagcagttaccacactct

SEQ ID NO: 9154 - DNA, 279 bp, Diabrotica virgifera
  misc_feature (29)..(53): n is a, c, g, or t
  misc_feature (60)..(112): n is a, c, g, or t
  misc_feature (131)..(181): n is a, c, g, or t
  misc_feature (187)..(187): n is a, c, g, or t
  misc_feature (205)..(231): n is a, c, g, or t
  misc_feature (238)..(262): n is a, c, g, or t
gtttattaaaacatgtctttttggtattnnnnnnnnnnnnnnnnnnnnnnnnngattaannnnnnnnnnnnnnnnnnnnnnnnnnnnnnnnnnnnnnnnnnnnnnnnnnnnnttgaagctggaatgagggnnnnnnnnnnnnnnnnnnnnnnnnnnnnnnnnnnnnnnnnnnnnnnnnnnnagcttnatttttttaaagacgagnnnnnnnnnnnnnnnnnnnnnnnnnnnaatagtnnnnnnnnnnnnnnnnnnnnnnnnnataatttattatttggg

SEQ ID NO: 9155 - DNA, 920 bp, Diabrotica virgifera
  misc_feature (63)..(86): n is a, c, g, or t
  misc_feature (345)..(363): n is a, c, g, or t
  misc_feature (843)..(843): n is a, c, g, or t
  misc_feature (865)..(865): n is a, c, g, or t
attatccaacataagcaaatgaattaaaaaagaaaccgttaataaagcctaaggctacaatcnnnnnnnnnnnnnnnnnnnnnnnncacgctagaatattccacagggtgttccgaactttaagaaaaaaacacattatcgatcgttacacccggtataaaatgacctttacccgtatagcaacaataatattacatcgattttcttaaatattgaggctataacatactaaaaaaaatcactcaaatcagacacaggtttaagaaattcgagacttctaacgtgtacaattgagtcgattatttttctcttaagtgtattattaatcaattataaaaatagatnnnnnnnnnnnnnnnnnnnctataattcggtatattattttgtcaaatgatagaaaaattgttcccttgatacaatttttgtaatacacataataaatactaatttagttgaaatgtagccatgtttatataaacatagatagagaatgataaatatttcttggtattgataaactaccacttttcgagaattttgtagcatactgtatattatgtgtatataggataatttatttcatcccaaccatatttgtttggttgttattggatctctttaagttgtaagtactacctcattattttttacgtgtttctggtgtatatatttgaggttcctatatagagaagaactggattatataagtacttcagatcaaatagttttaaaagattttaaatattcatgaacaactaattttgacattatttttgttatcttaaaattcaaacaaaataataaacattggctctcagggaaaaccttgggattaatgggaanaggaagagttatgctactctancacataccataaaacagaaaacacatttcagaactaccgaaactaaacagtaaat

SEQ ID NO: 9156 - DNA, 51 bp, Diabrotica virgifera
  misc_feature (2)..(50): n is a, c, g, or t
cnnnnnnnnnnnnnnnnnnnnnnnnnnnnnnnnnnnnnnnnnnnnnnnnnc

SEQ ID NO: 9157 - DNA, 108 bp, Diabrotica virgifera
  misc_feature (41)..(41): n is a, c, g, or t
tacttttgtgaagtgtgtaccctttgagtcgaaggttctanatctcaggatcctaagaaaagccaccatggttgacgctgcagtttttggacaactttgaagtggatt

SEQ ID NO: 9158 - DNA, 922 bp, Diabrotica virgifera
  misc_feature (670)..(670): n is a, c, g, or t
gttgtttttaataattttactaaaaaatgaatatttgatataaccgattcatttctgaaacatataattaaactaaaagtgacctggttacatcggcaccataatggcttcaagagttacaggaaaccaagtacaagaaaaactatcaactagagtagcaacagtatctgtgattgtgatatttttaacttcattattagctttatccctagtctacaaaacatgcccgaatgtaacagaagcagaacgccaacatattaaaattccttggaacatagaagatgcaaaacaactaggaattgtattgaataaatacaaaattgacaattactatcaagtgatgactggagtttgtgttacatatgtatttcttcaaacatttgccataccaggttcactgttcctatcaatcctttcaggatttctattcccgttcttcactgccttaacgttagtgtgcacttgctcaatggtaggagcctcactctgcttcatgctgtcccagatattaggaagaaaactagttttacattatttccccgaaaaagctaggaaatgggctgtgcaagtggagaaacatagatcaaatatgttgaattacataatatttttaaggataacaccattctttccgaattggttcataaatttaacagctcctgtgatcggngtccctttgtacccgtttgcatttgggacattcattggagttgcacccccttcgtttatagcgataaaagggggccagacattacacgatatgacagctagtgacactgcatttaatatgacgtcatttgtttggctcatagtggtttggagtatgtcgcttatcccgatactattgaagaataggttaagagaaaagatggaataaactagtagatatatttatttaggttacttatttttattgattcaa

SEQ ID NO: 9159 - DNA, 834 bp, Diabrotica virgifera
  misc_feature (8)..(701): n is a, c, g, or t
  misc_feature (725)..(726): n is a, c, g, or t
  misc_feature (765)..(778): n is a, c, g, or t
  misc_feature (781)..(803): n is a, c, g, or t
  misc_feature (811)..(832): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggaganngtcaatcgataaataagattgcgacctcgatgttggatnnnnnnnnnnnnnnggnnnnnnnnnnnnnnnnnnnnnnntgttcgannnnnnnnnnnnnnnnnnnnnnag

SEQ ID NO: 9160 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9161 - DNA, 275 bp, Diabrotica virgifera
  misc_feature (3)..(44): n is a, c, g, or t
  misc_feature (50)..(72): n is a, c, g, or t
atnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaata

SEQ ID NO: 9162 - DNA, 864 bp, Diabrotica virgifera
cgtctctcgctgtcctgactactatatttgttgtcattcggcttatgtggtcattccattcttttcttctgtttcttacccagttattaatgttatccaccttgcatctccgtcgtatatctgcacttatagctctgtcccataaagtcttaccatcgatttttcgaagggttttcatctccgctgtttcgagcaatatttttgtcctctctgtgtcgggtcgcgtttatgctgcgtatgtcattattggtctgattactgttttgtaaattctgccttttaattcttttccgatatttttatttctccatattgtgtcattcaggcaacctgcgactctgtttgctctattcacttgatcttccacttctgtttcggagccttccgtagctagatagtgcgatgcctaggtatttaaactccatcacttgttctattatgtgcccttccagctccaatttacatcttattggaaataggtaactcgttgggaatttaatttctctttactctttaaattaatctttctataaatcagtgagtcgtttgccttagttctaaaaagaaaacaaaagatcattaaattttgatgttaatgataaccattttttagatttatgtcacactccacgttattttactttccaaattatttcctatccactatcctcaaatgtcattcctaataaaattcaaaccgactagaagccattcattctagaagccattaatgcattatttaatcataatcaatcctgctaattggttaattgcataacgtcttgtagctaatgaggttgtatcgcgagaactgaagtaagatcataatgcgggaccttatctttttagtattacattcactac

SEQ ID NO: 9163 - DNA, 869 bp, Diabrotica virgifera
  misc_feature (33)..(75): n is a, c, g, or t
  misc_feature (83)..(195): n is a, c, g, or t
  misc_feature (206)..(850): n is a, c, g, or t
  misc_feature (852)..(868): n is a, c, g, or t
caatactaattaactatcattaaatcgtatccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnc

SEQ ID NO: 9164 - DNA, 109 bp, Diabrotica virgifera
cagctatattattaactttaatccaacatcgaggtcgcaatctttattatcgatttgaactctccaataaaattacgctgttatccctaaggtaatttattcttataat

SEQ ID NO: 9165 - DNA, 872 bp, Diabrotica virgifera
  misc_feature (841)..(841): n is a, c, g, or t
agataatggtacttaaaataaaataaaagtatacaagataaaaataaaacggttatttttattttttctaaaatgatttggcaatattatatacattagtagattaaacaagagaaagattatatcatatgatgcaatatttagtgtaaaattctgttcaatagatcgtatgatttgtttgtaagagtgtcgcagtttaggaattagtagctgtgatgtcaaaaataagaaaaactatttaggttagaacaatcaagcactactttatctatgcttttatttgatattttctaaggcgttttacaagtttttctctctcgagctggaggtcacaggttatatctacaaatcctataaaatgttgaagagtaggaatatagtagaggagatattgtaacagggtgtttaaaattgtttcatacgtttcttaatacgatgttcacgtgttactaggcattcagtatatttgtaaataactgtagatagattatttttgataaattttgtattcgattttataaattgttgaagcgcttcttcttcattacgttttgtttgcatattttatgaaaagacctaacgcaagtcgcgtagatttagtgatgaccggatcggatttgtttcgatcagtgagtcggaaccgttacgtgtttgaaacggacctgagtacaaaaactgttctagacaggttggagctataatatgtcgatccactgagcagtaccactaatttattgctgttgcaacgaatcttcgatttaataaacattaacgaatccaaaacttaaaattataagcaaactcatgatttgcgatttatgatctataagtgtaatacggntattagcgcgctcatcactgtataaaatcta

SEQ ID NO: 9166 - DNA, 856 bp, Diabrotica virgifera
  misc_feature (13)..(44): n is a, c, g, or t
  misc_feature (48)..(706): n is a, c, g, or t
  misc_feature (718)..(732): n is a, c, g, or t
  misc_feature (734)..(755): n is a, c, g, or t
  misc_feature (762)..(816): n is a, c, g, or t
  misc_feature (828)..(851): n is a, c, g, or t
cccccccgggccnnnnnnnnnnnnnnnnnnnnnnnnnnnnnnnncatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctaagggaannnnnnnnnnnnnnngnnnnnnnnnnnnnnnnnnnnnnggattgnnnnnnnnnnnnnnnnnnnnnnnnnnnnnnnnnnnnnnnnnnnnnnnnnnnnnnnggatacacaccnnnnnnnnnnnnnnnnnnnnnnnngaaga

SEQ ID NO: 9167 - DNA, 948 bp, Diabrotica virgifera
  misc_feature (356)..(376): n is a, c, g, or t
  misc_feature (545)..(562): n is a, c, g, or t
  misc_feature (660)..(678): n is a, c, g, or t
  misc_feature (680)..(702): n is a, c, g, or t
  misc_feature (707)..(725): n is a, c, g, or t
  misc_feature (744)..(744): n is a, c, g, or t
  misc_feature (827)..(828): n is a, c, g, or t
  misc_feature (836)..(836): n is a, c, g, or t
  misc_feature (862)..(862): n is a, c, g, or t
  misc_feature (870)..(870): n is a, c, g, or t
  misc_feature (890)..(890): n is a, c, g, or t
gccgaaaatgttttcgaatagtgagtgtattacctattatgttattacctatgaatggtgtttgtgaaaggttacttgaaacatctattcggtatattaattattttcaagtaagtacaacttagttatttcagttcacaagtaaacaaattactgagacattatctggtgtatttaagttccactgtaaactattaaaactatgtaattcagttaaagccctcagcaatactcagcattcaacccatttaaaccttactaaatacataatactagttcggttaaaagatgtgtttttatggtaaaagatgtgtaattcgtttaaaattatgcaataggtatttcaatacatttcnnnnnnnnnnnnnnnnnnnnnacaaatagtaaatacaaaagtattacctactattaggttggattattttaaatactgttaatcacaatcacaaacgagttcttattatgttattattcgtagtgcgtacgatgttgccagtttattaaaatttccaaacattaaaatacaggtatatggaaaacaatgnnnnnnnnnnnnnnnnnncgggtaactttagaaaaaaatggtataggacttttttgttccaaattgtgtattctctccataccttggaggaacgcactattttccgggacaccctnnnnnnnnnnnnnnnnnnncnnnnnnnnnnnnnnnnnnnnnnnatacnnnnnnnnnnnnnnnnnnngcataaatttaatgctatncacttgttcaggggctcattcgatgggtatttctaagtgctttgacaaatgttttataagttttttataagatgcattatttnntccattanttcgggcttgaatacatagattttgngtactcgncggaaaaatgtacattcagntacatatagctcacttcccagtagcactaacaggtctttctggtggggagtttattta

SEQ ID NO: 9168 - DNA, 877 bp, Diabrotica virgifera
  misc_feature (696)..(715): n is a, c, g, or t
gaagtgggtgagtgtacactgtaaagtaaacgattcaagtgaaaaaataatgacttctctaactaaaggaatttttattgttggtgcgaaacgtacaccttttggtacatttgggggcaaattggccaaatctcacatcaccgatctccaagtaattgcttccaaaggtgccttagccgctgctaatgttaaacccgaactagtcgacactgtagtcattggtaacgtcattccgtctgtagcagctgatggtggtttccttgcaagacacgtattgctcaaatcaggtattcctttagaaaaacccgccttttcagtgaataggctatgtggttctggattccagtctcttattaatggattacaagacatatcgacaggagtagcagaggtagctctaacgggaggcgtggaaaacatgtcatcttgtccctacatcgtaagaaacatacggtttgggaacgttccactgggcactagtcccgttttagaagacaccttgtggttaagtgtgcttgatacgtactgtaatttgcctatggctttgactgctgaaaagcttggagaaaaatttaaactaacaaaggatgaaatcgatgagtttgcttttaattcgcagcaacggtggaaagcagctcaagatgctggaaagttcaaagatgaaatcgtacccgttccaattaaggagaaaaaggnnnnnnnnnnnnnnnnnnnngatgagcatccaagaccgtggactaccctggatatgttaaagaaactgcccacaatatttaaaaaggacggattggtcacagctggaacagcttcaggtatcagtgatgggtgcaggcgctgttgtcgtagcaagtgaagctgcctcatccaaacataacct

SEQ ID NO: 9169 - DNA, 811 bp, Diabrotica virgifera
cgcgagcgcctaatttgggatctcttggtagccagtactggacagtaccgttagtcgtacccgttcgcgaattcttgaatcgacacgcgtcttctgaaactctctttagaaataaacacattttgggtgttaattggtggttctattagtactttcagtgatgtttggagtgtctaaatgggtgtttttactatcatatatgtcgctagtggcgctacagtcgatcggccaagacggcaatttccgatctcaagaagttatcgataataatggacctcaaggtagaaacttactagactggattggatttggtactggcccggaaactgatccttatttagctaggaccaacggtgcctgtttaaatggtgatctagcagaatgctttaaatcgagagctctggcgtcctttgaggacttctttacaaaaccggaatattatctcagtgaaaatgcccggattagaaggatgcccgaaactcaacttcgacagttatctcaagagccttacgaatattcggagagtcccagagcagacgagccagagtgggaccaactacttaaatttggcaagagaaagttggaaaagttcttaaaatcaaccgtatttgagcttgattttgatgaagaagttacggagagaggaaggtactcaccaagatttattgacgaaattgctggagaaattgacattatagaagataaaaaagatactttatttaaaagaaaacagttgaagaagctcttcattccactacttctgggttttgaaattgtttaacttaaagttgtgcttttccttccgctcatt

SEQ ID NO: 9170 - DNA, 988 bp, Diabrotica virgifera
cccacgcgtccggctttcaaaatattgcatcattattaacctaaaattttataatattcagttgaagatatcattggattttttattggaaaatggctttgatgttagcttctagagtgtgtagggcatctaccctatcgaagacgactgtttttgttaaacagcccaatacgatcaccgtttaccgagcttttagcgaaggcaaagatgcagctgcaagaacagctagaaggcaagttggaattaaagagaaactcatgcaacctgcaggagatacagctttcaaatgggtagaggcgccctagcaggagcatctgcacttggaattggagctttggccttttatggtcttggattaagcagcgaagctagtgcacttgagaaacaacatttgtggccccagtatgtgaaagacagaataaaaacaacctacatgtacttcggaagctcgattgctatcaccgctgcaagtgctctagcagcagtccgttctcctgctataatgcgcctagttatggcaaatggattcatgggcttcgccatcagcttagctgctatcatggggactggtattctttgccaaagtattccatattcagaaggctttggaagcaaacaactggcttggatgctccacgctggaaccatgggtgctatgatagctcctctgtgtttcctaggaggacctcttttgatcagagctgcatggtatacagctggagtggtcggtggactcagtacaattgcagtttgtgctccaagtgaaaaattcctctacatgggcggtcctttagctatgggtttaggtgtggtgtttgtgtcatcaattggttctgtatttctccctccactacagcactgggtgctggctttgtactcattcagttgtatggtggtttgatactgttttctgccttcttgctgtatgacactcagaggataattgcacaagctgagagatatcctgcccatcccgatgcacttggaa

SEQ ID NO: 9171 - DNA, 743 bp, Diabrotica virgifera
  misc_feature (2)..(736): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttt

SEQ ID NO: 9172 - DNA, 426 bp, Diabrotica virgifera
  misc_feature (141)..(160): n is a, c, g, or t
cggatagacaatttcaaaatcccatgaattctgtagtttcatctatgccaagtaaggactaatgaacaaatcgttatttgatatatcgaacttctaaagtaacttccaggatagaatattgtcatagttctaccttagtgnnnnnnnnnnnnnnnnnnnngttacatggatgttttcctattcctatcataagggtgattcgtgaagaagaaagatatttgtcgaatgagcagagtatctgcataacaaagattgcactttaaggaaccgtctctcggtccgaaggttcaaattcattcagattatggtcgaacgcttatttaaaaaaatgagaatgttcgattgaggaactgaccagccctgcacaatgattgttgtgtcgagagctcgagcgatagacgaggatttgccttcctcatccttact

SEQ ID NO: 9173 - DNA, 61 bp, Diabrotica virgifera
  misc_feature (14)..(14): n is a, c, g, or t
  misc_feature (19)..(19): n is a, c, g, or t
  misc_feature (26)..(60): n is a, c, g, or t
aagaatttattttntagtnaaaaagnnnnnnnnnnnnnnnnnnnnnnnnnnnnnnnnnnng

SEQ ID NO: 9174 - DNA, 639 bp, Diabrotica virgifera
cggcaattcacaaagcgtgaagctcctctaaatggaggcggctatcccagcggcggcccttcccctccgtcttctagctatggggctcccataggaggaggcgggggtgggttcggaggcggcggtggattcggaggaggaggtaatggaaatggaaacggaaacggctttggaggcatatcttccagttacggagcaccaccctccagttcgtatggtgcaccaccttcgagctcttatggcgcaccaccttcaagctcatatggcgcaccaccttcaagttcttatggagcaccaccctcaggttcgttcggtccaccaccttcaaactcttatggtgcgccaccttcaagttcctatggagcaccaccatcaaattcctacggagcaccaccttcgagttcatatggagcaccaccttccaattcctatagggcgccaccttcaaggccttcttcttcttacggagcaccaaaacgtccatctcgaccttcgtcttcatatggtgcaccacctcgtagaccgtcttccagctacggtgcgcctccctcttcttcatatggggcaccaccatcttcttcatatggcgcaccaccctcctacgtcctttggatcacctcccttctcgttcatatggag

SEQ ID NO: 9175 - DNA, 153 bp, Diabrotica virgifera
  misc_feature (4)..(40): n is a, c, g, or t
  misc_feature (47)..(150): n is a, c, g, or t
  misc_feature (152)..(152): n is a, c, g, or t
agcnnnnnnnnnnnnnnnnnnnnnnnnnnnnnnnnnnnnntttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnant

SEQ ID NO: 9176 - DNA, 505 bp, Diabrotica virgifera
  misc_feature (2)..(266): n is a, c, g, or t
  misc_feature (273)..(310): n is a, c, g, or t
  misc_feature (330)..(343): n is a, c, g, or t
  misc_feature (346)..(368): n is a, c, g, or t
  misc_feature (376)..(398): n is a, c, g, or t
  misc_feature (428)..(459): n is a, c, g, or t
  misc_feature (466)..(499): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnaatatt

SEQ ID NO: 9177 - DNA, 520 bp, Diabrotica virgifera
gactcctatagggaaactggtcgcctgcagggaccgggccgggatccccgggcgccccccggccgggcgctgtgtgacgtccagacagtgtttggtataggaaaattctatatgactgatgagtatttatgttgaaatagtacattgtaatctcatttcattaaaacactgacgatgatcggtgcattgattgaatgtaaccattctatgattataccatgatcctcaggttgagattgagaccagagcatgcactggatattgcaaacactgagagaagaggtgataagaatgttatattcgggaagattaaaagatgctatgctaacgaccttgagagggagaccgaacagactctattataatcctcctattctttctaatgcttgatgtatctcctgtagacaactcagcttgaggtgtaaatttaactatgatatacgacttataccatctaattacgtgtatgactaagaacaacggcgttttgaagttaaaaaggatcaacattagccgattt

SEQ ID NO: 9178 - DNA, 902 bp, Diabrotica virgifera
  misc_feature (5)..(48): n is a, c, g, or t
  misc_feature (54)..(76): n is a, c, g, or t
  misc_feature (267)..(340): n is a, c, g, or t
  misc_feature (345)..(410): n is a, c, g, or t
  misc_feature (428)..(446): n is a, c, g, or t
  misc_feature (455)..(469): n is a, c, g, or t
  misc_feature (471)..(487): n is a, c, g, or t
  misc_feature (490)..(508): n is a, c, g, or t
  misc_feature (523)..(543): n is a, c, g, or t
  misc_feature (681)..(730): n is a, c, g, or t
  misc_feature (735)..(817): n is a, c, g, or t
tttcnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnntattttagaatatgaaactttttaatcctaatttttattgaagattagattttaatagaattttatttttaagctcatcccctag

SEQ ID NO: 9179 - DNA, 950 bp, Diabrotica virgifera
  misc_feature (895)..(895): n is a, c, g, or t
gcgttatttagttttgaaatgtagacttttctgacatttaattatttaaacttatttattcctaaatatgttgaaccaagtctctgtggaagctgtttattcagctacttacgtagaaaattatttggactgtgtagaaaatctccctgacgaagttcaacgcctgatttcaagaatgagagaattggatgttatttatttagctagactaagggaagtggccattcagacagaaaatatgggcaatgacaatcatgcaaaaaaggcaaaaagttttttaaggatgcaacaatctctaatagcagcccaagaattaggagatgaaaaaatgagtctactgcaggcaattttggacaaaatagaaattaaaactaggttattagaccaggatctaaaaaatttagattttggtaaagaagaacagacacaaattgagataaaggaacaacaatctcccctagttaacacccccatcaacaataataatggtaacaataccagcactaacaataataacagcaattctgtgaataatgatagacctgccaagcgtgctagaagaacaaggcatgatacttatacaggtgcagaaagtaatgatgccataccagtagagcatgttcttagaagccaagttccagctactacccccaccaatactgttcagcagaaaaacatctacaagtaaaaagaaaaaacgcaaatcccgtcaaaatacccaaatacaaaaagaagaaaccccaccaagagatgaagaaccactcatcgatccagacgaacccacgtattgtctctgtgatcaaatttcttatggagagatgataatgtgtgataatgatctgtgtcctattgaatgggttcatttttcatgtgtaaacgtatctacgaagcctanagggcagtggtactgtcccaaatgccgaggtgaccgaccccacgtgatgaagcct

SEQ ID NO: 9180 - DNA, 339 bp, Diabrotica virgifera
cagaatacgatagtctgtatatataattattgttttattgcgatatgacaggaagttatacataaagacttggactgcgactgtgtctttctcctgaagttccaacattttaccattcattgccgactgtatggcaaaggaaatcactgaccttactgcctccaacctgatccctatgatcatagattccccgtactcgactataggtcatggggatatgggctatagtgcttgccttgactacttccttcctgatgctgtctattctgcagatagtacatggaatttctcatacacgcagtttctccctatattgttcactcggatattatgtcaaac

SEQ ID NO: 9181 - DNA, 63 bp, Diabrotica virgifera
gtaagaccactacgtcgccgtcctggtgttaccataatgctgaggggattttaagtatttaag

SEQ ID NO: 9182 - DNA, 651 bp, Diabrotica virgifera
ccccccctcgcggccgagctaatcataaagatattggatctttatactttatttgtggaatctgaacaggaatggacggaacttcagtacagaattatagaactagtataagttatggaatggccggatcttcacttgtaaatgaccaccgtaatatagttagtgttacaactattgcatatatcgtacctctttttagagatataccattagacagttgcgtggacttataaaacattggtgtagactttttgatgggagatctcgccttaccatatgcattcaaggtacttcaccagaagacgatagcgtacaccgctcgcttgttaaaaatatacaggccacacataatcaaacaaatacctcaatcttccagcggacgcataggactgacgcaggagcccacttccaaggctctgcagaatttggcgatcaccgacctgatctgcttctatatgaaaatgtattcgtgtcagtctatcagtagagtcttgtatattagggtttacatgtctcttggacatcctgtagctccagggtgttgtgcaatattggactggataatagggcttaaatggatcaaggaaaacattaggaatgttgtgggagatcccgaccaaataatcgcttggggacagagcgccggaaacg

SEQ ID NO: 9183 - DNA, 856 bp, Diabrotica virgifera
  misc_feature (22)..(60): n is a, c, g, or t
  misc_feature (663)..(677): n is a, c, g, or t
  misc_feature (680)..(692): n is a, c, g, or t
  misc_feature (718)..(718): n is a, c, g, or t
  misc_feature (749)..(749): n is a, c, g, or t
  misc_feature (840)..(841): n is a, c, g, or t
ggccgatgatgatgacgagggnnnnnnnnnnnnnnnnnnnnnnnnnnnnnnnnnnnnnnntcaggatctcgacgataaagatggtgacgaagaggagcaagaggatgatgatcaagctagtaatgaaaacgacgacaccgctgatacagatgatgcaaaggaaactgaacaagatgaagatgatggaactgatgataacgtcaaagccgctgatactaccaaagaagtaaaaaaaccgaaaaaagccgagcaaaagcaggaaccagaagctgagggagaagaaaaagacaacgaaggcactgtggatagttctggcactgaggatgaaatcctgccagctgaaaaggctcctccaaatatacaagacagaaggaacactataatcgtccctccggctttcaaagaagtagaaccagatatagaacacgttgaagaagacttttctgacgaagacgacgataaagacgatggagaggaaacagtagagcccaacaccgctaaagctaaatatcaagaactggcaacggcgtacatccggcctgttagcaatgagcatgaaagtactaacagagaaatagagtatgaagacgacgaagatgaacaggaggaggaggaagtgtctgaagaggaggagggagacgaacgagatgaaggacaggaatnnnnnnnnnnnnnnntcnnnnnnnnnnnnnttgatgatgaagacgaggaactgctncagcgttttggagctcgttacggaaaactcncagagaatattgataagaaattccctgaaaagcctgagtctgactctgacagagactcagaagataatgactatgagtataccaacattannctatgacaagattct

SEQ ID NO: 9184 - DNA, 62 bp, Diabrotica virgifera
  misc_feature (2)..(26): n is a, c, g, or t
  misc_feature (28)..(48): n is a, c, g, or t
cnnnnnnnnnnnnnnnnnnnnnnnnncnnnnnnnnnnnnnnnnnnnnncaataattctttga

SEQ ID NO: 9185 - DNA, 145 bp, Diabrotica virgifera
gcccccttccggcccgcatcatggctagaatcattcttctttccatcttgctctccgtaatctacagcagcgacggcttttctgggggagctgctgaagatgtacgtgaggataagaattttgttgacagagcaggacctctcca

SEQ ID NO: 9186 - DNA, 542 bp, Diabrotica virgifera
  misc_feature (10)..(63): n is a, c, g, or t
  misc_feature (68)..(90): n is a, c, g, or t
  misc_feature (119)..(146): n is a, c, g, or t
  misc_feature (270)..(289): n is a, c, g, or t
  misc_feature (306)..(334): n is a, c, g, or t
  misc_feature (337)..(414): n is a, c, g, or t
  misc_feature (440)..(464): n is a, c, g, or t
  misc_feature (494)..(537): n is a, c, g, or t
tggggtgatnnnnnnnnnnnnnnnnnnnnnnnnnnnnnnnnnnnnnnnnnnnnnnnnnnnnnntccannnnnnnnnnnnnnnnnnnnnnngtaccttaggggatacagcgtaaatttannnnnnnnnnnnnnnnnnnnnnnnnnnntgcgacctcgatggtggataaaggttataaatgggggagcagctatatttataaggctggtcgactttttaaatttttacttgatctggagttaaaaccggggtgagccaggttgggtttctannnnnnnnnnnnnnnnnnnntttagtacgaaagggannnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnntgagggggtccgggggttttggggannnnnnnnnnnnnnnnnnnnnnnnnagggctcttttttattagggggggcccccnnnnnnnnnnnnnnnnnnnnnnnnnnnnnnnnnnnnnnnnnnnncaaag

SEQ ID NO: 9187 - DNA, 277 bp, Diabrotica virgifera
  misc_feature (2)..(237): n is a, c, g, or t
  misc_feature (250)..(271): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttttcttacnnnnnnnnnnnnnnnnnnnnnncttata

SEQ ID NO: 9188 - DNA, 700 bp, Diabrotica virgifera
  misc_feature (4)..(421): n is a, c, g, or t
  misc_feature (428)..(465): n is a, c, g, or t
  misc_feature (485)..(498): n is a, c, g, or t
  misc_feature (501)..(523): n is a, c, g, or t
  misc_feature (531)..(553): n is a, c, g, or t
  misc_feature (583)..(614): n is a, c, g, or t
  misc_feature (621)..(657): n is a, c, g, or t
  misc_feature (661)..(661): n is a, c, g, or t
ctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattngatcgtcaaactggaaaaactgatatggctaatgaatac

SEQ ID NO: 9189 - DNA, 539 bp, Diabrotica virgifera
ggagccgcgggcgggaattcccggggcgcctttcccgcccggggattgttggaattagaacaggatgggtgcttacttccttaagaagtttagtacgagcagaattacgatggaccagatctttaaatggaaatgtacaaattgtaaatgtgattgttactggtcgtgcattaattatcggattttatagaggcatacctatattacttgtagggtgaataaatagagttgtaccactatataattgatgctcccgtaataacattcgatctaataaataatattgtgaatttgattgcttcccccgactcttttattagtactactataaacgatatgatattgggctggtggtacgagatatacaggtaacccgcctcggacatataaaattgtccatgtaggtaaataagaaataaagatagtttatacttacatttatctggaaagtcttgaattttaggtgcaatatatgttactatatgcagaaattttgatacgacaattatgagtagcctttgatagaatagccgtacatg

SEQ ID NO: 9190 - DNA, 754 bp, Diabrotica virgifera
tgataatttgttattcattagttgctaatttgacatacactggtggtatatattgaggaatatattaatttactgatttttaatgacacagcggtttaccttctaattttctaatattaacaaaggtcaacaacacactgcaatactgcaatcaaaatgtcttcagtggaatccataaaagatattaaagaacataagaaacatagtcatagaaatagaggtttttgtagttatgttagaacaatgctgctcaaagtttttctcttcacaagatactacattgatattcttatagacgttatatttggatattttaatgactcaaagagagttccaattaaaaaatgtactaatccaataattcttgaaagtgctacatctcttgcacaaaaaataagaaagagagaattaacatcagaagaaatagtacaagcatttgttgacagaattaaagaagtaaatcccgttttaaatgctttggtagattctagatatgaagctgctttagaagatgctagaaaaatcgatagagatatagcaaatggaacaattttagatgttgattttcaagaaaaaccatttttgggcgtaccatttacaaccaaggaatcaacagctgtagaaggaatgtcatttaccttaggtatagtaaagagaagaggaagaagagctgtatttgatgcagagtatataacccttatttaaaacgcaggagcgatatgtttaggggtgacaaatataccacagttgaatt

SEQ ID NO: 9191 - DNA, 819 bp, Diabrotica virgifera
  misc_feature (45)..(62): n is a, c, g, or t
  misc_feature (276)..(318): n is a, c, g, or t
  misc_feature (438)..(460): n is a, c, g, or t
  misc_feature (523)..(543): n is a, c, g, or t
aacgtccttagtattgttttatctacggtactcatccaggcattnnnnnnnnnnnnnnnnnnatccgattcatacaggagatagatttagtgagatagagatataatgtagtaattagactttaatgtatcttcaactaaattactttttctttagagatatacctgaaattgtaaagaacaggaaaattaaataagaaccaaaaactaaagtgaaccaacaataattgaacattccaaaatacactttttttgttaagttaactaaacgacatannnnnnnnnnnnnnnnnnnnnnnnnnnnnnnnnnnnnnnnnnntaatttggataaggtgtttttatattaagtgtgtaattataaagtttttttatagcactgtatagaatcatacaataaactattgtctgctcattgaatttggaaaataaacctttggtnnnnnnnnnnnnnnnnnnnnnnnggcttagcgaggaactaatgaaaacgtctatacatttttgaatttaataccaacagatattgnnnnnnnnnnnnnnnnnnnnncaactccaagtcaacatctagaaacaatagaaattaaagtaattaactaactaataacattctagcaacctgtacatgtggttgtattactctgttttgacattgacaaaactagctatgtgatcagttatctctagcagtaataaactctagctgtattttgttttatatatttgtccaaagaattggtttattttaaagcaaatataatggttcaaccaattttgtccgattgactaaaaaaaattcaagccaaaattatgttttatgtttaat

SEQ ID NO: 9192 - DNA, 112 bp, Diabrotica virgifera
  misc_feature (9)..(106): n is a, c, g, or t
  misc_feature (109)..(111): n is a, c, g, or t
aaagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnng

SEQ ID NO: 9193 - DNA, 382 bp, Diabrotica virgifera
ccgcctatgcgcccgcctactgttagtgtaaaaaaatagaatgtcctttgttggaagagataaaaccatcgatatgaaggcatgtagttcatattgcgatatagcactatattcctaagcccctcagataatggtagatatgcgcggctctcgtgtaatataagaaaatcgttatatatgtattattttcgaatgagagagatctacaaacgattttttatattgtaatggaagattctactaatttttatgtgaagagctgttatacgtttttaaatgtgtataattttttaaaaactgaataattttagtttattaacagaatattaataactgaagtatgcatatagttattatcattgattatgttgaggagtgtgct

SEQ ID NO: 9194 - DNA, 634 bp, Diabrotica virgifera
cattaattaaaaaacatttaatgttttcgtgtaaactcaagactgagaaaaaatgaatattaaaagtaacaaaaatgtgactaaaactacttacactataaaagtatctatttattgttagcttttgtatatttttgataaacttttaacgttttataattttaattgtaaataagtaatctgtacataccgatcgtaccaaacaattatgatataagagccctaagttaggtagttaatctgtgctgtgagttaatcatacgtagtgatttgtttctgtagatcttcaagtaatattctggtttacaataattaatcagcatcatcattcagcctatacttatccactgctggacgtaggcctcccgcagttcacctcacaaatccctgtcctgagccgtttcatctcggtagtagatcagttaccaaattatacctacttatgcatgcgtgactgttattaagggtcgttttcgcgctacgtcttattgtacgttttgtcgtgcgttttgcatgacacacaaagcgtacaatgagacgtagcgagaaaacgacgctttacatctgcaatttcagttgttatcgcatatgaatatatcgttcttttgatcaattcacttccaacattataatc

SEQ ID NO: 9195 - DNA, 133 bp, Diabrotica virgifera
  misc_feature (56)..(107): n is a, c, g, or t
cgcgtatttgaccgtgctaagtagcatatcattagttttttattgaagctgaatgnnnnnnnnnnnnnnnnnnnnnnnnnnnnnnnnnnnnnnnnnnnnnnnnnnnnttagtaaaaagcttaatttttttaaa

SEQ ID NO: 9196 - DNA, 490 bp, Diabrotica virgifera
tgcagggaccgggcccggatttcccgggggtccttacccgcccggggcacgcggtttttgtaacgcgtggattttctataaagggtacgtggtgatattacagatgctattgattctagtctagtcttcaaagccatcctaggagatgccctcaatagattacttaaaaagtcggaaaaagtagacccaagcagtgatcctagtactgttccgcagaacgaaaaacagttgaatggattcactattgtattcacgaggctcctacgaagaaacgtgagccttcactcaggtgggagaatatctggatcattacctggagacggtgttggagattactaaatgcttagaacaacctacattaaagttagtggtccagatgctaatgaaactgagcaagataaagcttagtggaggtttgagtacctcgatgggttgtcatgtaccatattctgtgattgctgaatataaaagatcatcacgttgtttagga

SEQ ID NO: 9197 - DNA, 57 bp, Diabrotica virgifera
  misc_feature (3)..(47): n is a, c, g, or t
tannnnnnnnnnnnnnnnnnnnnnnnnnnnnnnnnnnnnnnnnnnnntttttttgat

SEQ ID NO: 9198 - DNA, 934 bp, Diabrotica virgifera
  misc_feature (37)..(57): n is a, c, g, or t
  misc_feature (615)..(632): n is a, c, g, or t
  misc_feature (849)..(849): n is a, c, g, or t
acaaaattatcaaaattttaattctgaattacaaacnnnnnnnnnnnnnnnnnnnnntttatatgaaaaaaataacttaatattttatgatgacagactagtgattcccaaaagtttacaaagccttatgctctctaaattacatattgcacacttgggaatggaaaaaactaagtcaagagccaggaaaattttctactggttaggtatgacctcagatattgaaaattatatttcaaaatgtaatacttgtctaaaattttcacgtaaaccaacaaaagaacctttaattccacatgataagcctaacatacctttttataaagttggatgtgatattttaacttttggtggtatagattatttggtactagtggattactacacgaattggattgagctaaaaaagttagagtcaaaaacctctggtgatgtgattaataaattaaaacagatattttcaacttttggtatacctatgatgttgattgctgacaatatgccatttaacagtgccgaatgtcacagttttgctaaagactgggaatttaaaattcaaacatcaagtccgctatatccagaatctaatggtcttgcagaaagggcagtaggtannnnnnnnnnnnnnnnnngaaaaagtctagaagcaaatacagacgtttttaaggcgttactagaatataggaatactcctttagcagggtgcaatatttcacctgcagaattgatttttaagaaacagttgcgtagtgtccttccccttacaggtaaacatttggaaccatcctttgataatgaatcacagaaactaaccgaaaaaaggacagggataagattcattacgatcanaattcgaaaggtaggtcagagtttaaggtaggtgatagtgtaataaatcaggtagaaaaagaaaaacattggataccagggggaa

SEQ ID NO: 9199 - DNA, 802 bp, Diabrotica virgifera
  misc_feature (645)..(645): n is a, c, g, or t
  misc_feature (766)..(794): n is a, c, g, or t
ggaaaatagagggacagcgataacaacaacaaaatccaaaatttcagcatcagaattggtacctacgacgacgagtaaaaaaactatcaaactgacaacaactgtaacggagggtggaaaaactaaaaccaaaaccttagtctttcaaagtcccatcacagaagaggaattagaaaacatctgggacgaaaaaattcttcgattattgcttgaacaaagcacagaatacgaagaaaggcgaatcatcaggaataggttacgcagcgtaatggcagaacaagaagcttgtgcagatctggtacagaaggcaagccaggaacaagccagcggaaaaatagaggaaagcgtgactgttgaaaaatcgtcgagtgagacaccgacaactactaccacaaccaaagttacgaaaattagtacccaacaacaggtaaccaaaaagcctctatcgccattcgctaaatttcaacaattggacaaacaaaacagtaccactactccaccaggaacgttcaactagacaacttctccaccagctgggcggacggacttgcattttgtgccctcatccaccatttcctgccagacgccttcgactatcatgcgttaacgccaaaagaacgaagacacaatttcgaacttgccttncaagttgccagtgacaaggcggacatttttcctctccttgacgttgacgatatgatggccaccagaaggcctgattggaaatgcgtcttcacatatgtccagtccatttaccgacgctttnnnnnnnnnnnnnnnnnnnnnnnnnnnnnatattatg

SEQ ID NO: 9200 - DNA, 65 bp, Diabrotica virgifera
  misc_feature (7)..(7): n is a, c, g, or t
  misc_feature (12)..(63): n is a, c, g, or t
taaattnattannnnnnnnnnnnnnnnnnnnnnnnnnnnnnnnnnnnnnnnnnnnnnnnnnnngg

SEQ ID NO: 9201 - DNA, 609 bp, Diabrotica virgifera
  misc_feature (413)..(448): n is a, c, g, or t
cacctcccccctaatagggaagaggggacccccgccgggacccggcccggaattcccggggggccccacccgcccggtgcaatttttgtgtgtccatttaggcctccctaaatagctgttataatgacgtatataccgcatgtgatccagctgcagagacgattgttgtcaagctagatagtaattgcaatcgcgacattcccaggtatagattcgtctcactccaggctgcaaatattcttaatccacatggtcataataaccttagtatacctgcttctgactaccaacttcgacaactaccaaagatatcccataggatttgaaaaacttctccgtcgctagtctgatattaaatggaacgatgataaagaattcgacaaataccttactgttcgtggtggagacgcctnnnnnnnnnnnnnnnnnnnnnnnnnnnnnnnnnnnnaggaacagccagtcctcttcgattcggatgaattagatcgcagtttctcaagatttgcacttgaaaaagaagtatgtacctgattgcttctctatgaatcttggagctgctacaagctacaaacgaatacaagatcccgaactcaccgattatgtagaaaa

SEQ ID NO: 9202 - DNA, 1038 bp, Diabrotica virgifera
  misc_feature (266)..(292): n is a, c, g, or t
  misc_feature (731)..(844): n is a, c, g, or t
  misc_feature (849)..(1036): n is a, c, g, or t
ataaaaaaaagcaagtattatcaaggaatctacctgccaaatttcaaaattttcggatcaaatttagagtgatttaacaacaaaaaacccattttttgtactattttttacattatttaatttattctgtgcagtgtttattgagatatagttacattttaggaaatatattgataaagtgttagcaaggaatctacctgcaaaatttcaaaattttcggatcaaatttagagtgatttaacaacaaaaaacccattttttgtacnnnnnnnnnnnnnnnnnnnnnnnnnnngtgcagtatttattgagatatagttaaattttaggtaatatattgataaagtattagcaaggaatctaccagccaaatttcaaaattttcggatcaaatttagagtgatttaacaacaaaaaacccattttttgtactattttttacattatttaatttattctgtgcagtgtttattgatatatagttacactttaggaaatatattgataaagtattagcaaggaatctacctgccaaatttcaaacttttcggatcaaatttagagtgatttaacaacaaaaaacccattttttgtactattttttacattatttaatttattctgtgcagtgtttattgagatatagttacattttaggaaatatattgatacagtattagcaagtaatctacctgccaaatttcaaaattttcggatcaaatttagagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 9203 - DNA, 639 bp, Diabrotica virgifera
  misc_feature (139)..(158): n is a, c, g, or t
gggggttaaggggatggactcaatgatcggaactatatcacttcgaaagctcatggatagctcgtggttctgccgcagagatcgattcaatgtctctatttttaagtagtgggctgagtcaacgttgactccacacacnnnnnnnnnnnnnnnnnnnnctcccagtgtaacgagctggaaatttttgatttgcgggatatgaaaactcattaataggtcttaatttagcgctgtttgttttttaatttctgcaaggtgggagccagctcaacagaatgtattaattttgcttttcataaaagcatcatcctctttgccctgctttaatggaattgtagtaatctgatctcgttcttcagtattcacgaagttcaaaaacgtcagaacaaaagtttacctggtaaatcatgaacctagaacgcctcatatttgccctatatactttgtgatctttctgtttctagaagagttgttcaaatgaatgaccatattatattttaaagaattacattgtaaggaccttgtattttgtatattttgcactctgtatgttgatattttaatgttaaaggacaaaatgtcataccaaaggtaaaaattgttagctaagtaagcataaataaaaagctaatttattat

SEQ ID NO: 9204 - DNA, 109 bp, Diabrotica virgifera
  misc_feature (9)..(60): n is a, c, g, or t
  misc_feature (64)..(107): n is a, c, g, or t
gtggatgannnnnnnnnnnnnnnnnnnnnnnnnnnnnnnnnnnnnnnnnnnnnnnnnnnnagcnnnnnnnnnnnnnnnnnnnnnnnnnnnnnnnnnnnnnnnnnnnnaa

SEQ ID NO: 9205 - DNA, 763 bp, Diabrotica virgifera
  misc_feature (109)..(122): n is a, c, g, or t
  misc_feature (124)..(213): n is a, c, g, or t
  misc_feature (244)..(293): n is a, c, g, or t
  misc_feature (304)..(324): n is a, c, g, or t
  misc_feature (395)..(418): n is a, c, g, or t
  misc_feature (504)..(523): n is a, c, g, or t
acttctccacatgctatcaaaccaaacaatgttttggctctggaccagaacgacttgaatacctggagtacaaattaataaaaatcatggagataaatataagcagtgnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttaaatttaaattgtataaataatattnnnnnnnnnnnnnnnnnnnnnnnnnnnnnnnnnnnnnnnnnnnnnnnnnnaagttatattnnnnnnnnnnnnnnnnnnnnngacgtttataaatctaaattaaattttgttaatgaaattaaaattttctaaatatacttaaatttgaaaannnnnnnnnnnnnnnnnnnnnnnnatagaaatataccttgttttggttgaacccagaataatgattgattcaaggcagtgaagaagcgaacaaatcatttctgttatggnnnnnnnnnnnnnnnnnnnnctgtgattagtcatatccaaatttaagatcacgccttgtggtgtgactttcttccattgtgagttaaggggttatttggaagttagtacttgtgtcaatgttcgatcaagtggttttcattgtacttaagtacaatgttatgaaattaaaatgtatttacaacgctttagtgtatctttttatacttttggtctacgtgagcttaaatcatgaagttttggcggaaatattgtaaaataa

SEQ ID NO: 9206 - DNA, 939 bp, Diabrotica virgifera
  misc_feature (300)..(323): n is a, c, g, or t
ggcgaagcgggtgtgctaacgtggtgtacaattttcaattgtatttcctacactttctcaagttagttcttttgcagttgcttactgcataatttcaagtaatttattgtgtttgtgcttataaagaaccgtcaaggaggaggtttcaatagagatagaaagaggagtcaaaatcaaaaggatcagaagaaggacaaggaggatggaactgatggcgaagatggagaaaccaagagagactggaaagatgagaagagcaacagtgaaactcctgaaactgaggaagaagccaaggcaagnnnnnnnnnnnnnnnnnnnnnnnnaccttattatgatatacccattaaattgttgagctgctttgtctgcaacaaagaaatgtgggatggagaatctatgaggaaacatgtgaaaggtcgtgcccacagacaaatgttagatagcttggaagaaagcatccacatcactgttaacattctaagggagaatatgcgtcttcttgaagagaaaaaacttattgagttgaaccgtgtacaacgtgttactaaaagatttaataagccagagcctgaaagtcattgcaacatgtgtgatctcaaattcttgggaaaaatcattgctcatcgcaagactgaaggacatcaacgtttgaaacactacttgcatcctaactgccgcttgtgtagtaaagaatttccctctagaatggaatggattgaacatcgtttgactcctgagcatctcagaaaattaagtaaaacacttgctgataaggttggaggtgccgatggcaatgatattgttgaaagtgaggaagaaacaaatgatttggcattggagccaattctagatgagccattggaaatggaagctgagaatccaattctttgaattactgaaaatatcaatttctcatttatgaatctttatgctgcatac

SEQ ID NO: 9207 - DNA, 78 bp, Diabrotica virgifera
  misc_feature (61)..(61): n is a, c, g, or t
ctcgcgcctggtgttacatcccaagtagtgttccttttattttctagttattttcgacagntgcatttactttatttc

SEQ ID NO: 9208 - DNA, 346 bp, Diabrotica virgifera
  misc_feature (8)..(31): n is a, c, g, or t
  misc_feature (93)..(106): n is a, c, g, or t
  misc_feature (108)..(120): n is a, c, g, or t
  misc_feature (289)..(306): n is a, c, g, or t
taaattcnnnnnnnnnnnnnnnnnnnnnnnntatgtacaatatgaagtgattataaattaagctgtagaagtagttaacttactgataggcannnnnnnnnnnnnncnnnnnnnnnnnnnggatatttgcggtgttgtataataatcacataatagtatatattatgataattactttataaattgttatactgtgatataatacagattatgttttgaattatagatgttcatattaggccccgggtcgttacaagttttgtacacttgctcactttttcattatagnnnnnnnnnnnnnnnnnncatgagtattatgagtctgaaagttgtttatattgttatc

SEQ ID NO: 9209 - DNA, 413 bp, Diabrotica virgifera
atattacctgctccctgtgatatttcttcatatgaaacagggatcattattataactatgttaaaggaattcaagttatcaccggcctattcgttagctatacataactgcccatatgtataattatcatttaaaagagctgcccctatttgccgatatgaagtaatggctgattcctaccaacttctaatgcacgaggagcatcattttcttttatttcgcaattcatccatattggcgctagtaatatattattaatcttataatataatcgaaacttgaataaccgaagtaactgatttttttctagcgataggaacagagacatctatggaatgaattaccctgaggaccaataccatttcgaggaccaaccccacatactaagctaggtatccgtctattcccatatt

SEQ ID NO: 9210 - DNA, 850 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaagatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatcc

SEQ ID NO: 9211 - DNA, 805 bp, Diabrotica virgifera
  misc_feature (2)..(17): n is a, c, g, or t
  misc_feature (19)..(795): n is a, c, g, or t
  misc_feature (802)..(802): n is a, c, g, or t
cnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattnaat

SEQ ID NO: 9212 - DNA, 202 bp, Diabrotica virgifera
  misc_feature (60)..(60): n is a, c, g, or t
  misc_feature (107)..(128): n is a, c, g, or t
  misc_feature (160)..(188): n is a, c, g, or t
taacagcgtaattttatttggagagtcaatcgataataagattgcgacctcgatgttggnataaagtttatattgggtgtagcagtatatttataagtctggtcgannnnnnnnnnnnnnnnnnnnnnagtttaaaacgtgggggagcccaggttggttnnnnnnnnnnnnnnnnnnnnnnnnnnnnngtaacgaaaggacc

SEQ ID NO: 9213 - DNA, 806 bp, Diabrotica virgifera
  misc_feature (586)..(604): n is a, c, g, or t
  misc_feature (716)..(716): n is a, c, g, or t
  misc_feature (731)..(731): n is a, c, g, or t
  misc_feature (786)..(786): n is a, c, g, or t
tgattctttagaagacagtaagtcaattatagaaattagttctagtgttacatcgattaaagatacaactgaaccttccttagatgaagacaggtcaaatcaagcagtcacttctagtataataacattggatgatagttcagataaatacaaatcgtctgaaattacctctagcgaaataatcgatgaatcattgaagtcaattaacgaaagtattgacattctaaaagatttagaaaatagctctgaagtatataaaacagcagttgagtcagacaaatttaatttggatactactactgacgattccttcaaattaaatagtttaactgtggagagtattgacgatatctctactagtgaaacatcaaatatagatcgtttcgtatctattgaaaaccatagtaatttagcagaaactaaagatgattctataaatgaaaatagtgatggaattgtcgaagctgtaaacgacaacattaaagaaaagaaatcacaggagatagtacaagcaattaacacagaaattaatttaaatgagataaattcttcaaacgaaatagttgagacagcacaagcaattaannnnnnnnnnnnnnnnnnngaggtaaattcttcaaacgaaatagttgagactgttaactataacgtaaataattctagtgatgcgctttcaaaatcaagtgaagttgtagaaaatactaaatcgaaatccnaaaacactctccttnaaatggaaagttatcctgaagatcttaatccattcgatgatgaaccacctactcnccatgattccctaaatccat

SEQ ID NO: 9214 - DNA, 452 bp, Diabrotica virgifera
gggaattcccggggcgccccccccgcccgcgctctcaaaaagtgattattaaaatctaagttttagttaagtaaagagaaatttagcttaatgcgtagcaatatagtgagaagatagataaatttcatttaatcgatctatgagtttggtcacggcgactaggggggagcgagtaatactgaactaattacttacttatgtgagggcataacataaaagaaccaacccgacaacctctcatggaggcataagcatgtttgacaatgcgctcagaagagtgctgtgctttcgacatgtagtatatctcatatactagataatatttgaaaatatatttctaacagaaaatctttaaaagactaattgatattaatataatcgaagatgccgagggcagatcttggatgaagaatgaggtttaaatcattgcattcactgaacgcactgaagtc

SEQ ID NO: 9215 - DNA, 780 bp, Diabrotica virgifera
  misc_feature (241)..(262): n is a, c, g, or t
  misc_feature (656)..(673): n is a, c, g, or t
  misc_feature (758)..(772): n is a, c, g, or t
ggcaattcggtcataaggagtgtgtcacgttttattgataaagtttgtaacgaaggcggagtaactagagagcatattcgtaatttgcatcaaatgatacccggggtagtccacatgcatattgagaccttggaggctgttcatagagaatcaaagaggttgcctcccatacagaaacccaagatattgacaccaagcatgctcgttggagaagaaacgataatggagggtctgagagtgnnnnnnnnnnnnnnnnnnnnnnaagaaagcggtacaggactactcggtggaccacctttactaccagctgaaggtgccatattcctcacaaactaccgtattatcttcaaaggaattccatgtgattcatttgcttgtgaacagatcgtggtacgttctttcccagtgacgtcgttaaccaaagaaaagaaagtagctgtacagtatttagctcatcttgaccagtggctacaggaaggattgcagttgcgttcgtgtaccttccagttaatgaaatttgcatttgacgaagaagttacagcagaaaatgtagatacacttcgaaagttgatacacaaagtcagacatcctccagatatattccatcattttgcttttacggggacagtggtcgttacgcagacaccatttgcacnnnnnnnnnnnnnnnnnncaacactgaaaggttttgccaaagagacacttctcaaaactgcgcggaaaggcggattcaaacaaaatcttcatcaaacgacaannnnnnnnnnnnnnnaacatgac

SEQ ID NO: 9216 - DNA, 199 bp, Diabrotica virgifera
  misc_feature (64)..(77): n is a, c, g, or t
  misc_feature (80)..(102): n is a, c, g, or t
  misc_feature (111)..(132): n is a, c, g, or t
  misc_feature (174)..(193): n is a, c, g, or t
taacagcgtaattttattggagagatcaaatcgataataaagattgcgacctcgatgttggatnnnnnnnnnnnnnnggnnnnnnnnnnnnnnnnnnnnnnntgttcgacnnnnnnnnnnnnnnnnnnnnnnagtttaaaccggtgtgagccaggttggtttctatctttaagnnnnnnnnnnnnnnnnnnnngaaagg

SEQ ID NO: 9217 - DNA, 516 bp, Diabrotica virgifera
  misc_feature (335)..(361): n is a, c, g, or t
ccccgcccgcgccaattttatttttagaagtatagaattttttagttagtaaagaaatattgttcctctcggagtataatatattgattaagtaaaaatacatacctttttgactctcgctggctatttctcggatcacgtgtaactggaaaagtctaacaaacttcatatctttgctgctgccccaattatagaagctaatccaacatgataggctcctgccataattatctgttagaactctccaataaagtgactgttgtactccctaaggtatatcgctcttatagtccaaacaatgggatcgtgatcgttgtataatctatataacatannnnnnnnnnnnnnnnnnnnnnnnnnncccctatagcttatacctattatacaaataaatttgacactaaaaacacctagtaagcactgaatagaaacctacgggcacttctcgtcttgtgatacattcgtaggttgtttaatcagaactacttattcataaatagatcttgaaaaagacag

SEQ ID NO: 9218 - DNA, 907 bp, Diabrotica virgifera
  misc_feature (823)..(823): n is a, c, g, or t
  misc_feature (862)..(862): n is a, c, g, or t
cggacgcgtggggtggtgcaatcgagtctgtatccttgttgcatcgaaagtaaaaaagttgaaagtgttgatagacatgaaaataaatagagtgaattattacataggccgaaactgatgatgccatcatgaaaataattagctactaccagaaacaattatacgttttatgtttaatattggcagtggcgttgtttagtctatgcatacagatggacattgttagctacaatacatattatgcagaatatgaggaatacaaaaaaaatatagacgatattgaaattaagctagtagaagaatggaaggaactgcgaagcaagcaaagtaacttatcaaacttagggaaaatactgttcttgggaacagacgaaccagtagtgaatacaacgaaatcctatcaaattctagtctggaaatatggcaaaatgatcgaaaatcgtctaataaagaagttttccaaaaattgggtcgacccattcagtaactgccctgtgaaaaactgtgatgtaacttataaggatgaagcactctcaacagctgaccttgttctatttcatttgcatagaatgaaaagttctaaacagctaccattgaaaagaggaaaatcgagccagatatgggcttttttaaccgaggaaagttcctatcacacgtttctgaatcgggataagggtgttaccataaaagactataacggtgtttttaattggtctatgagttatagaatggattctgacattcccgttccttatggaaggaccattctaaggaagacacctcaacctgtagaaataaaattggaaaaacaaaggaatgtttntggtgcgataatgggctcaaattgtggtggaaagaatanacgatgggattatgtaaagggagtagaaaaacatatttaaagtga

SEQ ID NO: 9219 - DNA, 958 bp, Diabrotica virgifera
  misc_feature (84)..(96): n is a, c, g, or t
  misc_feature (98)..(127): n is a, c, g, or t
  misc_feature (856)..(856): n is a, c, g, or t
  misc_feature (864)..(864): n is a, c, g, or t
  misc_feature (874)..(874): n is a, c, g, or t
  misc_feature (926)..(945): n is a, c, g, or t
cggacgcgtgggatttttgagttcttggtatcactcggaagtcaaaaaaggaaattctttgtaacagaagggtgaaaatctacnnnnnnnnnnnnncnnnnnnnnnnnnnnnnnnnnnnnnnnnnnnagctcgacagtgttacctcacgaaatgtctaaagagaatctctgcaaaatttcaggtggatcggtcgagtacttttatgtccaccgcctttgaaaaaacagttttgagaaaaacgcgtttaaagttttgacaacttcatcttcatcttctgatttgtctgtcaaatcgtaaagtgatgcacatcggaatatgcttttggatcgcgtagtgtaacaagaaaaaagaagaacttatgttggagtgaatgcaaagagagtgataaactccaacagaagtaaggaacaaaaagtaaaccaatttgtctaatgggaaataaatgaatggcttcaacgttgatgaagccgaagtaggaaaatactaagaaaaactgaagtacttgtatggggggataatgataagatgatgaagttgaggataggggaattaaaagggatagaactagaagtatgaagagacagaggcaaactaaatggagtggctagcaagagatgcaagagaacaacttgatacataaggatggatacggctcgtttgcatgcctgtcgaataacagtagctcctagtagataaagattgcttaaaaaggtatatattaagataagaataatgtactgaaaatgtataaagatgaataagtgctaaagaagaaccaattaaataaaactaacaaatcatgggcgccaagaaaatgatcttcgatcactcttcccagtatcttacactgctgtncaatattnaatatattanatcagtaataatgaaacgtaaggaatataaaataaatgatatacaaaataannnnnnnnnnnnnnnnnnnnctacctagatttt

SEQ ID NO: 9220 - DNA, 378 bp, Diabrotica virgifera
  misc_feature (13)..(32): n is a, c, g, or t
  misc_feature (340)..(361): n is a, c, g, or t
aaagattaagggnnnnnnnnnnnnnnnnnnnncaatgaaaattggtgttgttattttatattacttcataacacattttattatctgcaaccgatatttttacattcttaacttctactataatagtaataacggttgttaaagacgaataatacattttttaacgtgtcagtaactacttaatatgatgtattttattgttgtacgtatgtaccttatgttaattatttttaggtatgattgtattttaaattttatgtaggtatctgccaatatacagcaagcaatattgtttttagtagtttcatactaacatatttttgattttactctaatgagnnnnnnnnnnnnnnnnnnnnnngccttatattactttcg

SEQ ID NO: 9221 - DNA, 598 bp, Diabrotica virgifera
  misc_feature (79)..(105): n is a, c, g, or t
  misc_feature (472)..(493): n is a, c, g, or t
  misc_feature (530)..(549): n is a, c, g, or t
cggacgcgtgggttcgactgaagtgtgagcacatgttgatttgtgtagatcgtaattactgttttgtttttttaggagnnnnnnnnnnnnnnnnnnnnnnnnnnncgaattgttttatagtgaagtgctaataaacaaatcgaaaatgaaatctagtaaaaagaaaacgcattgctaatcttgcaatgaccaacgaaaattctaaaacgactctgaaggtaggaggttggtaaacttagtttcaaaatagtttgtaaatttgtgtttataggtaaaagaaacaatattagacagtacactgcacagacaattttagtaaagaagaaaggatgcaattattgtgttccacgtacagggaactgtgaatcgtataatcgaaaaaagtatttcattttacagaatgtaaaattacatgcaccaagaagacaacggcctcgacaaaaatgtgccaaatcacgaacgaaaagcaaannnnnnnnnnnnnnnnnnnnnnctgctcaaattagagtgtgtactaaattttgttttcnnnnnnnnnnnnnnnnnnnngttttcatgttaattttgattgttgttttcgaataaatgattatctgtt

SEQ ID NO: 9222 - DNA, 918 bp, Diabrotica virgifera
  misc_feature (187)..(242): n is a, c, g, or t
  misc_feature (376)..(393): n is a, c, g, or t
  misc_feature (793)..(793): n is a, c, g, or t
  misc_feature (831)..(848): n is a, c, g, or t
  misc_feature (873)..(893): n is a, c, g, or t
ggtggtgaaaacggttaactcttcttttaactcttgaagtggtataatatagaagtagacatgaaaggaatgcaaggcaaaattgctatagtaacaggagccagttctggtattggagcagggattgttgaaaaattggttgaagaaggattaactgttgttggtctagctcggagagtagacatgnnnnnnnnnnnnnnnnnnnnnnnnnnnnnnnnnnnnnnnnnnnnnnnnnnnnnnnnatgcgatctaagccttgaatcaaatattctaaaatgtttcgattatgtatctaaaaatttaggaccgatatatgtattaataaataacgcaggttgtttaaccaagcaaaatttatgtgacggaacaactgaannnnnnnnnnnnnnnnnngatgtaaacctacttggtttatgtatagccacaagagaagccatcaaaagtatgaaagaaaatgaaatcgatggccacatcattcatatcaatagcattacgggtcattggaacgtaaggatcgacgacatcaatgtctatcctgctactaaatatgccgtaacctcactagctcaaactttaaggagagagctatcaaagtcaaaaactaaaataaaagtgacgagtctaagtccaggagttgtaaacactgaaatatttgcagtgggaggactaacaaattatgcagacagtttagaacaagaagaagtaccagctcttacacctcgggatattgctgacgcagtaacatatattttgtccacccctccacatgtaaatatttccgaattgatcattncacctgtaaacgaagatttgtgatctaattgaatcggnnnnnnnnnnnnnnnnnngtataaatagaaattgtagtattgnnnnnnnnnnnnnnnnnnnnncttttataaagaacaaagtctgttt

SEQ ID NO: 9223 - DNA, 709 bp, Diabrotica virgifera
ttccttgacggccgcgagacgcgaccgaataagacgctcatgtccttcttcaaaagagaaggaaattgtaaatgtgatgcaaaaaactttcttaattccaaacgaagattgtaggaaatctgagattgctgggacatgggtaccattaaatcacatctcgatatttgcttacatagaagtgaaatattaaactaaaggatgaacccagccatattgcatcgactactccagtctccgcattacatctcagacaggatgtatgattgattcaatcaatagtaagaaaattattgaatgaatcataaggggtatttcttaccatacaagccttaaaagagaataaaacacctgatatacgtacagaggtgttcaaaatatagaggcagtatcgtgcagtaataagagcttgtctagaaaacctacaagacgaactctccaagtccatacccgaagataaaatctagatacaaaattagatcaaagtgttctattcaatctaatgcatcaggaacttatgtgaaatcctcttcatagacacagctcctggaaccgtagcgttatctcaggttttaaagcgggacatgacccatttcccagaacatgagagaaatgctgcaaatatgcttgcgaaaaaaaagatcggcttaaaaacaaatccagaatatgggaataccggtttcggcggaatggttgccgggacgaatactac

SEQ ID NO: 9224 - DNA, 957 bp, Diabrotica virgifera
  misc_feature (791)..(791): n is a, c, g, or t
  misc_feature (852)..(852): n is a, c, g, or t
  misc_feature (869)..(870): n is a, c, g, or t
  misc_feature (904)..(904): n is a, c, g, or t
atattttaccattttacgataaataagtttaaatttagaattaaaagtaaaacagaaaacagttgatgataaaacatattgatacttaacaacaataattataataatgtatttatcgtaaggtatttaaaacactgattaaaagtaacttcagaaagaaagttttaaaaatgagcaaaccaaaaagaaatccgggtcctgtacctcccagatggctgcattgtcctaggaaatcggaaaatctcattgcggataaatttatggctctaaaaacaccattgagttcggattttgacgaccaagtaccacccgagaaccgatttcacccaaaaatggtgtttgatatagccaaatctaaaaagattaaatttggattatggattgatttaacaaacacttctagattctacaacaaagcagatattgaggaatatggatgtaaatatgtgaaattacagtgtaggggtcatggagaaactccatcacctgaacaaacttctacatttattaaaattgtcacacaatttatcacttatcaaccattagaaagtattgctgttcactgtacacatggattcaatagaactggcttccttattgtttcttatttgattgagaggatggattgtgaccttgggagagccttaacgttgtttgccgagtcaagtaatgatgatacttcaccaaaagctaaaaagggtcgcttcaaggaagccgtatttatggagggagtacctaacgttacccactttgtagaggaaaaagcaaccgaattgcaaagaatggtgcanaagatgtgtaagtggacaaaaaaggttttccaggcagtcagccagtttccatggatatgancaacattactcttctannagcccacccctacagagtttcctggaaagcagancgcatgaggtatatgatgcttattaaacgagaagacgaaagttacttttttga

SEQ ID NO: 9225 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnna

SEQ ID NO: 9226 - DNA, 603 bp, Diabrotica virgifera
gcccctcttaggggcccccgagtgtcgaggaacttgatttgtggcactttacaagcagtgaaaaataaattcttttgagatcatacggcaaggagaaaatgtaaatattatatctagaaatagccatgacatgttctacaccggctttgacggaactcctgagcttggatgcatatgtatattctctgcgcactgtccatgaggaccggatgaagtaatttgattagcacctctaataactgaagacaatggaaaagaaagagtatcggctgatgattagtaatatattgctcgtttgaaacaaatctcaaataataattagatgaacgtcgcgattaggattgtggattatgacacgagataaatcaattaatgatggcgagctgacatggccgatgatagttcgacaaaatggatgtgtcatgatgaggtaaccaaaaaccggggcttctaccgtctggaacatgctaataggtgtctaacgaggtgtacaacaagatgtagtacagaaaggaataagcataggatatgcatgtctgctatgtatatttgtaggatcgtctaaaagagaacagaccgttatataatatttacaaaaataaa

SEQ ID NO: 9227 - DNA, 192 bp, Diabrotica virgifera
  misc_feature (2)..(28): n is a, c, g, or t
  misc_feature (34)..(179): n is a, c, g, or t
gnnnnnnnnnnnnnnnnnnnnnnnnnnntatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaattacct

SEQ ID NO: 9228 - DNA, 485 bp, Diabrotica virgifera
  misc_feature (2)..(32): n is a, c, g, or t
  misc_feature (99)..(115): n is a, c, g, or t
  misc_feature (117)..(149): n is a, c, g, or t
  misc_feature (172)..(209): n is a, c, g, or t
  misc_feature (236)..(249): n is a, c, g, or t
  misc_feature (251)..(311): n is a, c, g, or t
gnnnnnnnnnnnnnnnnnnnnnnnnnnnnnnnttgaatagttattctgttttgaatagatctacttttttaagaatttcaatatatttattaattaacnnnnnnnnnnnnnnnnncnnnnnnnnnnnnnnnnnnnnnnnnnnnnnnnnnggatgagcttatttataagattnnnnnnnnnnnnnnnnnnnnnnnnnnnnnnnnnnnnnnaaaatttcatatgataaaatatgttcnnnnnnnnnnnnnngnnnnnnnnnnnnnnnnnnnnnnnnnnnnnnnnnnnnnnnnnnnnnnnnnnnnnnnnnnnnnaagtaatgaagataatattagtattgatgaattgaatatttagaaaaaatagattagttaaataaaggatatcggcaacatttttgtctcctgcatattatattcctgccgtttagtattaactagactgtctcgactgcccactgagtaactccagtgcactgagtattttga

SEQ ID NO: 9229 - DNA, 72 bp, Diabrotica virgifera
  misc_feature (25)..(52): n is a, c, g, or t
agttgtttatgtatttgtaaattcnnnnnnnnnnnnnnnnnnnnnnnnnnnnctaataaaagtgtctcgaat

SEQ ID NO: 9230 - DNA, 87 bp, Diabrotica virgifera
  misc_feature (35)..(35): n is a, c, g, or t
  misc_feature (46)..(46): n is a, c, g, or t
  misc_feature (65)..(65): n is a, c, g, or t
cataacgcccggtttgactctcatgttatcattcnaattaaattanaatggaaactgatgcgaanacattcttaattccaaaacgat

SEQ ID NO: 9231 - DNA, 871 bp, Diabrotica virgifera
  misc_feature (23)..(41): n is a, c, g, or t
  misc_feature (50)..(64): n is a, c, g, or t
  misc_feature (66)..(82): n is a, c, g, or t
  misc_feature (85)..(103): n is a, c, g, or t
  misc_feature (118)..(138): n is a, c, g, or t
  misc_feature (276)..(325): n is a, c, g, or t
  misc_feature (330)..(438): n is a, c, g, or t
  misc_feature (441)..(486): n is a, c, g, or t
  misc_feature (494)..(580): n is a, c, g, or t
  misc_feature (611)..(665): n is a, c, g, or t
  misc_feature (671)..(712): n is a, c, g, or t
  misc_feature (731)..(766): n is a, c, g, or t
  misc_feature (794)..(794): n is a, c, g, or t
  misc_feature (818)..(856): n is a, c, g, or t
  misc_feature (862)..(862): n is a, c, g, or t
aaaactctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaaacgaataacatttcannnnnnnnnnnnnnnnnnnnnnnnnnnnnnnnnnnnnnnnnnnnnnnnnnnnnnnctcttnnnnnnnnnnnnnnnnnnnnnnnnnnnnnnnnnnnnnnnnnnccctgatacacaaggtacnnnnnnnnnnnnnnnnnnnnnnnnnnnnnnnnnnnntctcacaatactaattaactatcattanataaaatttttctttacttttacnnnnnnnnnnnnnnnnnnnnnnnnnnnnnnnnnnnnnnngttctnagatcgcga

SEQ ID NO: 9232 - DNA, 972 bp, Diabrotica virgifera
  misc_feature (866)..(866): n is a, c, g, or t
cggacgcgtgggagaatcttgaaaatcggagtacaaatagggaagttataagactgtcgaacttgatcagggattttgggtggcggaattttgtgccggtgagtgtacataaatgtaacagacagtcgcagtcgtataaaactactattagacaaataattgaagtaattggtatcttctttgaaattgaacttaaaaaaattatcagcaagatgggtaacatgaataaaagccaaaccaaccgaaaagacatgtacatttattttttaatgcgttatagataagtcaaagaaaattttcgtgcaatattagtaacaatgaagaaggttaccacacccgaaagaattaaagatgcaatcttgagcgggaaatattaggctagctgtattttggaattcaaacgctataattttagtagttcctgccaaaaaagggtgccataattacaggtgaattattagtttatacgagggaagctgtgtactctgaaaactaggtctaacagattaggaagaagtaatgttagggtgttaatcttcaatcaggataacgcatacagtcctagttcttccattgcaataactataataattcaagtaggcttcgaattagttgagcatccgccattttctccatatttggctcccataggcaaacgactgtttctaaaacctgcaaattgcatattaaaataatttgttcaaataattgtgtccattaaatcagtgatttgcagaggtccagctatcgtacacatcttagaacatagatgggaaaataaaagtgaagtatttgccaatattttattaagtgggccaggtgtggaaacagggatcgcgccccgtatttggtatatttttgcattnttttgtagtttttaggttgtatcgttgagtagctagctcacttttataccatttgttttatttagtattttgcaaaatgcagtaaataaacaggctattgataaat

SEQ ID NO: 9233 - DNA, 340 bp, Diabrotica virgifera
cttatgatagaattatgaattattaataagtcttcatcaatgatgtagtacatccacacaggtattgtatgtactacatcattgatgaagacttatgatagaattatgaattattaataagaatcttcaattgccccagaaacacactttaaaaatactgataactccatatatgttattatacttcaaagtttgtcacggtattcttaaattttcaataacccacacatcattagaacaagtttaaatatttttttgcttttcaagataattgagtgcaatcttctctggtatgaattgtttcaataaagtgaggcagataatattaaatcgtgacaat

SEQ ID NO: 9234 - DNA, 79 bp, Diabrotica virgifera
  misc_feature (5)..(32): n is a, c, g, or t
  misc_feature (44)..(73): n is a, c, g, or t
cgagnnnnnnnnnnnnnnnnnnnnnnnnnnnnaagttttttagnnnnnnnnnnnnnnnnnnnnnnnnnnnnnnttgggg

SEQ ID NO: 9235 - DNA, 237 bp, Diabrotica virgifera
  misc_feature (42)..(42): n is a, c, g, or t
  misc_feature (191)..(231): n is a, c, g, or t
ataattaccttagggaatacagcgtaatttttattggagagntcaaatcgataataaagattgcgaacctcgatgtttggattaaagttttatattggtggtagcagctatattatttaagtctgtttcgacttttaaaattttacattgatttggagttaaacccgggggggggcccggggtggttttcnnnnnnnnnnnnnnnnnnnnnnnnnnnnnnnnnnnnnnnnngggccc

SEQ ID NO: 9236 - DNA, 260 bp, Diabrotica virgifera
atccggtaggtgagagtataacacaatctgaatcaaatttggagaagttaacgatggaaacccaaggtgagccagttttgctggacatggctacttcttcagacaccggcaacagatcatcaactgatacagtttacaggtcagataatgaacaaaacattattgttgattatccatctgataatatgtctcaaacaggtagaagcagacgcgttacaaatatgccaaagaaatacaatgatttcattctagagtaagtc

SEQ ID NO: 9237 - DNA, 71 bp, Diabrotica virgifera
  misc_feature (4)..(31): n is a, c, g, or t
  misc_feature (34)..(68): n is a, c, g, or t
taannnnnnnnnnnnnnnnnnnnnnnnnnnnctnnnnnnnnnnnnnnnnnnnnnnnnnnnnnnnnnnngct

SEQ ID NO: 9238 - DNA, 848 bp, Diabrotica virgifera
  misc_feature (289)..(338): n is a, c, g, or t
  misc_feature (343)..(440): n is a, c, g, or t
  misc_feature (454)..(499): n is a, c, g, or t
  misc_feature (507)..(593): n is a, c, g, or t
  misc_feature (624)..(638): n is a, c, g, or t
  misc_feature (640)..(672): n is a, c, g, or t
  misc_feature (695)..(724): n is a, c, g, or t
  misc_feature (803)..(822): n is a, c, g, or t
gtacaacgctacagtcagtgataaagagatgatgttttaacaaaattaaagcttttgaacttaagaataaaattctttgtaaggtaagtaaagacagtgtttttttcatccaagcccttcattccagcttttcatataaaaaaattaatgattatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttttaatccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaagcgaataacatttcannnnnnnnnnnnnnncnnnnnnnnnnnnnnnnnnnnnnnnnnnnnnnnngtttagctcttttaaattcgagnnnnnnnnnnnnnnnnnnnnnnnnnnnnnnccctgatacacaaggttcagaaaataaaattttctttcataaaaataaaatattctctcacaatactaattaactatcnnnnnnnnnnnnnnnnnnnnacttttactgaaaaaatttttttatt

SEQ ID NO: 9239 - DNA, 184 bp, Diabrotica virgifera
  misc_feature (2)..(29): n is a, c, g, or t
  misc_feature (49)..(62): n is a, c, g, or t
  misc_feature (65)..(87): n is a, c, g, or t
  misc_feature (95)..(117): n is a, c, g, or t
  misc_feature (147)..(178): n is a, c, g, or t
annnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9240 - DNA, 132 bp, Diabrotica virgifera
  misc_feature (2)..(48): n is a, c, g, or t
gnnnnnnnnnnnnnnnnnnnnnnnnnnnnnnnnnnnnnnnnnnnnnnngattaagagaaaataactgtaaaaatattctattatttaattgttttattacacctgaacttccataatattcaaatcatccta

SEQ ID NO: 9241 - DNA, 1009 bp, Diabrotica virgifera
  misc_feature (140)..(169): n is a, c, g, or t
  misc_feature (359)..(376): n is a, c, g, or t
  misc_feature (764)..(765): n is a, c, g, or t
  misc_feature (787)..(787): n is a, c, g, or t
  misc_feature (865)..(865): n is a, c, g, or t
  misc_feature (966)..(966): n is a, c, g, or t
agacacgatagatacaagttgtttcattataacctatcctccaaagttaacctaggaaccctaccacgtgttacattataacattacatggtgccgaacaagatcgaatacgttaagaaaagagataagtgcaatggaannnnnnnnnnnnnnnnnnnnnnnnnnnnnntcaggtaacgtgtatgaaaattggcaattcttcatacaaagattcaaaaactacttacaagctacagaattaacaaagaaacctgaaataacccagtgtgcacagctattacagttaataggggacgaagggttcaaaatatataacacgtttaagttctcaacagaagaaaaagacaagttagaactgnnnnnnnnnnnnnnnnnngcacatttcaagccaaaaagcaacgtgtcaaatgcaaggtattgcctgttcaccagaaaacaagaagaaggtgagtcagtagacaaatttataacagatattataaacaaggcaaaaaattgtgagctagagaatttggaggacagtctgattaagacttgcataacttgtggggtagcagatgaaacgatgagacagagactattagaagatgagatgagcttggaaaaagcaatcaatctgtgtaaaagtatagaaagttcgaaaatccagtctgaaaaaatgaagtcagaggaggtgcactacgtaaagaaaagaaacttcaataagaaatatgaaaatagagaacagtgggaagacagaagagtgaaatccactcattcgaagnntccagacggccagttcaatggntaatctggaagcagttcagggtgcagtaggtgcggaatggagcacagaggccaaccatgcaaagctaagtgtaatttnatgtataaaatagggcattatgcaaaaaaatgttttcaaaaacaaattaagtatgtagatgtagatgattcagaatcagatgatttgtttataggcttggntaatactaaaaatagcagttttgatgatgattcatgataaatt

SEQ ID NO: 9242 - DNA, 266 bp, Diabrotica virgifera
  misc_feature (7)..(8): n is a, c, g, or t
  misc_feature (16)..(16): n is a, c, g, or t
  misc_feature (33)..(33): n is a, c, g, or t
  misc_feature (40)..(40): n is a, c, g, or t
  misc_feature (53)..(54): n is a, c, g, or t
  misc_feature (61)..(99): n is a, c, g, or t
  misc_feature (217)..(254): n is a, c, g, or t
ataattnnttgatccnattttttttgattatangaaatanatttaccttaggnnatacagnnnnnnnnnnnnnnnnnnnnnnnnnnnnnnnnnnnnnnngccgacctcgatggtgggataaagtttataattggtgagcagctattttattaggtctgttcgaactttaaaaatttacatggtctgagggtaaaccggggggggagcccgggtgggnnnnnnnnnnnnnnnnnnnnnnnnnnnnnnnnnnnnnncaaaaggggccc

SEQ ID NO: 9243 - DNA, 895 bp, Diabrotica virgifera
attttgtatacaataaactaataatggagcactttgaagatgaaattagcagtgtagatgatgaaactacttcattgttcaataatgaatcgtcctttgaaaagaagtcggacgaatataataaccatgatttggatgatgatatggaggatacaagatcagaattaaaatttgacagagcattggaaaccgaagaagaaactgaaaaaaggttgttaatagaagaggctttgaacaatgaatacactaccataaacacttggaaaaaatttgctctgacagaatatggtttggtagcagatgacttgagatgcaaggtatggccattactactcgaagtagatccaacttctaatgaaaaaataccctctctagaagaactatctagtcatagtgaatatcagcaggtagtcttagacgttaataggtctttaaaaagatttccaccaggcattccatacaagcagaggctagctctgcaagaccaactaacagttcttatattacgtgtcattataaaatatccacatctacgatattaccagggttatcacgacgtcgccataacatttttattagtggtaggggaagtagtagcttttagaatcatggaaaacctcagcacgacacatttgagagattgcatggagcccaccatggagaaaacttcctataggttaaattacatttatgcccttttgtcaaaggtcgatcatgatctctataattttttggatagtgcttcagtaggtacgatgttcgcgcttccttggtacctgacgtggttcggccactccctcaaccaatacaaagacggtggtgcggttgtacgacttcttcctggcctcgccccaggacatgtcgctctacgtttccgcatctcttgtcattcaca

SEQ ID NO: 9244 - DNA, 1174 bp, Diabrotica virgifera
  misc_feature (942)..(964): n is a, c, g, or t
  misc_feature (1014)..(1035): n is a, c, g, or t
  misc_feature (1072)..(1107): n is a, c, g, or t
gactgttgtgaacgaaaagccctattattaatggatattcaatattttgaatttttatgtttgattaatttgagttcaacatgtcttcatcaaaaattatcgaactggatgaaaccaacacatgcaaaatctgcgataatgctcttgcaaaatactcttgtcccaagtgtaagctattatattgttctttaaattgctatcaagccaattcacacttagaatgcagtgaaagtttttataaagacaatgtctttgaagaacttaatttagacaaagaaagcccaaaatctaaggagaagatgctagaaattttgaagcgatttcacgaacgaaatctactaccttcgtcggatgtagacgaatcatttagaggatattcgggattttctattgaggatattttaaattttgatcctggagaatccgatggtgggaaactcgactctgatgatgagatgttagatattggagaaagattgcaaggggttaatttagatgatgccgagaaagtatgggataaacttacagatagcgaaaaacaagatttcctagcttttttaaaatcagaagatgtttccaatttaataccttcctggcaaccttggtggatgttttataatcccaccatggttgaagaagttgaaaaaatggatgattataaaaaggattgcccagaaatatgtaccattgaagatttcaccacattaacttcaaaagcaccagctgaatgtgtcaaatttaatttgataaatattcttactgcatatgcttttaccacaagatattttcatggggaacatttttgagtttcctcatcaggctgtgagttgtattgtaactatttctgtgacaataaaaatgggtcaagtgtttgaagacttccaaaactgctgtgaaatctggaagaacaggagtgtataaaaagggactgggaaatgaccnnnnnnnnnnnnnnnnnnnnnnngggggaggacataaaaaggaaacttaaaggaccaaaaaaattcaaacccnnnnnnnnnnnnnnnnnnnnnnttttttccgaaaataatcccccggttaaaaactttcnnnnnnnnnnnnnnnnnnnnnnnnnnnnnnnnnnnngatggaatttttccccaacttggtttccccaacccccccattttttccttctctgtgttatgggggg

SEQ ID NO: 9245 - DNA, 243 bp, Diabrotica virgifera
  misc_feature (165)..(190): n is a, c, g, or t
ctgtttcagaaaaaaggtgtttctggagctgttcagcatgattccatagtacaagaaggatgtcgaggaggtagtctcagaatacacacagaagcccgtattcgagccgagaagtctttggaagcgctcaggaaatccagagtagataactggaggtggtgaaannnnnnnnnnnnnnnnnnnnnnnnnngtttcaacagctgtgatttatattttgataaataaacttttatactagatttt

SEQ ID NO: 9246 - DNA, 51 bp, Diabrotica virgifera; identical to SEQ ID NO: 9123
  misc_feature (2)..(44): n is a, c, g, or t

SEQ ID NO: 9247 - DNA, 83 bp, Diabrotica virgifera
  misc_feature (7)..(54): n is a, c, g, or t
  misc_feature (56)..(80): n is a, c, g, or t
aaaatannnnnnnnnnnnnnnnnnnnnnnnnnnnnnnnnnnnnnnnnnnnnnnncnnnnnnnnnnnnnnnnnnnnnnnnnacc

SEQ ID NO: 9248 - DNA, 740 bp, Diabrotica virgifera
  misc_feature (12)..(12): n is a, c, g, or t
  misc_feature (14)..(14): n is a, c, g, or t
  misc_feature (47)..(69): n is a, c, g, or t
  misc_feature (695)..(712): n is a, c, g, or t
  misc_feature (714)..(732): n is a, c, g, or t
cccccccaggangngttgttgtatggtaatttttggttgtgtccctnnnnnnnnnnnnnnnnnnnnnnnggggaagttgaaagtagatgaaatgagggaaatgatggaaaaaaagaggaccctctgtaatatgtttgtgattgttaatgtggagtatggtaaatttagattaaaatattatatagtattaaaagatggtattattgttgttgataaagttggagaaaagagatttatagatataaggaaagatgaagaggaatgttgtattagtatgaaatgaagtgatatatgtatgttttgttaggtagatgataaagattttgtgttgataatgatggttgtatttttttataaatatgtggaaggtttcttggttagggatattgactctcctggataagtggcgtttcaatcagaagtaacaaatgaccgtccatattctgatggcggcctagaagttagggattgttgattgtggagtgtgggtagacacatgaatagaatacgataatatcgattggtgaaagttggaattgaatagatactagatgacaagatggacgtgtgtattgtgagtgtcacaacagtattaagaatatggttaatcctcgatatactgttttttagatgtaatgtggataggaattgtaattttcttaatatttcgcatattactgttgtactgtatatgnnnnnnnnnnnnnnnnnngnnnnnnnnnnnnnnnnnnngttgtggt

SEQ ID NO: 9249 - DNA, 440 bp, Diabrotica virgifera
  misc_feature (6)..(28): n is a, c, g, or t
  misc_feature (219)..(292): n is a, c, g, or t
  misc_feature (297)..(331): n is a, c, g, or t
  misc_feature (342)..(362): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnctaagaaaacnnnnnnnnnnnnnnnnnnnnntctataggttcttatcaccaattataacattttattctattgttttctcgaatatttatacattatttgctctgtata

SEQ ID NO: 9250 - DNA, 711 bp, Diabrotica virgifera
  misc_feature (273)..(291): n is a, c, g, or t
  misc_feature (570)..(570): n is a, c, g, or t
  misc_feature (614)..(633): n is a, c, g, or t
agatggtgtcgtcacttcgctctgaaagacactctctctaagctaatatataactctacgtatttcacccgtatttagtgaacacagatccgccatcggaaggcaactcatttttagaagttaaaacgtcaggatccttaaaacagttaaaacggataatcggacgaaatttatcagtaaaatataactttctcaccatctgtgaggttattaacatcacaaactcacaaatgatggagaaactcattttggatttgaaaaagtgaaagaacnnnnnnnnnnnnnnnnnnntctgaagacttctgccggagccaagttctgttttggaaagcaggaattcaggttttttggcggagcttggttccagtagagtctttagttcttcagatctagaaacttcgaaccgttttaagtagtagaagttagctacagggtctttgaggtggttgaaaatggtggtggtgggactctgatataatgaatggatacaatgtctctgggaatccatagactagggaaaggttattttatgggtagctttctcctaacaaataaacacaaagttattgngaggtcgcaggaggaacaggtgatataacttttagatttctagnnnnnnnnnnnnnnnnnnnnttacaaaattggcaggcaacagtaaggtgatttaatccacactggttagaagtgggaaaatggcgaagtagtagatat

SEQ ID NO: 9251 - DNA, 1012 bp, Diabrotica virgifera
  misc_feature (501)..(519): n is a, c, g, or t
  misc_feature (976)..(995): n is a, c, g, or t
agtagtcgcactttctgccaagtacgagggggattcgtcgaatggttttagaatgctgagcaaaaatggtttttgaatttttggataaaacgccctgtgactcagtgaggaaccacattttgtttaagtgttttaggttgaatcttcttattttgtgataaggtttctccggctactgtgtggacggttgttaatgaaacaccctgtatatatgccgaagggtcctagtttaaaaataacaatggaccagtctgaggaattctcttcaaatttgcccgttctcgagatgatgaatttatgcaggcacaaacgtcctcgcttatactgcagtgtcgcgcccgcttgattagcaattgaaaaccaaaggggttttcgctattgcattgcaaaaaagctcttcgggatttcgtcaatcgatgtttgaagaatatctgcctgccttggcaacattgaggttttcggttggatgtccgattcagggttgaaaatggccgatttcgnnnnnnnnnnnnnnnnnnncgcttatgtgtcaaaaactattgatctgggagaaaagtcactaaggaccttttctgtttggaattattcaaaaaacctaaaaaaaactttgttcgatgaaagagaatgattttaggaaaaaactctaaactttagaggagaaagtttattttgccccctaaactgtgcacttttcgattcacctggtagaggcgcgtgcagggctggtgcctgccaggttatgatttttatccttggtgtgctatgaattgtcactatacagatttctagccttacacagagaccgttactcggagggttcactagctcatagactatttgctattgtatagagctcgaatttgattgtgtatatttattgattttaatgtaattggctttaacaatatactacatataaagaagatatactatattcattttatttatgacattatccaactgcgctgtatattcnnnnnnnnnnnnnnnnnnnncatattcagtattttgg

SEQ ID NO: 9252 - DNA, 727 bp, Diabrotica virgifera
  misc_feature (2)..(202): n is a, c, g, or t
  misc_feature (206)..(253): n is a, c, g, or t
  misc_feature (439)..(468): n is a, c, g, or t
  misc_feature (482)..(509): n is a, c, g, or t
  misc_feature (512)..(526): n is a, c, g, or t
  misc_feature (556)..(582): n is a, c, g, or t
  misc_feature (594)..(631): n is a, c, g, or t
  misc_feature (663)..(683): n is a, c, g, or t
  misc_feature (712)..(725): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggnnnnnnnnnnnnnnnnnnnnnnnnnnnnnnnnnnnnnnnnnnnnnnnnacccttagggataacagcgaaattttattggagaggtcaaatcgataataaagattgggacctcgatggtgggataaaggttattattggggggagccggctatataattaagttctggtccgacttttaaaaattttacctggatccggaggttaaaccggggggggggccgaggtgggtttctnnnnnnnnnnnnnnnnnnnnnnnnnnnnnngaaaagggcccacnnnnnnnnnnnnnnnnnnnnnnnnnnnnggnnnnnnnnnnnnnnncaaaaggaggcacacaccacatacttgtannnnnnnnnnnnnnnnnnnnnnnnnnngggagagcaacnnnnnnnnnnnnnnnnnnnnnnnnnnnnnnnnnnnnnnccctaggggggaaccaagacttcggcggcggnnnnnnnnnnnnnnnnnnnnntaattttctttttatggggggggcccacnnnnnnnnnnnnnnct

SEQ ID NO: 9253 - DNA, 167 bp, Diabrotica virgifera
  misc_feature (7)..(78): n is a, c, g, or t
  misc_feature (87)..(154): n is a, c, g, or t
ctatagnnnnnnnnnnnnnnnnnnnnnnnnnnnnnnnnnnnnnnnnnnnnnnnnnnnnnnnnnnnnnnnnnnnnnnnngttgggggnnnnnnnnnnnnnnnnnnnnnnnnnnnnnnnnnnnnnnnnnnnnnnnnnnnnnnnnnnnnnnnnnnnntcccaattttttt

SEQ ID NO: 9254 - DNA, 791 bp, Diabrotica virgifera
  misc_feature (50)..(77): n is a, c, g, or t
  misc_feature (582)..(599): n is a, c, g, or t
aaaagcataaatcattattactctgtcgttctgcagagcaagaatgttcnnnnnnnnnnnnnnnnnnnnnnnnnnnngattactgtaaaagttttattgttttaagttaagtaaatgttatagttgaatcccgaataaattaaaatgaggaaacgagttgatttacccaataactggaatgatgattctcccaattattccgaaaaaataaggaataatattcacagtttaccattctattttggtattgtaactgtaatataccttttgttgttgactggagctgtttattatattgataaaaatttaccgactgcactgaatgtacaagacgagaaaacccatcctgattcatttattgctgaaagagcaattaatgatttggaagttcttactaatataggaccaagagtcgttggatcatatgaaaacgaagtattggcaactgattttctaaaacgggaaattgagcagattaaacttaatgcaaatgccaatcaaaaattagaattagatatacaattagctagtggatcatactatgttaatctgttgaaaactgacaatatcaatatttatacnnnnnnnnnnnnnnnnnnggtcaaaatacatggtgttaatgagactgacactgctgttttaattaattctcattttgactctgtacctacaagtccagggggaagtgacgatggtataaatgtcgtggcaatgttagaagtcctaagggaactttctaaatcgcctcaaagacctcttcacaatataatttttcctcttcaacggagctg

SEQ ID NO: 9255 - DNA, 724 bp, Diabrotica virgifera
  misc_feature (11)..(33): n is a, c, g, or t
  misc_feature (224)..(297): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (692)..(710): n is a, c, g, or t
acctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacctatatatttttactagatatacgattttttaatactaatattatcatgattacnnnnnnnnnnnnnnnnnnngttatttattaacg

SEQ ID NO: 9256 - DNA, 725 bp, Diabrotica virgifera
  misc_feature (3)..(16): n is a, c, g, or t
  misc_feature (21)..(526): n is a, c, g, or t
  misc_feature (533)..(570): n is a, c, g, or t
  misc_feature (590)..(603): n is a, c, g, or t
  misc_feature (606)..(628): n is a, c, g, or t
  misc_feature (636)..(658): n is a, c, g, or t
  misc_feature (688)..(719): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9257 - DNA, 168 bp, Diabrotica virgifera
  misc_feature (2)..(115): n is a, c, g, or t
  misc_feature (117)..(158): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnngggttggatg

SEQ ID NO: 9258 - DNA, 341 bp, Diabrotica virgifera
  misc_feature (29)..(29): n is a, c, g, or t
  misc_feature (53)..(53): n is a, c, g, or t
  misc_feature (112)..(129): n is a, c, g, or t
  misc_feature (143)..(165): n is a, c, g, or t
  misc_feature (199)..(233): n is a, c, g, or t
  misc_feature (242)..(306): n is a, c, g, or t
ttttgatataagaaataatttaccttagnggatacagcgtaatttttattggnagagttcaaatcgataataaagattgcgacctcgatgttggattaagtttataaatggnnnnnnnnnnnnnnnnnntaagtctgttcgannnnnnnnnnnnnnnnnnnnnnnagttataaccggggggggggccggggttgttgtnnnnnnnnnnnnnnnnnnnnnnnnnnnnnnnnnnnaaaaggacnnnnnnnnnnnnnnnnnnnnnnnnnnnnnnnnnnnnnnnnnnnnnnnnnnnnnnnnnnnnnnnnnggcggcccctaaaaagaggacaaagagtttatacg

SEQ ID NO: 9259 - DNA, 266 bp, Diabrotica virgifera
  misc_feature (85)..(125): n is a, c, g, or t
  misc_feature (140)..(159): n is a, c, g, or t
  misc_feature (172)..(187): n is a, c, g, or t
  misc_feature (190)..(204): n is a, c, g, or t
  misc_feature (208)..(237): n is a, c, g, or t
ggttaagagaaaataacgggaaaaatattctattatttaatggttttattaccccggaacttccataatattcaaacccccctannnnnnnnnnnnnnnnnnnnnnnnnnnnnnnnnnnnnnnnntaaaaattaattccnnnnnnnnnnnnnnnnnnnntatttcatattannnnnnnnnnnnnnnnccnnnnnnnnnnnnnnncccnnnnnnnnnnnnnnnnnnnnnnnnnnnnnnctaacccataacctaatcaaaccccaact

SEQ ID NO: 9260 - DNA, 516 bp, Diabrotica virgifera
  misc_feature (2)..(510): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatt

SEQ ID NO: 9261 - DNA, 283 bp, Diabrotica virgifera
  misc_feature (126)..(150): n is a, c, g, or t
catcacctaatctcatcttaggttctactggttctaccaaatacttattatatttacatatgtagttagtacctatattctacaatattacttaaaaagtaagtacatatttataaattttagtcnnnnnnnnnnnnnnnnnnnnnnnnngctaaactaaactatgcataagtaactaaaatttatgtaatacttatatgtacttacctatttaatgagttaccaaaatagattatattttatgtattttgaagcaccgcaaacaaaataaagatattacaat

SEQ ID NO: 9262 - DNA, 977 bp, Diabrotica virgifera
  misc_feature (60)..(93): n is a, c, g, or t
  misc_feature (436)..(455): n is a, c, g, or t
  misc_feature (663)..(688): n is a, c, g, or t
  misc_feature (814)..(814): n is a, c, g, or t
cgtacaccaaatttcattaaaattgacttactagaatttgcataataattttgcaatctnnnnnnnnnnnnnnnnnnnnnnnnnnnnnnnnnncttgcacaacaaaaactagaacatacaaagatttgtcaatttgtttacatgtagggaggtgctccacctgtctaatgcactttgcagagttgaaatcggattgtttaggcagcctcagcggtgttttagggttataaacggttttttgggttgtaaacaaattagtgctgtggccaggagggggtgctacgggctcctttatttagatggacttacccaagtttttttatgtattttgacccgtagaacacgaattttttgggtaacagttgatccggatgtcgataagattgttataaacaaagaacttgaggtattacataaaatcgatttttcgcaaaannnnnnnnnnnnnnnnnnnncttgggtaattctaagcaaaaaatgttcttacaagttttttcgtaggatgcatagctttcgagataaacgcggtggaactttcaaaaaatcgagaaattgcaatttttgagcgcgaataacgtttgattaaaaaatacaatagcaattctgctgacagcatttgaaagtttaagtcaaattataccggttttaattatttgcattgcnnnnnnnnnnnnnnnnnnnnnnnnnncaaagctatttgtttgtgggccaaagagttgtttatgagtttgaaacattgctgagtccccttgaatagcccgattttagttctgtagaggtgattggagatgggtggagcacctctttgtgtgtnaaaacattagccaacttctaatggtctactttttgttcagtcctaggtcgtttttaatgaaatttggtacacgatttactacttactttccgtaaaggatcatagggcatccacgaagcttctccaagggaactctgtctctgggcatagctgctacctctcc

SEQ ID NO: 9263 - DNA, 890 bp, Diabrotica virgifera
  misc_feature (795)..(795): n is a, c, g, or t
  misc_feature (868)..(868): n is a, c, g, or t
caaggggcgctcatatcagatgaggcagagcagtgccgttttgtgtttgtttttaacaaatactgtttatattataagagctaggataacgatatatttgaatataacaaaattaagtagctttaacaaatagacgatgacacgcgtacttagtcgctttgattactttactgatgtttagtgtctttattatgttactcgtggtttaggaaaatattgctattgggttattccctcttgtctgtcattgaaaacctccctaaagatttcttcagagtttagtttaaaaatcttcttctttaagtgccatctccgcggcggaggtcggcaatcatcatagctattcgtattttagagatggctgctctgaaaagttcatttgatgtacatccgtaccactctctcagttgcgcagccacgatattctgcgtcgccctatgcttctctttccttgaatctttccctgcataatcaattggagcaagctgtaactctctccacgtgaaatatgtccgagatattccaattttcttgttttgatggtatttaggatttccatttctttattcatccttctcagaacctctttgtttgtaacgtgttctgtccacgatattttcagaattcttctgtacacccacagctcgaatgattctagttttttcattgatgcagcattcaaggtccaagcttccattccataaaacagagtcgagaaaacgtagcacctagccaacctaactcttagctccaacttcaaatctcttgtgcagagcactttgctcattttgttanaatttgctctagccttttctatcctgattttgatttcctgtaagtaatctcctgtggagttgatcattgttcncaggtatgcatatttatcgact

SEQ ID NO: 9264 - DNA, 832 bp, Diabrotica virgifera
  misc_feature (298)..(317): n is a, c, g, or t
cctccccaggccggaaaagaaaccaaatcatcaccttaattgccccttacaaatatgtgtcgtcagtattcaataggtttgttccagctcggtacagaaccgttcgtgaatcgttacgcgcatgcgcaataacgaataattatgcgtagtaacacattttttgttactgcgcatgctcgtgaccgttcaggagcggttttgtatcgggttggaacagacctaagtatggtgcaaatgaagggaataaattcgttatttcgtaagtcggcgacttaacgaaaaatcttgaaacaggtcnnnnnnnnnnnnnnnnnnnngattttttggcatattcaatcatactagtgacatcgtccatctaggcgtgatgacgtaatcgatgatttttttttaatgaaatgtttgattccagtaaagtttgctaataattcttaaatcacagatgtttatttgtataccagcggacaaactgtataaagtttgtttagcggaaaatggttggcttcagttagtacggtcgtaaatataattaaatttatctgacgtggcccattgttaagaccggtccggagcgataagcaaacgaggtagacagagttggtcttttgacaattaacactgactagacggtactcctataataaagcaaaggatccacaaaatttttacctgaaatacgtgaatgaaacatattttacttgaaaccgggccttttatactattatcggttaacccaggatgtttattcttcttcttcttcttaaggtgcctatccgtttccggatgttggcgaccagcatggctatcctaactttgcttgctgctattctga

SEQ ID NO: 9265 - DNA, 134 bp, Diabrotica virgifera
  misc_feature (9)..(57): n is a, c, g, or t
  misc_feature (60)..(72): n is a, c, g, or t
  misc_feature (87)..(106): n is a, c, g, or t
attgggggnnnnnnnnnnnnnnnnnnnnnnnnnnnnnnnnnnnnnnnnnnnnnnnnnacnnnnnnnnnnnnnccccatcttttctgnnnnnnnnnnnnnnnnnnnncttaggggaaaacccccggaattttttt

SEQ ID NO: 9266 - DNA, 1047 bp, Diabrotica virgifera
  misc_feature (859)..(859): n is a, c, g, or t
  misc_feature (870)..(870): n is a, c, g, or t
  misc_feature (903)..(925): n is a, c, g, or t
  misc_feature (928)..(950): n is a, c, g, or t
  misc_feature (953)..(990): n is a, c, g, or t
  misc_feature (1002)..(1025): n is a, c, g, or t
tgatttttcattgtttatcgtcgtattttcgtctattttcatttcatttggatttcgtttcccgtttttgtgaactttataaactttaccacaatgcaaactcgattatttaaggaaattattattggaaactccagatgttgcgagaaagatatttattgaagctgaaaataattggggatttagatccatacggaattcagtcagaattggattttacagtaaagtgcagtccatcaagttactattatagatatttatacagatctggcggagtctcacagttgctactctaagcagcagatgaaagcatacaaaagccttcaggcacatacatattttacatctggatttgttttgaatggagtaaaaattgttaatgatttcctgatttccatattattgttggaaaggtgaagcatttccaaaaagctaatgctaaacgacttaatggttgggtggggtgatagccagttctgatgacatagcaaatgcacattgtatgcgtatggccggtaatagtgaagtctgcagcaatcctatttttagctgagtatgcccagagcaagacagacgaacaagaacccaatggatgtacatatgttacagctacatggtttggagatagcaacatatgcattctctgatgaaaaactaatgagttttgaaactgttcggtcagagtgcttgttgcgctcactaaaagaactgaaatataagatggctttggcattgtgttgcagcgatatgaaaatggttattcatttttaattataatgtacttcttcatcatgagtaattatgtattggtcttttagacgtgtatttatttttgtaattagtatcaacttgtaatgantatatacattnatccggttagggaccaacaatgtttttgactcnnnnnnnnnnnnnnnnnnnnnnnccnnnnnnnnnnnnnnnnnnnnnnnttnnnnnnnnnnnnnnnnnnnnnnnnnnnnnnnnnnnnnngagaggtccccnnnnnnnnnnnnnnnnnnnnnnnnacccaaaggtgggagggaaaaa

SEQ ID NO: 9267 - DNA, 867 bp, Diabrotica virgifera
  misc_feature (435)..(463): n is a, c, g, or t
aatagctatatatttacatgcagaaactgtccttatcgatgtaccctcgaagatttgtggctcgccaacgatcatggaaccgacgttagtccgatactgggccgaaattttataaatgacatgtccggacacgataaagtaaagtaaagactgtatggcgtccattacaaaatcattggctacaaaatcacctgtttaagccacttcgtggattcacagagtagcgctgcaaagtggtttgtctgtttttaacttataaaaactaaataacttataaaaaacactttcagtacaggaaaatcagtaaaagaatggttgattatatgtttttatttacttattgggaaaaatcaaagaaatgactgcaaattcttaataatgcaactcttgggtttttcgttagtttggaaagcttttaggtataggtatgctagnnnnnnnnnnnnnnnnnnnnnnnnnnnnncgtttataatagaccttggtgactgcaaactggttgaagatcctgtaaacctgtttgcttggaatttgattgatttaaattataacaattttgttccatgactactattaatttccgatcaaagttttacttgttatgtgaagttgcgcaatattgtatttctaaatgaatacctatatggtttaaaaagtggcaaacacacagtgtttgcttttgaattttatcaataattacatcaccaaccccgatttccattgttttgtccttaatgtaagttttttctattaaattaatatctcgttaaacgaatcttgtaaatttccgccgcacatagtcatgtaaaagaagagagtgcacactattggtaaatcaactgttttggtttttgtgggtttggatttttt

SEQ ID NO: 9268 - DNA, 204 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccag

SEQ ID NO: 9269 - DNA, 162 bp, Diabrotica virgifera
ttttgcgtccgtactaataaaataaatgattgacgttataagtatattatcataatcccgttcttttatcctattctttgttaaagctctgtacttaattagataattgtgatgtcacagtttgattagtattgtaatgtctgtaatattgtaattttctgt

SEQ ID NO: 9270 - DNA, 651 bp, Diabrotica virgifera
  misc_feature (125)..(155): n is a, c, g, or t
  misc_feature (160)..(190): n is a, c, g, or t
  misc_feature (192)..(205): n is a, c, g, or t
  misc_feature (318)..(364): n is a, c, g, or t
  misc_feature (369)..(406): n is a, c, g, or t
ctcactatagagagaagataggtacgcgctgcgtgcaggcggggcggaattcccggcggcccctttcttgcgcgtgatgaaatagtttttagcaaaagtaaagagctttattatttagtgacaannnnnnnnnnnnnnnnnnnnnnnnnnnnnnngttannnnnnnnnnnnnnnnnnnnnnnnnnnnnnnannnnnnnnnnnnnncaattaataattacataattattatattcgtatttaaaaaagctaaaaaaataagatgtttattgtgaaataaatattttcgataatatgctttgcagcgaaacgatatccgnnnnnnnnnnnnnnnnnnnnnnnnnnnnnnnnnnnnnnnnnnnnnnnattgnnnnnnnnnnnnnnnnnnnnnnnnnnnnnnnnnnnnnngttaaatagttttagggaagatctgaatgatatgattgtatatatagtttatttttgcatagaaattaatgatgttgattttcttattataggcaatgtgattaattattccaatatatgattaggtttattctcaattattcgcatgttaaccccggaatttagaatattgaaataccgaacgtgacgctaatagagctattgcttatctgagtgatgataggaaactgtacagttcataatca

SEQ ID NO: 9271 - DNA, 332 bp, Diabrotica virgifera
  misc_feature (3)..(4): n is a, c, g, or t
  misc_feature (11)..(98): n is a, c, g, or t
  misc_feature (289)..(318): n is a, c, g, or t
ttnnatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaattacccttaggggataacagccgtatttttatgggggaggttcaatcgataataagatggcggcccccgatggttgggtaaagattttaattgggtggagcagctattttattaaatttcgtcccacttttaaattttacttgaatggggtttaaacgggcggggggggcgcggcggggtgttnnnnnnnnnnnnnnnnnnnnnnnnnnnnnncttaggcccccacc

SEQ ID NO: 9272 - DNA, 733 bp, Diabrotica virgifera
  misc_feature (2)..(44): n is a, c, g, or t
  misc_feature (52)..(724): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaagc

SEQ ID NO: 9273 - DNA, 983 bp, Diabrotica virgifera
  misc_feature (116)..(130): n is a, c, g, or t
  misc_feature (840)..(840): n is a, c, g, or t
  misc_feature (854)..(854): n is a, c, g, or t
aaaatctagaagaatgaggatagaagtagcatcaaatatggataatgataggcgaagaggtagaatggacatgaatcgtgacaggcaaccagatcgcagcgattcttttggtgatnnnnnnnnnnnnnnnagggcatcttctgacagtatggataaccgccgaaccggttttaatagggatcgagacggcggtggaggtggcggaggatttaccagagaaggaatgcgtgatagagatgacaaaagttttactcgtgaaggaatgagagatcgtgactatggtagagatagggacaatcgagattttggacgtgacagagatagtaacagagacttcaatagagatagggatagtaatagggatagaaaagatattgatgatcggcccggtggatggagagatggagatagacaaaataaagatggggaccgcgacagagataggggtttcaaccgtgatagaggcaatttccgtgactctgacagaggcaaccgatacgacgatgatcgaagaggtggaggctttggtggaagaaggtttgatgacagaagggatgataaagacagagatagacgggatggattttcaagaagagatgaccgggatacagagtcgtcggaaccacgtgaaaggccaaaattaatgttagcaccaaggacaaaaccagtagaagttgtacctgtaaatactacagaatcagtgccttcagcttctatattcggtagtgcgaaacctgtagatacagcgcagcgagaaagagaaatagaagagaaaattgccagagaggctgataaaccaagagaaagtagcaaagatagagatgagaatagaaagcatgnaaatagtgaacganaaaatgtagataggattgaaagaagtaggccaccaccacgcagaatagatgatagccccacaagagataaggaccacagagatggacctaaaagaactatgatgacagaaaatacctccctaaaatgat

SEQ ID NO: 9274 - DNA, 879 bp, Diabrotica virgifera
  misc_feature (809)..(809): n is a, c, g, or t
cagacttgccaataacgaaaagaggaattttgtgagtccctgttgcattcgaacaaacggccactgtagtacgttctttgttctttgtaaagccagatgcagactgttcatgactacctagaaaagttgtttctggtaacattttaatgtttagcccggtctcgtccatattataaactggttctggagataatttctctgtttcaatcatttcaccaaacttaatcttgaattctgtcgcaccagaagaatcatcagacagtttttctccacttacgtgtgcgaaatgaattccgtgtgcttcttccatcgattaagccaaccatcacatgccacaaattcgcctccattattaatcttctggtggatagccaaagctttttctttcaaaattgggccgccaatcagtgtacctcttcgacgttcctgaagaaaccagatccacaaagcttcatcgacgacctcgcaaatcgatttttttctcgtacaacggctacccagatttttatcagattccattttcgagcaaaactcctcaatggaccgtctatctcttcgccagtcatttacagtgctttttccaacattaaattctgcacatattttcgccacggattcaccattatcaatccgctttagcacttttaaacgtgtctccatcgaaaccacaattcgtttacgctttgcactcattgggaaagtatgttatgtacgtgcgtacccacagcagaaacaaaccaaactgatcaaaacgacaagtacacagtttatcgaacgtcgcgaaaacacgtccacactccacacactanagtcgattgactgctctttcatgttttgcgtcggttaccgtccggggaagccgaatcgctcgccgcgccg

SEQ ID NO: 9275 - DNA, 896 bp, Diabrotica virgifera
  misc_feature (158)..(188): n is a, c, g, or t
  misc_feature (796)..(796): n is a, c, g, or t
aattaccgtcttccaaacaacatccatccatgtctgagagatctgtatcagcatctggtactgttgattcgtgctgttgagatgtttgttctttttctcttctgccactcggctctttttgcttatcagcacaattgatgattttcagttttccattnnnnnnnnnnnnnnnnnnnnnnnnnnnnnnntctactcgtttttcattcatcaaaatttgattcttcaatgttttaaattgaagctcaacaggagcactgctggctggcactcgtccgtaaccaaactggtccctgcaaatactagaccagagtggaatagtgggtaattgtttgacgagacgttttgaaaatgtcggagaatatcgagggtttatgtcatctcctgtctccttctctaatattgaaacgactttcttttccattgatgaaatccattttttcagagtattctcattttcattttcatctgcatcctcaatttcaatttctgaatggaaattttcgtcattgttgttcaataaactttgttccacaatctcttcgatttctggtgtgacttcggtaataatgtttttcatggaattcacagctgctgtcaaagacggagatccagtaccagcggtctcacttgttgaaatcaaaagtagggcttctataatccgggtagcttgtgattggcttctacataaaattaactggccaatagaaaacatgtaaaatttcctggttaaggaccaaaatgtcgattttgagattgacacacgttattaaggaataaagtgttctctatcgattgncactagtctcgtttttatacgatgaaaattgagctcaggatgaattattcttttaactgcgttgttttacccctgcttgagcgagaggacttcaaacgcg

SEQ ID NO: 9276 - DNA, 892 bp, Diabrotica virgifera
  misc_feature (824)..(824): n is a, c, g, or t
gattgttctttttaaaaacgactcaagacgtgaagcgcctggaaggagtcagtagagctccagtatattcccatgttatcgccaccctagacggaatgacaaccataagagcatctaagtgcgaagatatggttatccaagaatttgacggacttatggacaatagttcaggagcttggtacctctatattgcttcctgtgaagtatttggcttttatcttgattgcataagtacagtttttatagctatagttacgtaccagttccttatttttgataacccagatcccagttctgcaggaaacgctggccttgtcttatcccagtgcttgatattaacaggaatgttacagatgggcgtccgccaaactgcagaagtagctaacaatatgaccagtgtagagagagtacttgaatatacaactttggaaaaagaaacagaaggaaagaaacaactgtcagtgaataatttaatacctagatataaatctctagataaagattggccacaagcgggagaagtagagtttaaagacgttttcctgaggtacacattagaaagtgctcccgttctaaagaatttaaatcttgtgtttagagctggagaaaaaattggtgtagttggcaggactggtgctggaaaatcttcacttgtatccgcattgttcagactttcaccattagaaggatcagtaaaagttgatggcgtggatactgtcaatatagagcttagtaaattgagatcaacaatttctataataccacaagaaaccagttctgttctcagcgactgttagatataatctggatccatttaacactgnttagtgatgagcagatatgggatgcattagaaaagggtagagttgaaacattcgattactgaccttga

SEQ ID NO: 9277 - DNA, 479 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagctttc

SEQ ID NO: 9278 - DNA, 601 bp, Diabrotica virgifera
aaagcaactcagtggtctaggtagtactcggtagtttattgcctgactaagtgataaggtgcaaaatgaaatacgttttgattgttgttttatgcaccgttgctgttgcatacgttgcggctacggcagtgaaagaatgtcccaacaataaaaacggtttaagttaccctgatttagcagacagggtttctcttcacaactgtaccaaagctccatgcagagccagaaaagatagctttcaaaaagttgaatacaaatttacaccagataaagattacaagaacctccatacaagagtaactgctgaaatattgggtactgctctacctttccctggagttgatggtcagtctgcgtgtcccaatttatacgaggaagacaagactacgaaagtaaaggattgcgaagttaaagcaggaaaaaactactattacaaaaacggttttgaggttttaagaatttatccaaggataaagaccaatgcccattgggaactctatgagccaaaaacttcaaggaatattatgtgtttcgaatttttggtccggataactaattagtgatattttgataacctacattaaacaataaattttttatt

SEQ ID NO: 9279 - DNA, 712 bp, Diabrotica virgifera
  misc_feature (334)..(371): n is a, c, g, or t
  misc_feature (438)..(464): n is a, c, g, or t
accgttacttattttaaaaaaagatcttattccttactacaagtaaagatatattttatttcatgatactcaattagcattgtgggataatattccattttcaccaaagaaaaaattattctttgtaccatgtgtatcagggatgatgatttactaagtatatatgtatcattttcctatttggacgagctaaacaattaacatctctattgaaaaataaacatttaacagaatttcttggtaaggaaatgttattctttgttacatatctccaatttgttaggaaataaattaaatgtgttcatcagcaagacatttatcattggacatttgnnnnnnnnnnnnnnnnnnnnnnnnnnnnnnnnnnnnnngcatacaacagtttattaaaattcatctttccaatacaagtcaggaccatgaattttcctattttgnnnnnnnnnnnnnnnnnnnnnnnnnnnttcttagcttcattgcttatacctcttttattacatcatccattgacactcttcgaatttatgccatgaagactgtatccctatctggacaccgtatatttcgtatcaaatatctaggccacctaaggtgcctcgcctacattttattcacctgtctcctaggagcatgactttttctattaaacatgctggctcgcctgaccactgatgactttgcatggccacggtatattgaccgtgctaaggca

SEQ ID NO: 9280 - DNA, 374 bp, Diabrotica virgifera
  misc_feature (12)..(175): n is a, c, g, or t
  misc_feature (182)..(219): n is a, c, g, or t
  misc_feature (239)..(252): n is a, c, g, or t
  misc_feature (255)..(277): n is a, c, g, or t
  misc_feature (285)..(307): n is a, c, g, or t
  misc_feature (337)..(368): n is a, c, g, or t
tctatagggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9281 - DNA, 69 bp, Diabrotica virgifera
  misc_feature (6)..(50): n is a, c, g, or t
aaagcnnnnnnnnnnnnnnnnnnnnnnnnnnnnnnnnnnnnnnnnnnnnnattattaaataagttttta

SEQ ID NO: 9282 - DNA, 551 bp, Diabrotica virgifera
  misc_feature (252)..(272): n is a, c, g, or t
gactcctatagggaagctgggcgcccgcgggcccggcccggattcccgggccccttccgcgccgctgatattatttaaatcatagcgattttttatacctgtatgagggatttctttgagatacaaaatgcagagcgacaatacctctctttttcttccctgcttatattttcgtgccctgtgggtctagcggagatggagcaaccctcgtatctctagtatttgaggatgcgacggtttcaccggtggacnnnnnnnnnnnnnnnnnnnnngtaattgttctattagttgaaatgcactgtcagcacccatgcgcttcccttatttctggaggcgcgtgagcccacaaggttcatgaccagcacccgcatttcctggaatgtgtgcgtaataggcgaggtattattacaagcagatatgtctatagtaaaatgtctacacgcctagaatgctatcagatgcaatgaggataggcaaagtgcaaagagggatgacaagtactgtcaccatatggatgaatagaattgctcagtgcatacaaactatatccg

SEQ ID NO: 9283 - DNA, 927 bp, Diabrotica virgifera
cacgctcttaatgagctcctcgtatggatctccaagactgatgctaccttagacgagttaaaacccgttgcgggagatccacaagtattggagatcgaattagctaaattaaaggttttggttaatgacatacaggcgcatcaaactagtgtcgatactcttaatgatgctggaagacaaataattgaaagtggtgaatccgatgaagccagtgttacccaagaaaaactcaacacgctgaatactcaatggcgttctctaatgcagaaagcagcggatagacaaagggagcttgaagatgcgcttacagatgctcagagatttaatgctgagattcaagatcttctgtcgtggttaggagatgtcgatggaatcattaccgccagtaaaccagttggagggttaccagaaaccgcctccgagcaattggagaggttcatggaaatatataatgaaatagaggataacagacctaaagttgagacagtcttagcgcaaggtcaagaatatctgaagaaagctacttcacctgcatctaacttacagcagaatttgcgcacattaaaacaaagatgggataatgtcactgccagagctaacgacaagaagatcaaattagaaattgctcttaaggaagctacagagttccacgaatcactacaagcattcgttgattggctaactaatgcagagaaacatcttcaaaatgtgaaaccagtttctagggttttggaaactattcagaatcaaatagaagaacacaaagttttccaaaaagacgttagtgcccacagagagataatgcttgctttagacaaaaagggaacgcatctcaagtatttcagtcaaaacaagatgtcatactaatcaaaaacttacttatcagtgtacagcacaggtggggagagagtcgctcccaaatcactg

SEQ ID NO: 9284 - DNA, 123 bp, Diabrotica virgifera
  misc_feature (43)..(60): n is a, c, g, or t
  misc_feature (87)..(108): n is a, c, g, or t
gccgtattggtaaaccccggccgtgtactaaatattgactgannnnnnnnnnnnnnnnnngtttacatttgttttattgtttctagnnnnnnnnnnnnnnnnnnnnnncctatatttttatct

SEQ ID NO: 9285 - DNA, 905 bp, Diabrotica virgifera
  misc_feature (2)..(18): n is a, c, g, or t
  misc_feature (24)..(68): n is a, c, g, or t
  misc_feature (70)..(743): n is a, c, g, or t
  misc_feature (745)..(745): n is a, c, g, or t
  misc_feature (756)..(756): n is a, c, g, or t
  misc_feature (762)..(762): n is a, c, g, or t
  misc_feature (770)..(806): n is a, c, g, or t
  misc_feature (810)..(840): n is a, c, g, or t
  misc_feature (846)..(896): n is a, c, g, or t
cnnnnnnnnnnnnnnnnncgtgannnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanaagcttaattnttttanagacgagnnnnnnnnnnnnnnnnnnnnnnnnnnnnnnnnnnnnntagnnnnnnnnnnnnnnnnnnnnnnnnnnnnnnngggggnnnnnnnnnnnnnnnnnnnnnnnnnnnnnnnnnnnnnnnnnnnnnnnnnnntccattttt

SEQ ID NO: 9286 - DNA, 549 bp, Diabrotica virgifera
ccggaattccccgcgccgcccctctccgccgccgactggcagtaccaatgattgaatgttacctatatttttgattaatctattttgatacctgtgttatacaaactgtttatactgtagtggtatgctactatgtcaaaaaaggaaactcccagcaaggacgactaatgttccaagaagactatttggaaccgaatttactaatcggcgcacactcaatttatgggtactacaggcgtagaccgaaataacttataaaatggagataatgaatgaacaggtaggccttaactaacacatcttgagacaagatactgatgttaaaatgaaattcccaggaattaatgcggtactttccgtgactgctgacataaatgtatggtagaatatactgcgaagaatatagttgacatgaatgtcttataagcactagaccggagaataacttacatcttctctaccagagatcgaaacacgacatatggtacgatggaattgatatccaatgggaaaggccaagaaccagaccagagaaaatattctggactg

SEQ ID NO: 9287 - DNA, 401 bp, Diabrotica virgifera
  misc_feature (167)..(185): n is a, c, g, or t
  misc_feature (204)..(230): n is a, c, g, or t
  misc_feature (236)..(336): n is a, c, g, or t
gggtgaagctgacaggttcatcggtaacaaaatgcccaaacatttgttctcaggcaagagaggagtaggaaaaacggataggagataagtcgaagaacatattattatactgggagaaaaacgattcgtgttggaagtgtgttttggtagaaccataaaaatgatgnnnnnnnnnnnnnnnnnnngaacatgattagattgttnnnnnnnnnnnnnnnnnnnnnnnnnnngtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaaagggacccaggtttacgaccgggggggggggaggccatagtttttttaaagggccccca

SEQ ID NO: 9288 - DNA, 1184 bp, Diabrotica virgifera
  misc_feature (14)..(47): n is a, c, g, or t
  misc_feature (63)..(122): n is a, c, g, or t
  misc_feature (130)..(745): n is a, c, g, or t
  misc_feature (752)..(906): n is a, c, g, or t
  misc_feature (918)..(983): n is a, c, g, or t
  misc_feature (985)..(1013): n is a, c, g, or t
tcccacaccccgcnnnnnnnnnnnnnnnnnnnnnnnnnnnnnnnnnnccccactactttaacnnnnnnnnnnnnnnnnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttaatttnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnncttaagggataacaggcggaatttttatttggaaaaggtcaaatcgaataaaaaagattgggacccccaaggggggattaaaggttataaatggggggaaaacgtaattttattaaagcgggttcgctttttaaatttttaattggtttgggtttaaccggggggggggcc

SEQ ID NO: 9289 - DNA, 643 bp, Diabrotica virgifera
  misc_feature (9)..(642): n is a, c, g, or t
cgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 9290 - DNA, 772 bp, Diabrotica virgifera
  misc_feature (2)..(50): n is a, c, g, or t
  misc_feature (52)..(754): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccctatagagtttta

SEQ ID NO: 9291 - DNA, 629 bp, Diabrotica virgifera
ctacgggttcaagggtgccgaaatcgccacggcgtcgtaccgctctgagctgcaattcctgggcaacccggtgaccaaccatcgtccagagcgcggagcagcacaaccaggacgtgaactcgctgggactcatctcctccaggaagacggccgaggccatcgagatcctgaagctcatgacctccacgttcctgatcgcgctgtgccaggccgtcgacctgcgccacatcgaggagaacgtcaagagcgccgtcaagggctgcgtgatgacggtggcgaagaagaccttgagcaccaactccgccggtggcctccacgtcgcccgcttctgcgagaaggacctgctccaggagatcgagcgcgaggcggtgttcgcctacgccgacgacccgtgcagcgccaactacccgctcatgaagaagctgcgcaacgtgctcgtggaacgcgccctcgccaacggcacggccgagttcaacgccgagacatccgtgctcgccaaggtcgcccagttcgaggaggagctgcgcgcggcgctgcccaaggcttgtgggaggccgcacgggcggccgtcgagaacggcacggcggcgatacccaacaggattaccgagtgccgctcgtacccgctct

SEQ ID NO: 9292 - DNA, 96 bp, Diabrotica virgifera
  misc_feature (6)..(91): n is a, c, g, or t
gtgatnnnnnnnnnnnnnnnnnnnnnnnnnnnnnnnnnnnnnnnnnnnnnnnnnnnnnnnnnnnnnnnnnnnnnnnnnnnnnnnnnnnnnnacctt

SEQ ID NO: 9293 - DNA, 416 bp, Diabrotica virgifera
gagaaagctaagcgccagtagagatagatagatggcttccgcctctgtgtaacgtcgatatcaagtacggtggtccagctatctttgtctgtcgtgcgagtgtgagcgtatctaccaagaggtgggagtaatggaacgacagttacacagaggcggaagcaatctactttcattatgatcgcagatagtgctattgatttatacgattatctgcttctggagaaatggattcctaagactcgtatttgcaggatgttcttaatattcacaataattttattggttaaaaatcttaaaactcatatataaagagtcttcgtggacgatagtggatgcttgttaggttatgaattattctcatttcttgatgctttagtttctcttagaaattcatgtatattgaaggctttataata

SEQ ID NO: 9294 - DNA, 301 bp, Diabrotica virgifera
  misc_feature (2)..(102): n is a, c, g, or t
  misc_feature (109)..(146): n is a, c, g, or t
  misc_feature (166)..(179): n is a, c, g, or t
  misc_feature (182)..(204): n is a, c, g, or t
  misc_feature (212)..(234): n is a, c, g, or t
  misc_feature (264)..(295): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9295 - DNA, 742 bp, Diabrotica virgifera
  misc_feature (44)..(61): n is a, c, g, or t
  misc_feature (214)..(237): n is a, c, g, or t
  misc_feature (256)..(277): n is a, c, g, or t
  misc_feature (286)..(302): n is a, c, g, or t
  misc_feature (304)..(335): n is a, c, g, or t
  misc_feature (342)..(478): n is a, c, g, or t
  misc_feature (481)..(496): n is a, c, g, or t
  misc_feature (501)..(659): n is a, c, g, or t
  misc_feature (681)..(721): n is a, c, g, or t
  misc_feature (724)..(741): n is a, c, g, or t
atttttctcttctctttaaaataatcaaaatctctctctcttcnnnnnnnnnnnnnnnnnnctttctctcaacgatagttaatctcagtatccgtcggagtgaatctctttctcctttctcaaaagaaaaaatcttcacttcctcgtaccttcgggtatccagggatctcaccattcatcatctctctcacttcatctctttcgaatcttcaannnnnnnnnnnnnnnnnnnnnnnnctcatgtaaaataaatctnnnnnnnnnnnnnnnnnnnnnncgaaacgtnnnnnnnnnnnnnnnnncnnnnnnnnnnnnnnnnnnnnnnnnnnnnnnnncttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnncatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaacatggtctttttggnnnnnnnnnnnnnnnnnnnnnnnnnnnnnnnnnnnnnnnnngannnnnnnnnnnnnnnnnng

SEQ ID NO: 9296 - DNA, 883 bp, Diabrotica virgifera
  misc_feature (175)..(192): n is a, c, g, or t
  misc_feature (524)..(546): n is a, c, g, or t
  misc_feature (549)..(582): n is a, c, g, or t
  misc_feature (803)..(803): n is a, c, g, or t
gggtaaaggaaggggtagagcaaaataaataacagtatggataggtatttttatgaaaatcaatatcgatctaatgatagatttttataacagcgaaaaattgtttgtatattatgataagtcggtgtaagataagtttaacaaaatatttgaaagatccgctatatctaaagtnnnnnnnnnnnnnnnnnncagttggctttaaatagaagttaagatgtaacatatgtggagataagatgtctagtataatttattaattacaaatttttgcaaattttttattggaatcatagacagtgttgcttgacaaaatttgataagatatttgtctttataagttagaaaatgctggacattctctggaatcttcaatctttaatgaacattttatgcatctatttctgaatttgggagattaatttttgttaaaaaagagtaacagacgacgcaatataatggtcttccgaactgatagcttaataaaatggattgctatttttttgacctcacttgtgagtgannnnnnnnnnnnnnnnnnnnnnnccnnnnnnnnnnnnnnnnnnnnnnnnnnnnnnnnnnctatttttattctaatagtcatcatctctattgtacactatggtttaaaaacaaactatagtagtgtatcatcttccacgcactggcgtcttgcactgacttactctaatttaaaacatttgttacttaatacgttttgtatgtttgtaaacgtttattgttaatttcatgtaactcaaaaaattgccctgaaaaatatttgtaagaatagatctaattanattgtagtaataatgaaaaatggtttaacgtaaaaaatcctgtacgtatttataagcttttagatttgtaattcttttct

SEQ ID NO: 9297 - DNA, 201 bp, Diabrotica virgifera
  misc_feature (27)..(27): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (175)..(176): n is a, c, g, or t
  misc_feature (184)..(184): n is a, c, g, or t
taacagcgtaattttattggagagttncaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggtggtttctatctttaattnnataatatnatttagtacgaaaggga

SEQ ID NO: 9298 - DNA, 754 bp, Diabrotica virgifera
  misc_feature (2)..(44): n is a, c, g, or t
  misc_feature (52)..(751): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncga

SEQ ID NO: 9299 - DNA, 888 bp, Diabrotica virgifera
  misc_feature (755)..(755): n is a, c, g, or t
  misc_feature (837)..(837): n is a, c, g, or t
tggatatcgtagtgggactcaccagaaaacattttaaaactccattgctaaacagtccagtctcagtgatcattcgtaaatctcatcctgtgagctcgataagctgctgttaatttagggcatgcgaacaaaccactttcatgcaggactattcttacagttcgtgaagaaatatgagttctcgacagtggcgtaacaaaatctgtcggggcccccccgcagaattggcaatggggccccctttaaaaactactaaatgcgacatgtgtaacaaaaacttatgtgttaaagcccagtaaatgaacgtgatatacggtgataccgtgtaattatcaatgtcaccaccaaactggtccagtcaatacttttcgagttaattacgactgaaaatgcaacacgttttcaggaggtttttcgcaaataactcaaaaagtaagtattcgtcagtaagtagtaaaaatgtagcttatataaaaatgaagtctatcgaccctgtaaatgtaaatttttagcttatgaaaaattgttcttattcgtcaaattccaaatcgaatatttcaacgtgaaacaaccaaaaaatgaagcaccccaaatgaaacgaatcattaccgctttgcaaattacttaacttttttttatatgacctgtaagtttcaccggttcaaattgcttattcttgaatgagttttatttgaaagggctctaacgagtcattaatcacgagtgtatgcaaattttgaatagccatgttttanacaattttttcttacagaaaaacaaaataaaaccaatatatttagaaaagcaaaacctacatttctttaatctttaatactncacaactgaataatactcactaatactcaagaccgatttttcgaggggact

SEQ ID NO: 9300 - DNA, 815 bp, Diabrotica virgifera
  misc_feature (18)..(36): n is a, c, g, or t
  misc_feature (532)..(551): n is a, c, g, or t
gttatgtagagatcttgnnnnnnnnnnnnnnnnnnngttacttataattttgttaattctttttaattttgattaaagttctggttttgattgattctttatgttttagaatgttaatcaaaattaattgataaaccaatgatataaattcagattcaaacaagacatacgtaattttttgctagctttgatcccaataattgtggatcgctcgttattaatattatgtgatacatgacagaagctcgaaacaattgacagtcgatgaaagccctgtatagtgatcatggatcataacctcaacctcacaaatttgtttttatatgtattttctacaatttctgtttttctttgattttttttgtgcgttttttgagctcatttcatgatggaggaagtgatgagacttagtatagtcgaatatatggtctatttaaaaggttctgaacattattctgaatatgtagttgaaggtgaggaacttttaaatgcagggcatttaatattagctgggataactgaccagcatttnnnnnnnnnnnnnnnnnnnnctctatgtgacgaatctagtactattaaccataatccccatgaaataaagggtgaattaatgatcattaaggacaatgctttgaagataaatgcaatgcattgttcctgtacagctggcaatagtggacgatgcaaacacatttcagctcttttaatcaaatgtataagagcagataatattgaaagtctggaggaaatttcccaaacggatattaacagtgtttggtcaaatgaacacaaagacacaaatgataattataaac

SEQ ID NO: 9301 - DNA, 75 bp, Diabrotica virgifera
  misc_feature (10)..(45): n is a, c, g, or t
  misc_feature (47)..(72): n is a, c, g, or t
gttaaaagcnnnnnnnnnnnnnnnnnnnnnnnnnnnnnnnnnnnngnnnnnnnnnnnnnnnnnnnnnnnnnngat

SEQ ID NO: 9302 - DNA, 716 bp, Diabrotica virgifera
  misc_feature (2)..(45): n is a, c, g, or t
  misc_feature (47)..(89): n is a, c, g, or t
  misc_feature (97)..(714): n is a, c, g, or t
cnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 9303 - DNA, 202 bp, Diabrotica virgifera
  misc_feature (7)..(44): n is a, c, g, or t
  misc_feature (64)..(77): n is a, c, g, or t
  misc_feature (80)..(97): n is a, c, g, or t
  misc_feature (100)..(100): n is a, c, g, or t
  misc_feature (111)..(133): n is a, c, g, or t
  misc_feature (170)..(190): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnaangtctgttcgannnnnnnnnnnnnnnnnnnnnnnagtttaaacggtgtgagccagggttgtttctatcttnnnnnnnnnnnnnnnnnnnnngacgaaaggaac

SEQ ID NO: 9304 - DNA, 98 bp, Diabrotica virgifera
  misc_feature (35)..(53): n is a, c, g, or t
tgtcgtcggagatatattatagagatatttgtagnnnnnnnnnnnnnnnnnnntagatgaaacctattgttttgtggttgatgataatagcagcatct

SEQ ID NO: 9305 - DNA, 892 bp, Diabrotica virgifera
  misc_feature (117)..(135): n is a, c, g, or t
  misc_feature (485)..(504): n is a, c, g, or t
  misc_feature (564)..(576): n is a, c, g, or t
  misc_feature (578)..(591): n is a, c, g, or t
  misc_feature (648)..(675): n is a, c, g, or t
  misc_feature (732)..(744): n is a, c, g, or t
  misc_feature (746)..(759): n is a, c, g, or t
  misc_feature (819)..(837): n is a, c, g, or t
  misc_feature (868)..(868): n is a, c, g, or t
ttattttcattttcatttatttcatttatttcatttattcatctcactttttggatgtaaaattactattgtattttggaatatatcatataaatcaaatcaagtttaataaaatgnnnnnnnnnnnnnnnnnnngcgaggaaacgtgtaaagtaaaaatagagtataataatgacttggattatgatcttttggaaggcattaaatgtgaaattcaagaggagtccaatagagaagttattctggacagatatgattccttagacttgaagaaatgtcccataaatactgatataaaacaacatggaaattcatttgaagaaaaccaagaaactgaaaaaggttatctcccaaatgaaacaaaatggaaattatggagaaaccaattgaagattcatcttacgaaggaaatgatatgagtctaaacactgaagaaaaaacattaatcaaaaatatggaagttgtgactggaaagagaccttatnnnnnnnnnnnnnnnnnnnnacagtgtaaaactgcaagtgatttgacaagacatttgagagtgcacactgatgaaaaatnnnnnnnnnnnnngnnnnnnnnnnnnnnatttagtgaagcaggttatttgaaaaaacatttgagactgcacactggggaaaaacnnnnnnnnnnnnnnnnnnnnnnnnnnnnatttagtcaagcaggtactttgaaaaatcatttgagagtgcacactggggaaaaacnnnnnnnnnnnnngnnnnnnnnnnnnnnatttagtgaagcaggtaatttgaaagtacatttgagagtgcacactggggaaaaacctcnnnnnnnnnnnnnnnnnnngaaacaatttattacaagaagtgatttgaanatacatttgagagtgcacactggg

SEQ ID NO: 9306 - DNA, 746 bp, Diabrotica virgifera
  misc_feature (6)..(44): n is a, c, g, or t
  misc_feature (52)..(657): n is a, c, g, or t
  misc_feature (677)..(723): n is a, c, g, or t
  misc_feature (730)..(730): n is a, c, g, or t
cgtgannnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggagggttggatgannnnnnnnnnnnnnnnnnnnnnnnnnnnnnnnnnnnnnnnnnnnnnnaagcttnaattttttaaagacga

SEQ ID NO: 9307 - DNA, 861 bp, Diabrotica virgifera
  misc_feature (2)..(16): n is a, c, g, or t
  misc_feature (18)..(794): n is a, c, g, or t
  misc_feature (796)..(838): n is a, c, g, or t
  misc_feature (840)..(858): n is a, c, g, or t
cnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnncnnnnnnnnnnnnnnnnnnnggg

SEQ ID NO: 9308 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9309 - DNA, 626 bp, Diabrotica virgifera
ctatttttaagcaaaatttccaatttctaaaagtgaaaatgtccacaaacaacaataaaaaaagcataagccaccgtactaataacttatagtgcggaagcttatcgcgtcaaatttctagcataagcccccgtactaagaacaacttatagtgcggtggcttatcgcgtcaaatttctatttggacaatttcacatcccttcagcagtcatccagataaataacataattacatgttgcatgtcatacaaacaaaacagacaagtgtaccggggaccaattcagatgcggagatggcaaatgcattccgagaaacaaggtctgcaatcgaaaatatgactgtgatgatctttcagacgaacgaaactgtcgtaagtgttttcatcttcaatgtcttgaatttctcgatttcttattacatttttataacatctgtcgtatttcttttcatttcgtggtgacttaatacagtagaaatccttcaaaaatgtccaatgtttatattacgactgttgtttttcacgagaggttatcattaatatgaaccaccgacagcttgaatacgtaaacaaatatacgaaatatcgtggctgctggatcaccatcaacttgattatacacaacaa

SEQ ID NO: 9310 - DNA, 897 bp, Diabrotica virgifera
  misc_feature (688)..(688): n is a, c, g, or t
  misc_feature (783)..(783): n is a, c, g, or t
catttgaaatatttagggatgcattttgttgggcgctccctgtgtacaggatttggtctgttgctacactgttggtcgatacagacagggtagtgcagcttttgtttgaaactttttttgtattcccgaaattggggagggtaggtgggggtcaggatataatgagaagccctgtacagtttcataagagaaggtaagcaaacagttcatcaaagatatccgcagttatataagagacacattcattattttagtatttgctcggggctacgtccattgataatgggcttccaaaaaacacgtgggagtggtacacaaacaatatatttgtcgcgtattgtgcccgaaatactgcagattttgatatttgatggtggtctgtacgtctcggttcttcttcattcttccgaggatttcctcacttgtgactcagtaaatccatgtgattgatgtgatcttcagtaatctccgatagagccacgcacatcttaaatacttctaaacttctacatatatctttgttcaacgttcacaccataaaaataccgagagagagagaattgtggctcttgaagaaactcctcatccggttgaaggtggaagctgtttcgatgcgtctcttatctcctggttgttgtcatttattatggtgcctgggtagttttagtgcttcattgtttctgctggnggtatggttgacctcctgttatcgttttcttgtaattatcaagaagctttgtgttctttacatccatattgagtccatattgactgtagtaccgntgattttgttcataaaaatgttcccgtgatctctttctcggaattgttcagttcagatgatcctgatatgctatacagtcgagcccgcttattagaatacctgttacaggatat

SEQ ID NO: 9311 - DNA, 595 bp, Diabrotica virgifera
  misc_feature (493)..(517): n is a, c, g, or t
aattcccgcggcggcccccccggcccgacttattttaatggaatcacaaaatgtgaacgttgatctccgaaaaagctatcgttaatgactagctagttagggattgcgatacgaatactcttatttctataaaagaaaaatgtatgtattagtaccttgcgcttgcgcgtttgtcacatcttaatccatacagttatgattttctaatttacacgagctacaaaattaaaattcttattgtaaaacaaatattttaaataacctttttgtaatggaacggattgcgtattgaatatatcctaattctttaacagatagattacatttatttgtcatcaccatagctataattaataattatgctattatcaatattaattatgcttatggcaggagtttcccaataaaatattattagtcatttacctttttactacacattaccattagcatacttcgtattttaacgagaggtacgattaatatttgatgnnnnnnnnnnnnnnnnnnnnnnnnnactctatactacaatacaagtttaaattatcttagttcgagcaacgatgagaagattagaattataaaatagaatctt

SEQ ID NO: 9312 - DNA, 406 bp, Diabrotica virgifera
cgggcttcacccgaaatgttatgggtttgtatacacctaaagaaacgatagacgggccttataacattctgctaaaaattataaatcattttcaaactttttatccgtttcaaaaagtgcgcgacactttctgcgtgtactgtataataactacttaattatccaccgaatttgataattacagaaaagcctaacaaatcataccatgaattgcttgtggtaggtctagaggatagttttcattaccgtacacgcgtcatggaataagaattatcatacatcacattaaagaggattactatcctgatatcggcgtagatatttggaatattactaaacaccgattctacagcgatcacgatagcccgtcgacctattattgactttgaactgtaggtgtagtcat

SEQ ID NO: 9313 - DNA, 779 bp, Diabrotica virgifera
  misc_feature (2)..(46): n is a, c, g, or t
  misc_feature (53)..(336): n is a, c, g, or t
  misc_feature (341)..(489): n is a, c, g, or t
  misc_feature (513)..(555): n is a, c, g, or t
  misc_feature (602)..(619): n is a, c, g, or t
  misc_feature (623)..(662): n is a, c, g, or t
  misc_feature (665)..(713): n is a, c, g, or t
  misc_feature (715)..(741): n is a, c, g, or t
  misc_feature (748)..(748): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatatatagggttaatacagggnnnnnnnnnnnnnnnnnnnnnnnnnnnnnnnnnnnnnnnnnnngtattaatataagtctcgcctgccactgataatttgaaggccgcggnnnnnnnnnnnnnnnnnnagcnnnnnnnnnnnnnnnnnnnnnnnnnnnnnnnnnnnnnnnntgnnnnnnnnnnnnnnnnnnnnnnnnnnnnnnnnnnnnnnnnnnnnnnnnngnnnnnnnnnnnnnnnnnnnnnnnnnnntatagangtttataaatattaatagtttttttagatta

SEQ ID NO: 9314 - DNA, 313 bp, Diabrotica virgifera
tatggtgttgatgattaatctgctgtggcaagaaatataaagaataagagagagagaggttggagttatttgttaggaaaaaagagtgataaaaaatgataaaaatgccaatgtgtgtaatgcttgggaggaaatagatgttattgttataaataatgtgagtggggggtaggacgggggcagtaattgtatgttggtatcttgttaagaggcggcgtaattcggatgtaatataaataatatgattgtataattctggacaaatgaagaattcagatttcttgtctgcggtgacagacaagctaaagattag

SEQ ID NO: 9315 - DNA, 427 bp, Diabrotica virgifera
  misc_feature (315)..(335): n is a, c, g, or t
  misc_feature (377)..(394): n is a, c, g, or t
aaatcgggagggaagttaggcagggatgtactatgtatccattcctactcgatgtatacagtgaattaatttttaaagaagcaaagtgaaggaaatgatatattaattctgaagacggagaaataatatttaacgcaagaaaaataaataacataagatatgcagatgacaccgtgattatggcaagctctgctgaacagcaattttgtgaaaaatatatgtctaaacccactttactttcgtgtcatgcaatataagctatgcctatttatatatttattgtaaactacttctaatcaaaatacatattagtgnnnnnnnnnnnnnnnnnnnnncattgtatgatgtatgtatctactaattaagtatgatgtatnnnnnnnnnnnnnnnnnnaaaatatcatcgaaaaaaactttatacatgttt

SEQ ID NO: 9316 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9317 - DNA, 827 bp, Diabrotica virgifera
  misc_feature (14)..(32): n is a, c, g, or t
  misc_feature (56)..(96): n is a, c, g, or t
  misc_feature (103)..(157): n is a, c, g, or t
  misc_feature (173)..(226): n is a, c, g, or t
  misc_feature (256)..(352): n is a, c, g, or t
  misc_feature (398)..(423): n is a, c, g, or t
  misc_feature (438)..(517): n is a, c, g, or t
  misc_feature (526)..(566): n is a, c, g, or t
  misc_feature (582)..(615): n is a, c, g, or t
  misc_feature (623)..(635): n is a, c, g, or t
  misc_feature (638)..(677): n is a, c, g, or t
  misc_feature (686)..(739): n is a, c, g, or t
  misc_feature (769)..(805): n is a, c, g, or t
ggcgccctttcccnnnnnnnnnnnnnnnnnnnccccccggggctgcccccccccgnnnnnnnnnnnnnnnnnnnnnnnnnnnnnnnnnnnnnnnnntggggtnnnnnnnnnnnnnnnnnnnnnnnnnnnnnnnnnnnnnnnnnnnnnnnnnnnnnnnacggcggcgcgccgcnnnnnnnnnnnnnnnnnnnnnnnnnnnnnnnnnnnnnnnnnnnnnnnnnnnnnntaccttctctcttttctgttgtgtttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgtttccccgcgggtgagtacccccggcgggggggggttgcgnnnnnnnnnnnnnnnnnnnnnnnnnnaacaaaccacccccnnnnnnnnnnnnnnnnnnnnnnnnnnnnnnnnnnnnnnnnnnnnnnnnnnnnnnnnnnnnnnnnnnnnnnnnnnnnnnnnggggggagnnnnnnnnnnnnnnnnnnnnnnnnnnnnnnnnnnnnnnnnngttggtgggggggggnnnnnnnnnnnnnnnnnnnnnnnnnnnnnnnnnngtggggtnnnnnnnnnnnnncgnnnnnnnnnnnnnnnnnnnnnnnnnnnnnnnnnnnnnnnnggggagggnnnnnnnnnnnnnnnnnnnnnnnnnnnnnnnnnnnnnnnnnnnnnnnnnnnnnngagagaggcggtgcggcgcgcgcgcgggcnnnnnnnnnnnnnnnnnnnnnnnnnnnnnnnnnnnnngcgcgcccccccccaccccacc

SEQ ID NO: 9318 - DNA, 857 bp, Diabrotica virgifera
cggacgcgtgggaacaaaggttgaatttcagtgccattattttttagacttaggctgacctgaaaagatgtcaggagattcaaaaggatttatagcagcattagacataggaacaacaacaatcaaatgccacattatcaattcttcagcaagatctattggatttgcttcgcatttagtaaaattgcactatccacatccaggatgggttgaaattgttcctgatgaattttttcaaaatattgtacaagttgtacatcaagcaataaaaaatgctaatgtaagcatgcatcagataaaatcacttggtatttctacccaaaggtgttcatttgttacttggagtaaagataccggtgaatattttcataattttataacatggatggacctgagggcatctcaattaatacacaagatgaattcatctatgttttttatgagtataagatgggcagcatttttgatatatttaggaacatgcaataagaaatatggaatggctagtaaatttcgagttagaaataatcatgtcactggtcgacttttatgggttttgaaaaatttaaaaccagtgcaacaagctttaagaaacaaaaatttgatgtttggtaccgtggatacttggttaatatataaacttactggaggtctatcctatgttacggatgtcactaatgcaagctcaacaggtttctatgacccttttacactcgattggggtattgttgctaaatcgcttggtattcctacacattttttacccaaagttgtagcaaatgattacgattttggggaactgatgaaagtatatttggtgtgcccattaaaattaagtgtgtgatggcagatcaaca

SEQ ID NO: 9319 - DNA, 370 bp, Diabrotica virgifera
cgatcaagtcaacttttgactaaacgaaaataactataattcgaaaaatgaaattcacgattgcatttttggttttggcagtcgctttctgcgcttacgcccaagaagaacaagcaccattgagcccagaacaagttgttgaccttatcaaagagaacaatcccgtagtagcatgtattaacctggaatgtcgactttcttgcaggaatcaaggcttcaaatcgggttactgcagtgctggaaccagctgtgcgtgtgtgggacctttgacacctttattgttttagaatatttcaattggtttttatctctagatctgataaacaaacttgtgtaccttaaaacaatgtaacttagcaattatttttat

SEQ ID NO: 9320 - DNA, 199 bp, Diabrotica virgifera; identical to SEQ ID NO: 8259
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t

SEQ ID NO: 9321 - DNA, 592 bp, Diabrotica virgifera
  misc_feature (3)..(47): n is a, c, g, or t
  misc_feature (54)..(537): n is a, c, g, or t
  misc_feature (539)..(584): n is a, c, g, or t
ccnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngcccactg

SEQ ID NO: 9322 - DNA, 248 bp, Diabrotica virgifera
  misc_feature (24)..(41): n is a, c, g, or t
atcctatctagagattgttgcttnnnnnnnnnnnnnnnnnntatgttttattcgcagaagacatattttgtgtgtatctggttgttgcatggtaggaatattataaaaagaaattataagtatgcctacaggcgatagaagtgcgagagacaataaagatcgttaacacaacataacaaagatatttaatggatttaaagggaagccctgccgaaaccgacacctctcctacctgattgggcgaactg

SEQ ID NO: 9323 - DNA, 920 bp, Diabrotica virgifera
  misc_feature (8)..(41): n is a, c, g, or t
  misc_feature (852)..(853): n is a, c, g, or t
gttgggcnnnnnnnnnnnnnnnnnnnnnnnnnnnnnnnnnnccggactggtccaatcttacaataaactatttaacgtagtgtagttttcgtaatttattgttagtgatagtttttttatacaatttagatagacccaaaccgagtatggcagacagaaaagcggaattagaacgtaagaaagccaaactacaagcactgagggaggaaaaagatcgaagacgtcgggagaaggaactgaaagaggtcgaggaggctgctaacagaactcttctgggaggtggtggcgataggaaagaattagacgatttgctaagggaagttggtgtagcgcctgtttctgaagtgttttctagtatatccagtgcaaattcactcacgccagagcctagtcgaaaccacacaccagacacttcactacaaccgcatattttaaccaacaatgtaacagctgtaaaaaagaagcttccccaacttacagttgttccagtacaaactacaaacattccccccaaggaagttgttgtctacacgaagcagacccagacaacaactactggacatgatgtcagagacgcccacgcgaccgattactacggagaggatgaggagggcagtttaccgccacatctcggaggatatggtgggagtaagctaccgcccgggatcctaccgcacggtcttccccaagtcaaggaggtccagccagcggttacggctttggaacaggaacagaagaaggaggaggtcaaagaaattagggaactgagcgaggaggagaagcagatgatcatactttcagaggaattccaacacttcatagatagggccggaagagtaatggagagggctnntatgcgaagtgtcgacatttatatggattatacaggcagctaaggagaggaaggactggacgaaaat

SEQ ID NO: 9324 - DNA, 129 bp, Diabrotica virgifera
  misc_feature (13)..(38): n is a, c, g, or t
  misc_feature (44)..(128): n is a, c, g, or t
ttagtaaaaagcnnnnnnnnnnnnnnnnnnnnnnnnnntatagnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9325 - DNA, 960 bp, Diabrotica virgifera
  misc_feature (461)..(478): n is a, c, g, or t
  misc_feature (772)..(799): n is a, c, g, or t
ctattattttaatgttgcatcctaattttaagcataggtacataaagttttaactaccaactaccatttaaataactttaatagaatacggagcgcagtccagcactctgaatcggcgattttcgactcttgttggagtcatcctcggagaggcgtaggcctgctgctctctgctcgaagtgaccaaaccatgaaagcttatccccagattacaactgacgtgtatggattaggtgactagcatcatctggcagttgaaagatcccatgtactacaaaaggtctgcatgtatttcacctacaaagttcgttacacaaacagctccacagagatacctgaatttcctattgctccagaaattgcactagaattattgatggctgctaatttcttagactgttaaattatttattctaaaaaaaatgtgggttgttcattacttagctgtaaaatgcagttgnnnnnnnnnnnnnnnnnnttcataataataataattagacgacaattgaaatcctgcacggataccagaagaagaaacaattattttgtctgccgaagttgattttttcatatgtttaaatagtttctataaagtttaaacaattacttttattgtataaatagatgattttgtggcagtgactcatatcattttccaatgttccctgaaaaaaaaactgctgctcaactacatttaaccctgcgttagtgcgatgggtaaatattagacagttagagcggtgggggtgtgtagaaccccaacaaaaagtannnnnnnnnnnnnnnnnnnnnnnnnnnntttcagaaataagataactgtaatctttactaaatgcctttatggcttcgatctaaaaataacagtaattgaaaaaatacaaatagtattctgaatatgtccacaaagaacacaaaaatatttctaggtagggtgtacacactctgccgactaacgcaggt

SEQ ID NO: 9326 - DNA, 918 bp, Diabrotica virgifera
  misc_feature (5)..(25): n is a, c, g, or t
  misc_feature (547)..(573): n is a, c, g, or t
  misc_feature (873)..(894): n is a, c, g, or t
  misc_feature (901)..(901): n is a, c, g, or t
atgcnnnnnnnnnnnnnnnnnnnnnttagaatttaaaccgagaatgacttaagtatattcttgtaattttcccaaaagacacttctaatagcttgcactcataagatacatatgttataaaacatttcaccttctcaaaaaattactcatatttggtaaattagccgttttcagttacctggttatataacgcattatgcttaaaatacatttctcctgattgcattcaagaatcactttgtataatgcctagtgtgaccaactagtccgaaaaatccgggacatggcccgaaataaaaagtcgtgtccaggcatcccagacaagtcttccgggccatccgaattttcaacgctttggtaaaattctatttcaaaattttgaatacgttattcttcatataattcacatctaattgaattggtgggacaaaaaaaagtcgacaatttctagagtgtaatactaacaccacatccaaaacgcatgcattttatatcgtggtattatagttctacgaaacctataatggtggacttttttcgtttctgnnnnnnnnnnnnnnnnnnnnnnnnnnngaacgacggaaagctagacttagaaattgcagatgggacaacgaaagatatgagaatatattatgcgattaataatacgatactgggaaaaagggaaatcagccaagaaacaaaaatacatgtatttatacaatcacagtaccaactcttctataatatgcaagcgagacatgagttacctataaataaaagatatgaaagtgccataaatgcagcagaaataaagcaactgagaaaaatagctggacagggaaaggaacgaaaacatcaaaaacgtgctaagacaggaaagcatagagnnnnnnnnnnnnnnnnnnnnnntgaattngttttgtacatataact

SEQ ID NO: 9327 - DNA, 267 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(265): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnga

SEQ ID NO: 9328 - DNA, 804 bp, Diabrotica virgifera
  misc_feature (79)..(98): n is a, c, g, or t
  misc_feature (437)..(454): n is a, c, g, or t
  misc_feature (760)..(760): n is a, c, g, or t
agaacggctggtactattactactttaccggcaggtactctgtgagtcacatcagtgagttcttgcttctgtcattcgnnnnnnnnnnnnnnnnnnnnggggtatcattttttgtgttatctgcttttgaactttgcaattttattagaggttattagtgtttacctactggtgcttgtattgcgagtggtaataatgcaccgttacacaacagaactacaataattaaaggatataaacagtaacacaaacaaaaccgcgaccttcttaactgaatttcgcgactgcggtattgttggttgtctatctactggaagtgagtttggagtcaacatggggtgtttttcaaggaaacagcgtttagggttcgtcgtagcgatatcactaggatgtgtactttttggaataataatcgctgttttcttcagtagctgggnnnnnnnnnnnnnnnnnncacaaattaaattagtaaatggtacacaaacgttcagttggtgggccaaacctccagtagagcccaagataaggctttatatctacaacgttaccaacgctgatgaattccttaataatggatcgaaacctatcgtcaacgaattgggtccatatgtatacagagaaagatgggagagaaaaaatatttcaatacacgacaacggaacccttacatttaatctacagaaaatttaccatttcgacccagaagcatctaaaggtagtccagaggaccctagttggtgtaccaaatattcctaatggntgagtgctacctcccaatccaaacatgccgccagattcctcagg

SEQ ID NO: 9329 - DNA, 521 bp, Diabrotica virgifera; identical to SEQ ID NO: 7280
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (484)..(515): n is a, c, g, or t

SEQ ID NO: 9330 - DNA, 707 bp, Diabrotica virgifera
tagactgatagtgagagcacagggcccggattgcgaacactcgatacgatgcgtatcgagtgtacttaatccggatccagagatttagatttttcaaaaaactgcaattgtgacttccctttgacggacttcctcatgaacagattaagtataattgaaatattttctgcttctactcagactttacggatccatcggaaactgtttttaccaaagagctaattttctttctatttttgcggtaaacgttcactcgagtacctgtagtcatgccaaagtatatgggtgatttggtttattattttggcacgttatggttctgcgaatagatctcttgaatcgaatgtaactaagttcgagttccaaagatgtaaaaatactaatgattcttgagttattcaaaatggtaacgacacatagattagctatctagtgttaccggatatatacgtaactgactgaaacaatttcgcctccattcactacttgcgaatgtagagtttaatttcactaatttccccggaaatgtgaaatgtaccagcattaaattcgattgtttcagcgcatcatgcggggcctttaaagaatatctaaaacatctctcttataatcccacttataaatacagactattagaataaaatacccagatctcactcacccccgctacacattttaatttacacaatatctaaaaagtactcata

SEQ ID NO: 9331 - DNA, 429 bp, Diabrotica virgifera
  misc_feature (17)..(36): n is a, c, g, or t
  misc_feature (101)..(149): n is a, c, g, or t
  misc_feature (289)..(309): n is a, c, g, or t
ctattatgttgttgcannnnnnnnnnnnnnnnnnnntataggagctgtatttgctattatagcgggatttattcaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 9332 - DNA, 906 bp, Diabrotica virgifera
  misc_feature (16)..(31): n is a, c, g, or t
  misc_feature (33)..(49): n is a, c, g, or t
  misc_feature (260)..(287): n is a, c, g, or t
  misc_feature (814)..(814): n is a, c, g, or t
  misc_feature (827)..(827): n is a, c, g, or t
  misc_feature (849)..(849): n is a, c, g, or t
  misc_feature (882)..(882): n is a, c, g, or t
attttagatcgagtcnnnnnnnnnnnnnnnncnnnnnnnnnnnnnnnnnctaataactcatgatccaataaaattgtaaaaaaatgggaaattcagtctctgcggctgaaatagccaaagtaactgcatcgcagttaataaatgcaaatgatcctgtagaagtagaaaaacatcgccagaaatatcaggattacactggagaaataccgccagaatgtcccatgcaccaaaaggtacaacaaaaacaagtggaatctggnnnnnnnnnnnnnnnnnnnnnnnnnnnnaatcccttaaacatgatgggaccagccaatcaaaagccatcaccaggacaaccctttcccttatccactgatcgccaggtttcaacaatacctaaagctataataaaagaaggagaaggacacttttgggtatatcctagtccacagatgttttggaatgccatgctgagaaaaggttggaaatggagagatgaggatattaagcaaggagatatggacaacataataaaaattcacaatgccaataacgaacaagcttggcaagaagttttaaaatgggaggcgctacatgctaatgaatgtcgagatccgagactgaaaagctttggcggtaaagcacaagactacagtcccagagttagaattcgtcatcttttgggatacgaattacccttcgacagacacgactggattgttgacaggtgcggaaaagacgtccgatatgtcattgactattacgatggaggagattgtgatgacaaatacagatttgctctgttggatgttcggccggctatggacagctntgacaacgtttgngacagaatgaaggtgtgctggntggcgatggttctacagcgatgaatagatacangtagctgcaggcagtcgtatcact

SEQ ID NO: 9333 - DNA, 136 bp, Diabrotica virgifera
  misc_feature (2)..(15): n is a, c, g, or t
  misc_feature (26)..(94): n is a, c, g, or t
gnnnnnnnnnnnnnnagacgagagcnnnnnnnnnnnnnnnnnnnnnnnnnnnnnnnnnnnnnnnnnnnnnnnnnnnnnnnnnnnnnnnnnnnnnggggggataaaaaaaaaatcaacttttttcatataatatata

SEQ ID NO: 9334 - DNA, 823 bp, Diabrotica virgifera
  misc_feature (642)..(662): n is a, c, g, or t
  misc_feature (688)..(706): n is a, c, g, or t
  misc_feature (784)..(784): n is a, c, g, or t
ggaaacacaaaatcggggtcgccaaacggagagaaaatttcccttttcgcgggaaattttcaacataaatggcgataatgggaaaatgttaactccaaatgggaaatctcattcggtttcagtccaaatcgtcgaaaatcatctcaagaaaaaaatcaaaataacttcgaaaaatcaatctcaacattcttctcagaatcttcgtaaacaggagggaagttttttttcatcaaaagtgggaatttttaaggtaagttcgacggaaaaagcttactcgacggtcggcaacgccaaagcctctcggttgcttcggttgtgcagtttggcacgttttggttctgcgaaatggcctattgaattgaatcggtacctaaattcaaattccaaggatgtaaaaatactaatgattcatcgataaactcgaaatggtaaagtcacatagattaataatatagtattaccggatagataggcaactcactgtaaaaatttggttcctttcgccacttgcgaccgtagtgttaactaatcactatttggcgggaaatttaaatggacaagcattaatttcatccgttcagcgcctcttgcgggccctttcgttactaattaaaatatcttcttataatctcacctatattnnnnnnnnnnnnnnnnnnnnnccagaacttactaagcttgttaaagnnnnnnnnnnnnnnnnnnnctaagtaatactcataaattattcggaattcccaagttaaaaaatatgttatttttgctgtcaaatttagtaaggaanagggatataaaaaaagttatgacaatgtttttctaatat

SEQ ID NO: 9335 - DNA, 914 bp, Diabrotica virgifera
  misc_feature (376)..(396): n is a, c, g, or t
  misc_feature (899)..(900): n is a, c, g, or t
aggcaagtagtttcatcgtcttattgaaaagattgtcatctaagttaccagacaatttttaatgattttttcaataattaaatacaatgaaagataaggaatccccttgccttattcctcgtatcttattaaccttacatatactcttctccaataattgccattttattctgtcattcgtgtagggccatttttaaaagatataatagtttccgccagattcctaattcttccatagttttaaaaaggtatcagaaaaaattataaaataaggctatacacttgttgttgtttataagttgccgctgttttgacctgtcaaatttaatcaaaacagcaactaataataaataacaacagcgtgtaatacttcttnnnnnnnnnnnnnnnnnnnnncttttttaaaacgacttccggattggaaatccaaacgtcaaaaacaaatataaaatataatttctattacaattaattgaggcttaatcccatataaatgtaatatgtatgtaggaattcgttaaagacaatagtaataaaagtccgtgtgatgtttaacagttttaattaataaaatagataactaaattatagatactattaaattaacgaaatgtaaaagtcttgtgtaattgcgactaaatttttacgtgttcttattcttacaaaaagaaatgtatttctaaataatttgcgtctaatcagtattataaccgtcttgtcataatacccgtcttaactcgtctttttctattatcccaaaggacacgtccgtcgcgtttctgatgttaaaatcgactgactctcgcctcctacgctgaaacaaattctcttccagagttaatctccctcttctcatggtttaaattcgctttcgtgtgaactaacctattaaaatttgnntcaagggctctact

SEQ ID NO: 9336 - DNA, 981 bp, Diabrotica virgifera
  misc_feature (17)..(37): n is a, c, g, or t
  misc_feature (894)..(894): n is a, c, g, or t
  misc_feature (905)..(907): n is a, c, g, or t
cgttgttccttgtctcnnnnnnnnnnnnnnnnnnnnngtctcacagtttgcacggtacttttgtctctgaaaagattaataagattcgttggaggcctgacgaatttaataactgtcactttttcgtcacaggaagtgtagataatgttcaaaataatattaaattgtgggatttttgtgaaaacattgaagaagatgatgtatatccgttcttagtattcaatgaaccttattgtggagacgtgactgaaatagagtttttgaatgctgattactttgtaacatcttcgtctagtggatctgcacatcttaagaaaattataccttcatacacagaaagtacaacattaaagaatgaagttagttggagtaagatacatgagtttaaaaatggtgatgagagtccttgtacttctttaactacatatgaaaacgatattgtcacagtcggagaagatggaactattaatttgttgaatgctaagtctccgaaggttgtcaggaaaatagataacgctgatagctgctctatacactgtgtaatatttttaaaacataatgaagtattaacaagtaacttgaggggtcagatgaaaatttgggacttgagaagcactgatggcaagccgaatagtacttttatgatcagtggggaacaagtgacacctacatgtcttacttttcatcccacacaaaggcacttggtgattactggtgatgatttaggttcattaactacatgggacttacgtcataacacctatccagtaaatgtactgaatgcacacgaaggtgcagtgtctgagataaaattcaaccccgaatgtccagatcagctcttcactttgctcagctctggagaaatttggcattggactaccccaagcactgcangtccctcactnnntgtagatactactgaggctaatgtatggctggcaccctgatatgtgaaaaccaagtggatgtttcactcttatg

SEQ ID NO: 9337 - DNA, 121 bp, Diabrotica virgifera
  misc_feature (11)..(59): n is a, c, g, or t
gaataaaatcnnnnnnnnnnnnnnnnnnnnnnnnnnnnnnnnnnnnnnnnnnnnnnnnncattatttgtattaattaagtaatttttttcgaaccacatgtttttttgagttataaagaat

SEQ ID NO: 9338 - DNA, 106 bp, Diabrotica virgifera
  misc_feature (5)..(22): n is a, c, g, or t
  misc_feature (32)..(104): n is a, c, g, or t
aagcnnnnnnnnnnnnnnnnnncgagaaagannnnnnnnnnnnnnnnnnnnnnnnnnnnnnnnnnnnnnnnnnnnnnnnnnnnnnnnnnnnnnnnnnnnnnnnngg

SEQ ID NO: 9339 - DNA, 766 bp, Diabrotica virgifera
  misc_feature (361)..(472): n is a, c, g, or t
  misc_feature (488)..(507): n is a, c, g, or t
  misc_feature (576)..(593): n is a, c, g, or t
cgtttttatcagtcacggccgtaaaatccggtccaatgctatccaaacgcattacttctttcgaatcccgagaaaactaataaatatatttgaaaaattcaaacgcagaataaaatattacattattaccgagggttgaaagtcccttagaataaacaaaaggtttcttttgaatgaaatatttgaaatgaaaaagaatgattctattatagatacttttatcgcatacttttcatttcgtttttatcagtcacggccttaaaataatattaggtagcacttttgtacaggacaacaaacagtaagacattgttctttgggtttaaataatcgcttctatatacagaacaacgtctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgtacaaaagannnnnnnnnnnnnnnnnnnnggccgtgactgatccccacgaaatggatagtttgcgttaaaagtatctataatagaaatattctttttnnnnnnnnnnnnnnnnnncaaaagaaaccttttgtttattccaagggactttcaacgcgcggtaataatgtaatattttattcttgcgtttgaatttttcaaatatatttattagttttctcaggattcgaaagaagtaaagcatttggatagaattggaccagattttacggccgtgactgataaaaacg

SEQ ID NO: 9340 - DNA, 696 bp, Diabrotica virgifera
  misc_feature (259)..(284): n is a, c, g, or t
cggacgcgtgggattattccccatttcagttacctaccaaataaaaatgcttgcgtttgctttctgacagtttcccaatacgaactgattctacgtattaaataaaccaattacttgtctaaaatatcaaggaagcaaaaaataagatatcaaagtgtgtaaaaaccagttgtttccttggctaagtgattttgaggagattgtcatcatcggagctggtgctgctgtcaaaagggaatcttataggcaaaggattggnnnnnnnnnnnnnnnnnnnnnnnnnncttatgtcaatataagataaaaagagtgccactagttaaggtcatgtgcatgagcatcgtaacagtgtctagctgcattacagtgtatggtcatgtatgcatgtgcactatttatggttgtcctccgtacaacccccagggagaaaaaactggaaaggaacgtgcgcataaatgttacaaacacattaaggcttatttcatagcgaggatgtatcaaccaaccgacaaagtgctatcgaagagtagactgagtgacgattaaatgagattaacgtataggggtaactccagtgtattaaaataatgacgtatagttttataaatcatatgtttggctgatgattggttatgaatgaattgtttgaggtaaaatgaccaagttaataatgatatccctcaataatcttcctcc

SEQ ID NO: 9341 - DNA, 894 bp, Diabrotica virgifera
ctttttggcaacatgtcgcaccgtgatccatctgctaaccaacttttagagtatgctagaaagcaagggagcaaaaccgaaaggttaacaacatccggaggtaatccagttgcggaaaaagacgcaagtttaacagttggttatcatggacctaccttattacaagattgggttttaattgacgaattatcccacttcagtcgggaacgaatacctgaacgtgtagtgcatgctaagggtgctggagcattcggatattttgaagttactcatgatattaccaagtatacagctgccaaagttttctctgaaattgggaagaaaaccccaatagctgtcaggttttctcaagttgctggagaaatgggatacgccgatactgttagagatttcagaggatttgcagtaaaattctatactgaggatggaatttgggatttggttggaaataattttcctgtatttttcgtgaaggatgctgcgttgtttccaagttttatccacgtactaaaaaggaatccagtaacccatattagaccagactacgacatgttttgggatttcatcacgcttcgtgaagagtccatgcacgctgttttaatgatgtttgctgatagaggaattcccgacggttatagacacatgcatggttatggtgcaaatacgtttgcctttgtgaatgctcacggaaaactggtttattgtaaatttcattatttaagcaatcaaggtatctcaaacttgatgtcagaccaagcagaaaaacttgcaggttctgatcccgaatatctcattagagacctatacaacgctatagacagtggccagtatccatcttggaatatgtatgtgcagattatgacaccagagcaagcagccaaaagttcttatgat

SEQ ID NO: 9342 - DNA, 870 bp, Diabrotica virgifera
  misc_feature (54)..(141): n is a, c, g, or t
  misc_feature (800)..(800): n is a, c, g, or t
  misc_feature (846)..(860): n is a, c, g, or t
aacgttccttatatcatttttagtatagtgtttattcagtttagttaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgaagatttagaacttacaccaccatgtcagagctttcggatgaaactttgccacctgcatcaccagctagcacacagagcgacagtgaaaactcagtgtcaagtgtagagattcctcacaaggaactacgtctgtccagccacataatcaaatcctcacaactatcaaccgatgtgcagtgccaatggaggtcttgcggaataatgttttcatctttggaccaactagcatctcacgtctcaaaagttcactctgccagtgggttgggaggattattctactgtggatgggaaggatgcgttagaaacaataaaggatttaatgcaagatataagatgctcgttcacgtccgcacccatacaaacgaaaagccccacaagtgtttccaatgtgacaaatccttctccagagcagaaaacctgaaaatccattcacggtcgcacagcggagaaaaaccatacgtatgtccagtaacaggatgtaacaaagcctactcgaattccagtgacagattcaagcacaccagaactcatcaggtggataagccgtatcagtgcaaaatccccggctgtccgaaacgatatacggatccaagtagtttaagaaagcacgttaaaacatataaacatttcgttaatgaaaaccaaaaaactganagtaaaaagactgtagaacaaatcgtaatgaaaataagagtagagnnnnnnnnnnnnnnnctagaaccaa

SEQ ID NO: 9343 - DNA, 1232 bp, Diabrotica virgifera
  misc_feature (236)..(257): n is a, c, g, or t
  misc_feature (1090)..(1107): n is a, c, g, or t
  misc_feature (1151)..(1173): n is a, c, g, or t
  misc_feature (1183)..(1196): n is a, c, g, or t
  misc_feature (1198)..(1222): n is a, c, g, or t
cagaaacagacttagtcgtccatagaacaggtaattaaaatgaagatgatcgcagttctattcttgtgcatagtagttgcaataaatgcagttagcgagtgtccagactttcctggtgtaggagttatgaaagctggagaacagaaaccagtccaaggaacctgcaacattgccacctgccatgaagatggatctatttccatgttaacgtatgttttgaaaaaattacttcgtgnnnnnnnnnnnnnnnnnnnnnncataagtttaaaatgctttgcagttaaaaaacaacaaatgttggttgttgccaatcagatgtaaatctttaactttttacaattcgcgtgtttttgtaatataataatagtacattgtttaccgggtaggaatgtggcttttcctacgaggtaaacatactatttttcccaaatcgtttaaaattcgacagatattgattgatttaaaaaaaacgcgataattttattcccaaataaatggtgctttgaaattcctaataaaattacttgggttactatggaaacgtattgaggttgaattgtcaaacttgacgcttataaatttaattgctggtgttctcgaaagtaaaatgataattgatgatgaaatttccattcctgggactcctccagagctggttgaggcagtgaatactgcttcattagaattattgccaaagaaatcaagagaaaagtacgaaaatgcatacagatgttttatggattatcgcatgagtaaaaatacgagttctttctcagaaaatgttgtaatggcatacttcctagacctttgtttaaagatgaaatcttcaacattatgggccaattattcaatgctgaagtcaacccttgtacttaaacacaatgtagatatatctacatactcaaacctccttctttatggaagggaaagctcaaggttatagggcaagaaattcgaaaattttaccgaaggagaaatttgaaaatttattccggaagctccaaataaagaaatttaatgattaggtaatttacaaggttttattaaaaatgggttttctattatttatgaaaaaaccaacaactgtacnnnnnnnnnnnnnnnnnntcccccttccccaaaaaattttttttcccggcccggaatgtttnnnnnnnnnnnnnnnnnnnnnnngcccccgggnnnnnnnnnnnnnncnnnnnnnnnnnnnnnnnnnnnnnnnccccccccgg

SEQ ID NO: 9344 - DNA, 880 bp, Diabrotica virgifera
  misc_feature (2)..(18): n is a, c, g, or t
  misc_feature (20)..(62): n is a, c, g, or t
  misc_feature (70)..(857): n is a, c, g, or t
  misc_feature (859)..(876): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnncttt

SEQ ID NO: 9345 - DNA, 1209 bp, Diabrotica virgifera
  misc_feature (571)..(571): n is a, c, g, or t
  misc_feature (578)..(578): n is a, c, g, or t
  misc_feature (660)..(681): n is a, c, g, or t
  misc_feature (709)..(809): n is a, c, g, or t
  misc_feature (814)..(868): n is a, c, g, or t
  misc_feature (1025)..(1069): n is a, c, g, or t
  misc_feature (1104)..(1121): n is a, c, g, or t
  misc_feature (1139)..(1207): n is a, c, g, or t
ctgacaatctattttatatttttcttgacattacttcagaactgtctatactgtcaatacataaattaataaccatagaacatccacttttaatgatgaatattcttaaccaaaaaaagttattaggcatatcgattataaaattgctgattacttttcgaaagtgactatcactcacaaaaaaacaatgaaaaatattgttttacttgactgtaacgggttagttttaatttaacatttttaggaccccggtaatgttcgattgaaaattcttttgaagaaaatcggtatcgccgcgctaaaaactcccataaggattgtattgccgtatgttcgtgtactgtaaagtcacggtgggacagacattagaatgaattatgtatgtgcttgcatataggtactacaatataacgaaaccaaataaaatattctaatttatatcgttttattccttgtaaaaagcacataaatcattttgattgctgagtattacctaaaagaatttatgcaacagtttaatgtttaaataccagttacataaataataagtatggatttagagctcttaatnaaagttnaaaaatgaatatcagattggagtaagttgtaaatattttgggtgtcataggcgtgaactatctatattattattctctttannnnnnnnnnnnnnnnnnnnnntagtctaagaatttgtacatttatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactnnnnnnnnnnnnnnnnnnnnnnnnnnnnnnnnnnnnnnnnnnnnnnnnnnnnnnnaaaagaacaaaatttacaaccccggcggggccaacaaaatctttttttatgggccccaaaattttattcggggggcggtttttaaaaaccggggggggaaaaaccggggggtcacccacctttactcctcctggcacccccccccccttttcccccnnnnnnnnnnnnnnnnnnnnnnnnnnnnnnnnnnnnnnnnnnnnntcccccaaggggccccccgccaaaaggggggaaannnnnnnnnnnnnnnnnngaacggccccataataannnnnnnnnnnnnnnnnnnnnnnnnnnnnnnnnnnnnnnnnnnnnnnnnnnnnnnnnnnnnnnnnnnnnga

SEQ ID NO: 9346 - DNA, 284 bp, Diabrotica virgifera
  misc_feature (2)..(16): n is a, c, g, or t
  misc_feature (18)..(41): n is a, c, g, or t
  misc_feature (198)..(271): n is a, c, g, or t
tnnnnnnnnnnnnnnncnnnnnnnnnnnnnnnnnnnnnnnnaccctacggataacagcggatttttatttggagaggtcaaatcgcataataagatggcggcccccagggtggggtaaaggtttaaattgggggggcagctatttttattataatcgggttcccctttttaaattttttctggattgcgggttaaacnnnnnnnnnnnnnnnnnnnnnnnnnnnnnnnnnnnnnnnnnnnnnnnnnnnnnnnnnnnnnnnnnnnnnnnnnngggggccccccga

SEQ ID NO: 9347 - DNA, 522 bp, Diabrotica virgifera
  misc_feature (5)..(197): n is a, c, g, or t
  misc_feature (199)..(255): n is a, c, g, or t
  misc_feature (393)..(414): n is a, c, g, or t
  misc_feature (459)..(509): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnagaataaattacctttagggataccggcgtattttttattgcaagagttcaaatcgataataaagatggcgaccctccatggttggattaaaagtttataattgggggagcaacttatttttattaaattcggttccnnnnnnnnnnnnnnnnnnnnnngattttggggttttaaaccccgggggggggccccaagggttgggnnnnnnnnnnnnnnnnnnnnnnnnnnnnnnnnnnnnnnnnnnnnnnnnnnncaaaagggggccc

SEQ ID NO: 9348 - DNA, 812 bp, Diabrotica virgifera
  misc_feature (9)..(26): n is a, c, g, or t
  misc_feature (34)..(54): n is a, c, g, or t
  misc_feature (84)..(151): n is a, c, g, or t
  misc_feature (153)..(165): n is a, c, g, or t
  misc_feature (216)..(235): n is a, c, g, or t
  misc_feature (246)..(277): n is a, c, g, or t
  misc_feature (280)..(308): n is a, c, g, or t
  misc_feature (316)..(356): n is a, c, g, or t
  misc_feature (364)..(377): n is a, c, g, or t
  misc_feature (379)..(409): n is a, c, g, or t
  misc_feature (447)..(465): n is a, c, g, or t
  misc_feature (493)..(544): n is a, c, g, or t
  misc_feature (554)..(593): n is a, c, g, or t
  misc_feature (657)..(684): n is a, c, g, or t
  misc_feature (697)..(758): n is a, c, g, or t
  misc_feature (775)..(794): n is a, c, g, or t
ctgggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnnnnnnnnnnnnnnnnnnatttaagtttaaatagnnnnnnnnnnnnnnnnnnnntaaatataagtttttttt

SEQ ID NO: 9349 - DNA, 836 bp, Diabrotica virgifera
  misc_feature (2)..(46): n is a, c, g, or t
  misc_feature (53)..(779): n is a, c, g, or t
  misc_feature (788)..(788): n is a, c, g, or t
  misc_feature (790)..(835): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaantnnnnnnnnnnnnnnnnnnnnnnnnnnnnnnnnnnnnnnnnnnnnnng

SEQ ID NO: 9350 - DNA, 290 bp, Diabrotica virgifera
  misc_feature (3)..(105): n is a, c, g, or t
  misc_feature (248)..(270): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaagaaaatttcataatttcttatcccaggaaacaaaaaactaacggggacgatgaagaaagggggcaagcaacaaccccggccccctccccaaagtcccatcaaggcccggaatcaaattctttggttaaaaacaaacnnnnnnnnnnnnnnnnnnnnnnnaacgaaacttttcaacgttt

SEQ ID NO: 9351 - DNA, 121 bp, Diabrotica virgifera
  misc_feature (28)..(55): n is a, c, g, or t
  misc_feature (75)..(88): n is a, c, g, or t
  misc_feature (91)..(108): n is a, c, g, or t
ccttaggggataacagcgtaaattttannnnnnnnnnnnnnnnnnnnnnnnnnnntgcgacctcgatgttggatnnnnnnnnnnnnnnggnnnnnnnnnnnnnnnnnntaagtctggtcga

SEQ ID NO: 9352 - DNA, 408 bp, Diabrotica virgifera
atccttgaagagcgtatccttggtgttgcacctttacttaaaactcgtcctgcgccccagaggtggttttttagcacaccaacaagggtgaaataaaagtttttcagtttcttagaagtatatgtttcaatttccttgtagtaccatatatatcgtagctaatcattttcgtccatatatgttcgtatttacgagaactactgaatttttgtctatataaactaatatattttattatcattatattaagatttaaacaataatctatttttagtatctacacatccaatccagatgatattcagattaaaatgttaacaataattatgaatgaacatatcattattagttaagatcttaagatttcaaaagatggcaataagtatttcaatatcatatgattttcac

SEQ ID NO: 9353 - DNA, 251 bp, Diabrotica virgifera
  misc_feature (2)..(3): n is a, c, g, or t
  misc_feature (5)..(83): n is a, c, g, or t
  misc_feature (192)..(209): n is a, c, g, or t
gnngnnnnnnnnnnnnnnnnnnnnnnnnnnnnnnnnnnnnnnnnnnnnnnnnnnnnnnnnnnnnnnnnnnnnnnnnnnnnnnnaaattacccttaggaataacaggcgttttttatttggaaaggttcaatcgataataaggatttcggacctcgaggttgggattaaggttttttaattggtggaacagcnnnnnnnnnnnnnnnnnngttcccccttttaaaaatttttcttggtctgtggggtttaaa

SEQ ID NO: 9354 - DNA, 240 bp, Diabrotica virgifera
  misc_feature (23)..(23): n is a, c, g, or t
  misc_feature (30)..(67): n is a, c, g, or t
  misc_feature (183)..(230): n is a, c, g, or t
tatagaataaattaccttagggnatacagnnnnnnnnnnnnnnnnnnnnnnnnnnnnnnnnnnnnnngcgcgacctcgatgttgggattaaagtttataatttggtgtagcagtttatttatattagttctgttcgactttaaaaattaacaatgaactagttttaaacggcgggggggcgcnnnnnnnnnnnnnnnnnnnnnnnnnnnnnnnnnnnnnnnnnnnnnnnnaagggggcgc

SEQ ID NO: 9355 - DNA, 112 bp, Diabrotica virgifera
  misc_feature (6)..(108): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtg

SEQ ID NO: 9356 - DNA, 846 bp, Diabrotica virgifera
  misc_feature (295)..(309): n is a, c, g, or t
  misc_feature (641)..(641): n is a, c, g, or t
  misc_feature (678)..(678): n is a, c, g, or t
ggtaaccaaggagaaccaggtcctcctggaaccggaggatcggctgccggtgttggtgagaagggagcaccaggaccgcctggtgaacccgggatcaatggagaagatggagaaaagggagaaagaggttttccaggacttcctggtccaccaggtctaatgggacctccaggcctacaaggatcagaaggtttacctggaaaacatggagagcaggggccaccaggtcaaagaggtgaacaaggtcctacaggaacaacaggacctgctggttctccaggtaaagacggcgttnnnnnnnnnnnnnnnttaataggagacaaaggggacaaaggagaaattggaacacaaggacccattggtccaagaggatatccaggcaatcctggagcagcaggatttccaggagtatctggacctataggcgcaccaggtttagttggacagacaggtccgccaggattaccaggaccgccagggccaccaggagaggcagtcgttggaaatattattgacactggtaaatcaccaggaattcacggtcctagaggctttcctggacctccaggaattcctggcgaaagaggtgcagctggggaaagaggaccagcaggtccgtcgggcgttcctggactgacggngaaagaaggtcccactggtttgccaggacctcccggncaaagcggtcagccaggtttgccaggaattcagggacaaccgggaagagttttacggaagctgaagtaagagatatatgtgcagcggttttaagaagatcacttgccgagttgaccgctacattagtaggtcctccgggtcaccaggtgaatcagacccggtagacca

SEQ ID NO: 9357 - DNA, 315 bp, Diabrotica virgifera
  misc_feature (2)..(178): n is a, c, g, or t
  misc_feature (183)..(248): n is a, c, g, or t
  misc_feature (250)..(286): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnncccttaggggaaaaacaacgcggaaattt

SEQ ID NO: 9358 - DNA, 914 bp, Diabrotica virgifera
  misc_feature (250)..(279): n is a, c, g, or t
  misc_feature (487)..(499): n is a, c, g, or t
  misc_feature (502)..(521): n is a, c, g, or t
  misc_feature (833)..(834): n is a, c, g, or t
  misc_feature (854)..(855): n is a, c, g, or t
  misc_feature (862)..(862): n is a, c, g, or t
gttaaaaaaaacgctccctgacgctcttgcttccggttgcaccaaatgcaacataaaacaaaaagacacggctgagaaggtaatgaaacatcttatgtcaaggaggccgaaagactgggacagacttaccaagaagtatgatccacaaggaaactttaaaaaacgttacgaggaacacttgcaaaaagaaaagaaagcggcttagaaaattatctttaaagaagatgaaaagtcaaacattttgttgtgnnnnnnnnnnnnnnnnnnnnnnnnnnnnnncttataggggagtgcaattagaacgaaaagatacaatgtttcggaaaaaatcaaacaaggttatatttttctaaaactttttttgttagtttataaatatgttaaagtaaaaacttctactcacaaattttgccgctaattgtttattaattgtttaaacaataacaattgctttgtataaataatgttaagaatatgggtgaattcnnnnnnnnnnnnngannnnnnnnnnnnnnnnnnnngttttgattatgctgaacccgaatctgacattacaatttgcaaattcaaaatggcggattttttcctaaaaatccttaaaaagtagttgtaaaatccgatttttttttataaaatgtgtttgtttgcatattatatgtggatatttttgagaggttgctgaacctgaataaaattttgataatttaaattataaaatggcagatccaaaatggcggatagcttaaaaaatagttgtaaaatcataatttctttacaagatgtatttatttctacatatatttatttttgagtgctttgataaacctaacttnnaatgtaacattataaactanntaaatgncggatccaaaatgcggcttttcataaaagaacataaaaaagacatttttcta

SEQ ID NO: 9359 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9360 - DNA, 234 bp, Diabrotica virgifera
  misc_feature (16)..(36): n is a, c, g, or t
  misc_feature (54)..(72): n is a, c, g, or t
  misc_feature (145)..(163): n is a, c, g, or t
  misc_feature (171)..(197): n is a, c, g, or t
  misc_feature (210)..(227): n is a, c, g, or t
attccattttttttgnnnnnnnnnnnnnnnnnnnnncttaagggataaccggcnnnnnnnnnnnnnnnnnnngttcaaatccaataaataagaatggcgaccccccatggttgggattaaagttttttaattggggggaaccaannnnnnnnnnnnnnnnnnnggttcccnnnnnnnnnnnnnnnnnnnnnnnnnnnttgggttttaaannnnnnnnnnnnnnnnnngcggggg

SEQ ID NO: 9361 - DNA, 957 bp, Diabrotica virgifera
  misc_feature (708)..(726): n is a, c, g, or t
  misc_feature (728)..(728): n is a, c, g, or t
cccacgcgtacgaatatatacacgttacccagtccagatagagatacagattgtagtccagtggcttcaacatctcatggccctgctggcaaatctttttcaaatgagttagcaaattttgctaaaagtctagtatctgtagaatcaaatacacaaacaaaatccgatgaatgtccttgttcttcaaaagggaaagtagataattcaacaaaaaagccaaattctcctcatcgtcttggacttagcgtttctctaagttctcctaaccttttaaataccgctgtatcctctttaatgttatctagcagtagcagtgaaagtgatttaagtgaacctgaagctttaatagaagaattggagcatagagaagtaatatctaatgacgaaaatgatgtggatattgaaacaatgtccggggagaatgatgttgaatatgcagaattctctatggcacaaagaatgttagaacatgataatagttctgctaatagtagttttgtaggtgctactgcactctctcctactgaaatgggtagttcatttgaagatagattaaaattacttaatttctttgaaaattctccaaggaacacagctcaagatcctgcaaataatttgttagatctaactgcttcaaatctagatttagctttgcttggatcactttcaacagataattcaattataagtgctggtaactttactgcnnnnnnnnnnnnnnnnnnnanacatagatttaggcaattggatatgtcaggagctgaacctagactaatccagtttggggtatggactgaaaacggtcctatatctcagatcacaaagaatcagttatggggtccattggaatcatttttacgctccataaaatgttatcctgagcatgaccaaactcgaaggaaaggatccacaatgaaggaaaaaaagaagcattctacttctcatcctaaatttcct

SEQ ID NO: 9362 - DNA, 71 bp, Diabrotica virgifera
  misc_feature (6)..(69): n is a, c, g, or t
aaagcnnnnnnnnnnnnnnnnnnnnnnnnnnnnnnnnnnnnnnnnnnnnnnnnnnnnnnnnnnnnnnnnag

SEQ ID NO: 9363 - DNA, 370 bp, Diabrotica virgifera
  misc_feature (10)..(118): n is a, c, g, or t
  misc_feature (247)..(265): n is a, c, g, or t
  misc_feature (282)..(355): n is a, c, g, or t
tttttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaataccttagggatacagcgtattttttattggaaagtcaatcgaatataagatgtgggacctcgagggtgggataaaggtttttaattgggggaaaaccttttttttttaaagtctgttcgcnnnnnnnnnnnnnnnnnnnggattgggagtttaaannnnnnnnnnnnnnnnnnnnnnnnnnnnnnnnnnnnnnnnnnnnnnnnnnnnnnnnnnnnnnnnnnnnnnnnnnccaaaaagggggcgc

SEQ ID NO: 9364 - DNA, 100 bp, Diabrotica virgifera
  misc_feature (2)..(53): n is a, c, g, or t
  misc_feature (57)..(75): n is a, c, g, or t
  misc_feature (78)..(99): n is a, c, g, or t
annnnnnnnnnnnnnnnnnnnnnnnnnnnnnnnnnnnnnnnnnnnnnnnnnnngggnnnnnnnnnnnnnnnnnnntcnnnnnnnnnnnnnnnnnnnnnnc

SEQ ID NO: 9365 - DNA, 982 bp, Diabrotica virgifera
  misc_feature (939)..(968): n is a, c, g, or t
gttgattcacaaaagaagaacaaattcacaaaatgtctttcaaagttttatcttttgctgcacttgttgccttcgcaaatgcaggattattaagcgaggctccagtttctggtcctgttatttccgcatactcatcctcacctgtattagctgctccaaatgtaattaattcagtagctccagtagtgtctgcttactcctcacctttagctttacctgctacagctccagtaattccttcgtactctgcgccagttttagccaatgcagtagctccagttgcatactctgcaccagttacgtattcctcgccagcgccagtcgtgtcagcttattctagtcctttagtagccaaaagcttgacacccgttagctacgcttcatctgctccagttgcatctccagtagcctactcagcaccagccccagtagtgtcagcgtactctagtccattagtagccaaaagcttgacacccgtgagctacgcctcgaatgctccagttgtatctccagttggctactcagcaccagtgccagtcgtctcagcttactctagtccattagtagccaaaagcttgacacccgtgagctacgcctcgaatgctccagttgtatccccagtagcctactcagcaccagccccagtcgtgtcagcgtactctagtccattagtagccaaaagcttgacacccgtgagctacgcctcgactgctccagttgtatcagcttactcggctccagtagtggcccaaggcgtctctcccttagcttatagtgcgcctgctccagttgtatctacctactcagccccctcttgtgaataaaagtgtagctgccgcaccagtttcatatgcccgaatattccttctccagtttctgcttgggtattcctggtgccccagttgttcagccatgggagttacttaataaaatcgactnnnnnnnnnnnnnnnnnnnnnnnnnnnnnncatatattttggat

SEQ ID NO: 9366 - DNA, 131 bp, Diabrotica virgifera
  misc_feature (6)..(27): n is a, c, g, or t
  misc_feature (37)..(129): n is a, c, g, or t
taatcnnnnnnnnnnnnnnnnnnnnnnggaatgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnac

SEQ ID NO: 9367 - DNA, 388 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (207)..(227): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnatcttaaaccggtgtgagcctggatggtttctatctttaatttattcacatattgctagcacgaaatgcctcacnnnnnnnnnnnnnnnnnnnnntctacataaatattcaaaattattattatgatgaaatttattcctatttaatagatcctattactaattattagcatccacggctgacctgaacaacttattatatccactatatgaaacttagttgatcgattttaatcttctcattgattactaatcat

SEQ ID NO: 9368 - DNA, 199 bp, Diabrotica virgifera
  misc_feature (10)..(27): n is a, c, g, or t
  misc_feature (33)..(58): n is a, c, g, or t
  misc_feature (161)..(181): n is a, c, g, or t
aattattgannnnnnnnnnnnnnnnnncaatcnnnnnnnnnnnnnnnnnnnnnnnnnngaaataggtaaataaccttttcatgctaaatatattaatttatcataacgataacggggtaatgtcccacgaactcacaaccacaaaaatctaattaatcctnnnnnnnnnnnnnnnnnnnnncttattaaattagccccc

SEQ ID NO: 9369 - DNA, 942 bp, Diabrotica virgifera
  misc_feature (627)..(627): n is a, c, g, or t
  misc_feature (648)..(648): n is a, c, g, or t
  misc_feature (683)..(683): n is a, c, g, or t
  misc_feature (779)..(779): n is a, c, g, or t
gttggtggttagtaccgtaaatggcggttaatttcttcgaaattaatttttatttcaactaagtttggaagtatagtaaaaagttaccaccacttgtttcctggagtaaggatgggagtaccatcagtggaagaggaataaaaaattaaccggtaaatcgttttttctactaatgttttttagttaacgttgaatatatgaaatagttggttcattgttaaatgttcttagccagtcccttaggtgaaggatgtagattatttcgatctttatattatctttatatcgatctttatattaatggggtttttggttttacataaccaaacatttttgaagtcctcaaattaatattggaaataattaccatttctctgtacgttttaaaccgattgaacatccaatatatctataaattttcatgtccaatatatctataaattgtcatgtaactatctttgtctggttcaataccatttcattaaggtatataaaatgtatgtagatggctattactatcttaatctcatgttatttcagataagtcatattttatattcctatttcaaatgcaatgccattatttgttcatgttttcaaactcaaaatagttcaaggttacctgangattagtttttgttccatttntaaatgggttgtttttttatgttattgcttctaanaagttttcctcgattatttcttcttctctttacttttgtttaccggtttatatgagaaatcaaacgaagtatatgtttttagccatttggaagaanactaaccctcatgtgatgtcgtacccacttgactacctaggggaagcacctttgacttattgcagctaccgccaagtcaaactgggaagtatggttttgggaacaagctttttgggggacatcccagctccttttcgtcctgcccactgggcctacggggggg

SEQ ID NO: 9370 - DNA, 382 bp, Diabrotica virgifera
  misc_feature (8)..(41): n is a, c, g, or t
  misc_feature (45)..(64): n is a, c, g, or t
  misc_feature (66)..(103): n is a, c, g, or t
  misc_feature (114)..(148): n is a, c, g, or t
  misc_feature (162)..(203): n is a, c, g, or t
  misc_feature (205)..(376): n is a, c, g, or t
acataatnnnnnnnnnnnnnnnnnnnnnnnnnnnnnnnnnngtgnnnnnnnnnnnnnnnnnnnncnnnnnnnnnnnnnnnnnnnnnnnnnnnnnnnnnnnnnngttaaaaaagnnnnnnnnnnnnnnnnnnnnnnnnnnnnnnnnnnncccctattaaaagnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccca

SEQ ID NO: 9371 - DNA, 565 bp, Diabrotica virgifera
  misc_feature (226)..(252): n is a, c, g, or t
  misc_feature (380)..(398): n is a, c, g, or t
  misc_feature (409)..(466): n is a, c, g, or t
  misc_feature (480)..(508): n is a, c, g, or t
  misc_feature (511)..(528): n is a, c, g, or t
  misc_feature (530)..(542): n is a, c, g, or t
cccccccgggccggatttatactttgatttggtcactttctctcccctgagtaatttttaatcgatactaaatcttaaaaatgataattttcaaatttcagatcgcatataactcgcctacaataaattttagagaagggttgcgggaggccttttttgctccgaatgacctaaatgatctaataaaaatttgttcgaaattaaaatattgattttgtgaatttgnnnnnnnnnnnnnnnnnnnnnnnnnnncgaccgcggtacctccaggcaccttgtggatttgttataaggacttatttttcagtgggtttgtgcaaaaaggtcgagtcggagcaatttgcctaacaggggtgacgatacaacctggactataattnnnnnnnnnnnnnnnnnnnggatacctacnnnnnnnnnnnnnnnnnnnnnnnnnnnnnnnnnnnnnnnnnnnnnnnnnnnnnnnnnngggcttaggccacnnnnnnnnnnnnnnnnnnnnnnnnnnnnnccnnnnnnnnnnnnnnnnnncnnnnnnnnnnnnncccggggaaggaaggccccaccc

SEQ ID NO: 9372 - DNA, 477 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcttt

SEQ ID NO: 9373 - DNA, 156 bp, Diabrotica virgifera
  misc_feature (4)..(62): n is a, c, g, or t
  misc_feature (75)..(76): n is a, c, g, or t
  misc_feature (79)..(146): n is a, c, g, or t
gacnnnnnnnnnnnnnnnnnnnnnnnnnnnnnnnnnnnnnnnnnnnnnnnnnnnnnnnnnnnataattattttanntgnnnnnnnnnnnnnnnnnnnnnnnnnnnnnnnnnnnnnnnnnnnnnnnnnnnnnnnnnnnnnnnnnnnncaattttttt

SEQ ID NO: 9374 - DNA, 1057 bp, Diabrotica virgifera
  misc_feature (2)..(44): n is a, c, g, or t
  misc_feature (52)..(785): n is a, c, g, or t
  misc_feature (790)..(790): n is a, c, g, or t
  misc_feature (792)..(831): n is a, c, g, or t
  misc_feature (833)..(874): n is a, c, g, or t
  misc_feature (878)..(878): n is a, c, g, or t
  misc_feature (898)..(922): n is a, c, g, or t
  misc_feature (939)..(958): n is a, c, g, or t
  misc_feature (976)..(999): n is a, c, g, or t
  misc_feature (1010)..(1048): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagntnnnnnnnnnnnnnnnnnnnnnnnnnnnnnnnnnnnnnnnngnnnnnnnnnnnnnnnnnnnnnnnnnnnnnnnnnnnnnnnnnnattnataaatttttggacccccannnnnnnnnnnnnnnnnnnnnnnnnaccttaggggtaaagcnnnnnnnnnnnnnnnnnnnnagtcaacgcaaaatagannnnnnnnnnnnnnnnnnnnnnnnagagagttaannnnnnnnnnnnnnnnnnnnnnnnnnnnnnnnnnnnnnntcgcccccc

SEQ ID NO: 9375 - DNA, 594 bp, Diabrotica virgifera
cccacgcgaacgctttgatgatggcgtacgagaccgctcgcctcatgaaaaagatatatccaacaagatggcatgaagaccaaccaaagtgaggcatacggatctgaaaaatctttcactggttcccaaacatgacaactacattgtttctgtgaaccaccaatactctacaatcttactaacgtctcgctcaggttgctgtgaagccccaaactaaaagcatgtcatctcctagtcacccgtatcttgaccagttttgaccaacaaagacacctctctaaactagaggatgcgccacaaaggaccgcggaacgagacgacaaatcccctgtgataggtactgtacaccgtcttgacaggaccgcgctgcaagagtgcacgagcggtgaacaccagcagctatccttttttgacgtcgggaaactcgtccttgccgagtcagatgacagaaatagaagaactttctagactcgcacgaccttaagctgaatcgagcgatctgaatcacgattctgatcatgccacgaactgctgacacagaattgtaacaagatgtggaaagaagcgatgagactgctggaaatgccactgcac

SEQ ID NO: 9376 - DNA, 871 bp, Diabrotica virgifera
  misc_feature (2)..(755): n is a, c, g, or t
  misc_feature (757)..(842): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnngtgattaacaataaaatttaacttttttt

SEQ ID NO: 9377 - DNA, 82 bp, Diabrotica virgifera
cattaaaaccatttttaatgttcctattttcttttcatgctatattattattgttttgaataataaataaacacccgttagc

SEQ ID NO: 9378 - DNA, 103 bp, Diabrotica virgifera
  misc_feature (2)..(92): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaaggg

SEQ ID NO: 9379 - DNA, 970 bp, Diabrotica virgifera
  misc_feature (19)..(38): n is a, c, g, or t
  misc_feature (69)..(103): n is a, c, g, or t
  misc_feature (234)..(258): n is a, c, g, or t
  misc_feature (335)..(363): n is a, c, g, or t
  misc_feature (885)..(885): n is a, c, g, or t
  misc_feature (899)..(899): n is a, c, g, or t
  misc_feature (946)..(946): n is a, c, g, or t
agatatttgtagaggcacnnnnnnnnnnnnnnnnnnnnggcaattgaaactgaaacacaggacaaaccnnnnnnnnnnnnnnnnnnnnnnnnnnnnnnnnnnnggaaagatattgtcagttttgaagatgaggtaataaacaaagatagagctacagaagtgttaacaaaaattaaatcagaggaaagtattgttgaaaatgaagatatattccaagacaaaactataaaaggnnnnnnnnnnnnnnnnnnnnnnnnngttcagatagaagatcatagtatacacgatgattccgaacagttgaatgttgtatcagaaggttctgacaaaatatnnnnnnnnnnnnnnnnnnnnnnnnnnnnngttcaggtagaaggtgacagtgtacaagatgattctgaacagttgaatactccgtcaaaagcttctaaaaagaaaacgaaagcagttaatactgaaataagcgatgttaatcaagatacagacaaaatatccatgaagaaaaacaaagacaattccaatgaggtgaaagaagaagatactaccaatacattagaaaatcctacagaaaataatacagaatctaaaagagctaagaggcgaaaaaaacatctggagttacaagttgctaaaaaattgaaagccacactagtcacacaagaaaattgtcttaattatctgtcaaaatggaagcatagcagaagtgagtggaaatttgagaaattgaaacagatatggctctcaaacaatctgtttgattctgcaaaggttcctgaagagttttgggcaacaacattagaatactttacacaatctaggggattcgttagaaaggtaatattaagagatgctctaaagttaattgaaaaatgataagcagatgangacaatccagacgnagaatatcaaagcaaagtaaagagagcacgtgatatttgtacagaangttacagaataaatattttagatc

SEQ ID NO: 9380 - DNA, 647 bp, Diabrotica virgifera
  misc_feature (629)..(646): n is a, c, g, or t
cggtcaaggtgaacttatgggacatgtttggtcgggtacagcttcagataaaactcctgccttccaggttcaagccctactgcatgaccatttagaatacatacgactaggatctgggtatattgctgcgattaactttaaagggtctacatcttttgacttatccggcaaaatagaaatatctctttggaatagaaatgcggaatcattggtacagaaatcagcaggagttattatactgggtacaagcactattgataccgtatttgtgaaatctaaagctgaatttacagcttcgattgagtacaggttggatctgcagaccgatattgatttctcctcaggtgctcaattgtgtatgagacttacacaaccagacaccttatttaggcacaatattcataaagtggaaaggattccaggaagtaaacacaagatgaggatatctagataccaaaaatatattattccaggtacaacatatgcactaaacaacaaaaatactgaaatgtgtaacgcaatatttagctgacaagactaattttgaatgctttcgtgaatgaaccaattataagagctgtggtgtaaaaagactttagtttttaaaattcaatcaaagatgaccatgnnnnnnnnnnnnnnnnnnc

SEQ ID NO: 9381 - DNA, 1129 bp, Diabrotica virgifera
  misc_feature (2)..(44): n is a, c, g, or t
  misc_feature (52)..(730): n is a, c, g, or t
  misc_feature (733)..(750): n is a, c, g, or t
  misc_feature (759)..(803): n is a, c, g, or t
  misc_feature (814)..(834): n is a, c, g, or t
  misc_feature (844)..(904): n is a, c, g, or t
  misc_feature (909)..(938): n is a, c, g, or t
  misc_feature (955)..(977): n is a, c, g, or t
  misc_feature (982)..(1026): n is a, c, g, or t
  misc_feature (1031)..(1079): n is a, c, g, or t
  misc_feature (1087)..(1109): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnncgagagacnnnnnnnnnnnnnnnnnnnnnnnnnnnnnnnnnnnnnnnnnnnnnaaaaatcatcnnnnnnnnnnnnnnnnnnnnngggggggggnnnnnnnnnnnnnnnnnnnnnnnnnnnnnnnnnnnnnnnnnnnnnnnnnnnnnnnnnnnnnccacnnnnnnnnnnnnnnnnnnnnnnnnnnnnnncctaggggtaacagcgnnnnnnnnnnnnnnnnnnnnnnnccaannnnnnnnnnnnnnnnnnnnnnnnnnnnnnnnnnnnnnnnnnnnnaaagnnnnnnnnnnnnnnnnnnnnnnnnnnnnnnnnnnnnnnnnnnnnnnnnnggggggcnnnnnnnnnnnnnnnnnnnnnnnggtggggggggtgaaaacaa

SEQ ID NO: 9382 - DNA, 407 bp, Diabrotica virgifera
  misc_feature (16)..(33): n is a, c, g, or t
  misc_feature (75)..(222): n is a, c, g, or t
atctttgcgactgagnnnnnnnnnnnnnnnnnngatagaaaccaacctggctcacaccggtttaaactcagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaatttaccttagggataacagcggacttttattggagagctcgtagtctataataaagattgcgacctcgtatgatacgattaaagtttagaaatgggggaacaagtgatagtatgaaagcacctcgtctattaaactgtaaagtgtatcagatgaaatagtcagtctgggttgaaaattg

SEQ ID NO: 9383 - DNA, 691 bp, Diabrotica virgifera
  misc_feature (141)..(160): n is a, c, g, or t
  misc_feature (271)..(290): n is a, c, g, or t
  misc_feature (389)..(410): n is a, c, g, or t
  misc_feature (475)..(495): n is a, c, g, or t
gaaatagacagcatatgtcgtgagaatcacatcagcgaaaaccaaatttaggattcaatgactattagaaggactataatataaatttcttgtttttgtcattaggattgctacttacaaacatcacaaaaaagtctacgnnnnnnnnnnnnnnnnnnnngtaagttcttgtagatatttgtgatgataatcatttttggaaataaacttaagaaacatattttttacaaatttagcaatctaatttattgaatgtaattaaagcttcagnnnnnnnnnnnnnnnnnnnnaatagtgtatctcgaggcttgatttattcctatgtcgccgcgtctatggtcaggacccaaacaattataagagttaatttgaattcattttgacagttnnnnnnnnnnnnnnnnnnnnnntcgtcaaatgtagatttaattttcaaacgactgatctgtttaccttctttaaaaaatgtatacgnnnnnnnnnnnnnnnnnnnnngaaaatataattggaaataaatggaataacaattgtcgaaaaaatgtaaatatacgaaataaattgtctgaaccatttcaaatgcctgttgtaaaaatcgtcatatgtaatgtacagtttataaaattagaataagaaatgttaatttttaaaaaatgcagttgttaaaaccttaaaatgaactaaatgtaataaa

SEQ ID NO: 9384 - DNA, 921 bp, Diabrotica virgifera
  misc_feature (611)..(632): n is a, c, g, or t
  misc_feature (734)..(734): n is a, c, g, or t
gataaatcggtagaacatggcgctacaagcacgaaaacaaagatttaggaccgaaatatccaagatctttcacataagtaatttccataagtcattgactacaataaattaatataaatgctctaatatgctcaaagaatgttgttttcagcagaagtcttaaaaattctttgtgtttactgcattactgatcaacatagcaggtattatataacaaaatattgtatataacaaaaataatagagtagattagaccataagactcttaatttcagggtcgtaaattcaaccccacgttgggcgccaatgtgtaacattgtgtataggaaggtatggaaaatcaaatacaattttcttcctcttgtctacctgtaacatgtataaaaagtatgcaaaggatttttttattttgctaactatttgtgtcacatatttctggttatgaataacaacatcaagagttaatgaaaaactgtttaaaaaatagagatttcactgatggtgacaaataccgaaaagttttcttaacctttagtcaacaatttgagaaatttttttactaatcacgcatacacggctgccacataaaaatgtacagatctcatagtagnnnnnnnnnnnnnnnnnnnnnnccttcgcagatctgtccccaatattatgataagtttcgagatttaatgactaaatcaaatacttctgtatttattcgatgaataatatattttacttattanagttttattttgttaagagatgttttacaaatttcttgttgtagtgatatctgagttagtacaatttgaatattttattttatagttctggggacctgatattattcggagcattgtcttaagaaaacctaaaatatacataatatatacctacaccgcaatcccacggtatcaaaacagataagga

SEQ ID NO: 9385 - DNA, 754 bp, Diabrotica virgifera
  misc_feature (722)..(746): n is a, c, g, or t
cccacgcgtccgttctagatcataatcattcttttaatgaacagtttcaaattctgcatattcagaataaaggccttaagctatctttattagaatgtatggaaattaataaattgaaaaatacagatataattctgaatgaccaactcgagacaaacagctacccactcctcaacctcttcagttaaagactttaaaaaaggcaaacccgtagtaatctggatcacttgggaaggtaactctgccgaggcagctgtagtcacatagttgtagtgagttttgtggaagtgtggagaacaggagttttcggtgtcattttattgttgaagaattaatataggtagtggctccattgttgtacattggttgttatattgttgcaaattggtgtcccacgttgggcgccgatgttgatgatgttctaccaatttcaatatatcttctgtcatccatttacttttcttgattaagttacttctatattcattatttgtgcagatttcctaaacctggtttttacataattcgatagttcctctggatcttttagttgttctttattcttgggacttttgtttgtttaagtccttcgattgcatattctatctctcttcgtagaccacatagattttggtggatttttgccaaccctggtatcttaaaaagttactagctctgaaataaccagcacccacaaacttgtagtaaaaccgattggaagnnnnnnnnnnnnnnnnnnnnnnnnnaatacatg

SEQ ID NO: 9386 - DNA, 856 bp, Diabrotica virgifera
  misc_feature (823)..(823): n is a, c, g, or t
agcgccataggagagacagatattgcatttaataaatcccgatttaggttagattattctgtcagattagcaaacgttagcggtttgcaagcattttatgaactttgcctgtcacgacatgtaggtaggccagtgatcagtttacaaatctctaccgaggaattcttccacttacgtagttaaacggctctatagggtgatgaagatgtatacctccttctcaaatgcctcaaaaaatatgggcatgcgagtaaatgaggagaaaactaagatatggtatcaacacctaacaatagagccagaaacatcggtcaccaattcatggttgataactctacttttgaagtggtggacaaattcacatattttatactccagggtaataagctagaaatagaccatgttcgggacactcaagtatccaggtggctgactacttttttagttgttgtggacctgtaggaaggggacctacctgtttcctgcctaaagttcgtgtccgttttttgtttattgacagtttagtgcgggaatcgcgattttttcgattttttgcgctttattcaagagttaggtagttgacatggaattacaaaattcagttttttggaacatttaaaaaccttcaaaatgccgatttttgaaggttgaaaggttaatttgttgcagtttgcgtggcggcggattgactttttaactttcaaagatcggcaatttgaagatttttcaatgttctagagggctgaattttgtaattatatgtcaactatttggcttttgaatgaagtgcagggagtcgaaagagtcgcgatttttgcactanattggtaatgattaggaaacggacgcgactcta

SEQ ID NO: 9387 - DNA, 214 bp, Diabrotica virgifera
  misc_feature (2)..(38): n is a, c, g, or t
  misc_feature (44)..(66): n is a, c, g, or t
  misc_feature (68)..(126): n is a, c, g, or t
  misc_feature (142)..(160): n is a, c, g, or t
  misc_feature (179)..(205): n is a, c, g, or t
tnnnnnnnnnnnnnnnnnnnnnnnnnnnnnnnnnnnnnatttgnnnnnnnnnnnnnnnnnnnnnnnannnnnnnnnnnnnnnnnnnnnnnnnnnnnnnnnnnnnnnnnnnnnnnnnnnnnnnnnnnaatttgttattgaatnnnnnnnnnnnnnnnnnnncgataacataagacggtcnnnnnnnnnnnnnnnnnnnnnnnnnnnattgacgtt

SEQ ID NO: 9388 - DNA, 796 bp, Diabrotica virgifera
  misc_feature (8)..(28): n is a, c, g, or t
  misc_feature (58)..(125): n is a, c, g, or t
  misc_feature (127)..(139): n is a, c, g, or t
  misc_feature (190)..(209): n is a, c, g, or t
  misc_feature (220)..(251): n is a, c, g, or t
  misc_feature (254)..(282): n is a, c, g, or t
  misc_feature (290)..(330): n is a, c, g, or t
  misc_feature (338)..(351): n is a, c, g, or t
  misc_feature (353)..(383): n is a, c, g, or t
  misc_feature (421)..(439): n is a, c, g, or t
  misc_feature (467)..(518): n is a, c, g, or t
  misc_feature (528)..(567): n is a, c, g, or t
  misc_feature (600)..(600): n is a, c, g, or t
  misc_feature (632)..(659): n is a, c, g, or t
  misc_feature (672)..(714): n is a, c, g, or t
  misc_feature (773)..(794): n is a, c, g, or t
cgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggtntgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnntaattcttttttattataagaattaagttaaatagaatattatatatttatgataaatnnnnnnnnnnnnnnnnnnnnnntc

SEQ ID NO: 9389 - DNA, 756 bp, Diabrotica virgifera
  misc_feature (2)..(44): n is a, c, g, or t
  misc_feature (52)..(733): n is a, c, g, or t
  misc_feature (736)..(753): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnncga

SEQ ID NO: 9390 - DNA, 303 bp, Diabrotica virgifera
  misc_feature (12)..(119): n is a, c, g, or t
  misc_feature (237)..(256): n is a, c, g, or t
  misc_feature (266)..(287): n is a, c, g, or t
tttagtattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagaaataaaataccttagggaatacagcgtattttttattggagaagttcaaatcgataataagattggggaacctccaggttgggataaaagggttttaaattggtggaggagnnnnnnnnnnnnnnnnnnnngggttccgannnnnnnnnnnnnnnnnnnnnnttggtggattataacc

SEQ ID NO: 9391 - DNA, 711 bp, Diabrotica virgifera
  misc_feature (667)..(667): n is a, c, g, or t
actaatactgtctacactacaatgactttcaaagtaattatctttgcatcatttttggctttcgccaaagctggtagctatgacagtacattagcccttcctgccactccagtaatatcagcttaccagtcagctccagtattggctgctcctgctgtttccaaatcgtttgttcaaacctacaccagccacccagcgcctgtagccgttgctgctccagttgtaaccaaatcggtagctccagtagtatccacgtactctgctccattggctctaccagctcatggacctgttgtatcagcatattcagctccattgtctctaccagcccatggccctgttgtatcagcgtactcagccccattagtagctaaaagccctctttcatatgctgcacattcaccagttgtctctgcttattcttccccacttctctccgcctattcggcaccagttgtagccaagagtgtatctcctctagcttatgctgcaccttctccagttttatctgcctattcttctccagttgtatctgcttactcttcaccactcttagctaagagtttggcaccagcaccagttgcttatgcgggacacgctgctccagttctctctgcttactctgctggaccagttgttcaaccttggtaataaaaaatgtgatacnatcttttaagttatttatttatgaataagaaacctgagtacggt

SEQ ID NO: 9392 - DNA, 856 bp, Diabrotica virgifera
  misc_feature (51)..(68): n is a, c, g, or t
  misc_feature (706)..(706): n is a, c, g, or t
  misc_feature (742)..(742): n is a, c, g, or t
  misc_feature (822)..(822): n is a, c, g, or t
  misc_feature (833)..(834): n is a, c, g, or t
ataaataataatgaattaaatctaagaactaaatttaccaattagtcgagnnnnnnnnnnnnnnnnnntctttcaagcaagatttaaagcaggttcttaaaccgtattacatatttaacatattattaagtctgtcctatgtagctttgaaaagaacaccaggtgtatgcaattatttatttcccactagtggttgtgaatttgaggggagagaaacagaaattttgttctttcttattatagttatagcaataaggactagaaaagcaggaagtgtttctatgattaattatttgtcttctagtttcatttataccaaagtggcgaatttgattttatggttcagtgcggatctttttatgggaattgtctttggaatagtattcattttaggagcattgctatttcctgagcctacctactcaggccctgacaaggtgacatacttcagaggagttcaaggactggatgaagaattacagagagacaaaaaggttacatggattgttaccttctacgcagtttggaatccagcttgtgtgaactttgcaccagtgatttctaaacttagtactatatatgacatagaaaatctgaaatttggtaaagtagatatagggaggtacccggatgctgggcagaagtaccacgtaagcgatagtagcatgagcaaacagttacctaccgtaattttattccaagatgngaaagaagtgatcagaagaccaatggctgatactanaggaaaactgatcaaattctcttttactgaagaaacattatcaatgtttttggtctcaaagggttatacgagaactgtanagaggaattannaggttaacctaaaaagcacatt

SEQ ID NO: 9393 - DNA, 53 bp, Diabrotica virgifera
  misc_feature (5)..(45): n is a, c, g, or t
aagannnnnnnnnnnnnnnnnnnnnnnnnnnnnnnnnnnnnnnnncgagagac

SEQ ID NO: 9394 - DNA, 101 bp, Diabrotica virgifera
  misc_feature (9)..(71): n is a, c, g, or t
ggggtgatnnnnnnnnnnnnnnnnnnnnnnnnnnnnnnnnnnnnnnnnnnnnnnnnnnnnnnnnnnnnnnntttttttgatttataagaataatttacctt

SEQ ID NO: 9395 - DNA, 946 bp, Diabrotica virgifera
  misc_feature (22)..(43): n is a, c, g, or t
  misc_feature (639)..(658): n is a, c, g, or t
  misc_feature (804)..(804): n is a, c, g, or t
  misc_feature (854)..(854): n is a, c, g, or t
tacattgattcttgattggacnnnnnnnnnnnnnnnnnnnnnnctcttgaagtagacgatgaaccgatgccgggaccttcaagttccacgaaagaagaacaacagcctgttaaaaaacactgcaatttaccttggatcgaaaaatatagaccacaaacatttcaagaaatagtaggaaatgaagataccattacccgactttcagtattctccaagcaaggaaatttaccaaatataattattgcaggtccacctggagtgggaaaaactaccacaattttatgcttggcaagaattctattaggacctgcatttaaagatgctgtattggaacttaatgcatctaatgatagaggaattgatatagtgagagataaagttaaaagatttgcacaacaaaaagtaacattgcctcctggccggcacaaaatcataatactagatgaagttgacagtatgacagatggcgcacaacaagctctgaggagaaccatggaattgtacaccaacacaacaagatttgctcttgcttgtaattatagtgagaaagtgatagaagctatacagtctcgttgtgccatccttaggtattctaggctttctgatgcacaagttttggcaagaactttacagatatgnnnnnnnnnnnnnnnnnnnnatactgaagatggtcttgaagctatagttttcacagctcaaggtgacatgagacaggccttgaacaatctgcaatccactcacaatggttttggtgaagtaaattctcaatcagtgtttaaagtatgtgatgagccgcaccctatngtgataaaagacatgttgaaaaatttgtacacaggtgacatcagaaaggnctataaagtaatagagcacttatggaatttgggatatgctgcagaggatataaataagaatatctttcaggtctgcaaaaatatggatatgg

SEQ ID NO: 9396 - DNA, 1028 bp, Diabrotica virgifera
  misc_feature (255)..(276): n is a, c, g, or t
  misc_feature (779)..(779): n is a, c, g, or t
  misc_feature (954)..(1000): n is a, c, g, or t
acacttttaaataaacatgggctttaaaaaagtcaaatgtttgcaaatcaatgaacattgattagtttgagatcagtttgattaaattttaagaataaaaattagattttttacggatatttaaccaaaaatgaagatttctttataaatgggattattcgacaattaagtttgatactacagtaaaacctacgctaacctaaataattgtggggaggggggcgtttctgataacaagaatttcggataaaaatnnnnnnnnnnnnnnnnnnnnnntatcaaattacatagtattcttggtcaaagttagtattaaaaaggactatgaggtgattgcgttctttagttgtatgagagcaatgttgacgatgttgaaaaattaacattgaattctttcgataacgttttgagataaaaatttactttttattgacaaaattattgaaactgtcagccgtttcgtttaaaaacgatgtttcgattaaaaaggtttcggttaacggaggttttattgtaatatgtttaatttaatcatatttctgtatggaccaatatgtatttattagttgtaatttaaacatgggtataccttttttattgtaaacaggttgtgacataatttgctgatacaattttcagatgcaaaaaagaaaaaagacattactataacatttgtttgtgagcaaattatttgaacaattgttattttgcacatttgtatcgaatcatctaagaaataacttctaatcgtatctgcatacttaattaacatggatganatgaataagtggaacatttttatcgataattggtatacgtttttttgtggttgtcgaattttccgatttatagaaaatattgtcatttccctgtttttatggccatcatatctcacttaatacgtactatttctataagaaacggtttccccggcggacatctccttttgaaggnnnnnnnnnnnnnnnnnnnnnnnnnnnnnnnnnnnnnnnnnnnnnnnttttttggggtctttccccctcaaaagg

SEQ ID NO: 9397 - DNA, 836 bp, Diabrotica virgifera
  misc_feature (2)..(44): n is a, c, g, or t
  misc_feature (52)..(169): n is a, c, g, or t
  misc_feature (173)..(786): n is a, c, g, or t
  misc_feature (792)..(835): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagnnnnnnnnnnnnnnnnnnnnnnnnnnnnnnnnnnnnnnnnnnnng

SEQ ID NO: 9398 - DNA, 956 bp, Diabrotica virgifera
  misc_feature (49)..(74): n is a, c, g, or t
  misc_feature (242)..(263): n is a, c, g, or t
  misc_feature (474)..(492): n is a, c, g, or t
  misc_feature (554)..(572): n is a, c, g, or t
  misc_feature (813)..(831): n is a, c, g, or t
  misc_feature (858)..(858): n is a, c, g, or t
  misc_feature (886)..(915): n is a, c, g, or t
gaacattggttatctaatttttagttcgcttaaaaataggtttaacatnnnnnnnnnnnnnnnnnnnnnnnnnncaaatatattgccatggagcatttattaagaggtcaatttggtcgaatcataataagtacatattcccatacacctttaaagtatggtcctcaaaaatcttgtcaaagaggaatgtgtatattgtggagtggaagaactcttgatagatctagacctttactaaaacnnnnnnnnnnnnnnnnnnnnnnagaatatggtatgcttatagcacgagcccttagaggagtattaaaaataagatatttgttgcttggtggagctgtagcaggtggaggagcattgcaaaagaagtataatgattggaaagatggattgccagatatgaaatggctagatgaagttctgcccgacaatgaaaaatttcaacagtggagagccaatttagttgattttaaagannnnnnnnnnnnnnnnnnngaacttgatcctagaataaaatcacttactgaaaataaatacaatgagtttaagtcatggtnnnnnnnnnnnnnnnnnnntgccattgctgcagcagaagcgcaagaatctgcacaacctaataaagaaggtgctgttgccaagcttttatacagactgtactcagaaggcaaaaaggaaatcattcaaaaaactatggtttatgcagctaatccattttctgctgatgagaaagctagaaaagagactcaagagaggttaaataatatacaagatgaaatgatgcaaactcaaattaagtaccaaagagaattagaaagnnnnnnnnnnnnnnnnnnngaattgagaaaacaaacttattattgnaaacaggaaagaagccacttactagaannnnnnnnnnnnnnnnnnnnnnnnnnnnnngtgaagtactagacgaacttgctgattttgacagtggatac

SEQ ID NO: 9399 - DNA, 843 bp, Diabrotica virgifera
  misc_feature (254)..(274): n is a, c, g, or t
  misc_feature (749)..(749): n is a, c, g, or t
tacaatgatgaattaaacaaaatggattaataaaagttataaaaatgaagctaagataaataccgaaacgatgacctaaattaactcgaacaaatggaataaagcgaataaacaaataaaatatttgggaaacaagcaagtaatattacaaaataaatatcaaaccaataataatatataaaaccctaattttctaggcctgattaccttgtgcacacaagtaacttaccatagctacaatagtttgggaaccnnnnnnnnnnnnnnnnnnnnntcatataaaaaaaccaaaggtaaactaaatctgaaaaaattaataacatagtgcatttaaccaaatgtctgaaatgtaaaaccaatagttactaaatgcacaacactaaatattcccaaacaaacccattcatcgaacgacttccagataaggttcgatgctgcaatccgtagaatgagcacacggagagtgctaacctgtcctatccgtaggtgcaggtggaaagatgacagaaaatgggactggaacgtcccaaagtgtgtttcccaaattgacatattcccagtgatgacttgactgtggctgtaatggtttccctaggtggtcaaaggggctacgattcacattctggtttctcccaaatggctaaaacattcccagttttatttcccatataaacatgagcaaaaagtaaagagaagaaataaattaggaaactttttagaagcattaacatagaaaaaccgatcattanaatggaacaaaaactaatctcaggtaccttgaactatttttgagtgtgaagacatgaacaaatatgacattgaatgtgaaatttgatatgtaat

SEQ ID NO: 9400 - DNA, 283 bp, Diabrotica virgifera
  misc_feature (55)..(76): n is a, c, g, or t
  misc_feature (140)..(162): n is a, c, g, or t
atcaatagttacatacatatattgtaaattattcaataattattgtagcaaaatnnnnnnnnnnnnnnnnnnnnnngaatatttattgatatatcattagtaaaagtgccaaataattaagaaatgtatgtctggtagcnnnnnnnnnnnnnnnnnnnnnnncgaaactcttttataacaggtaataatttcattaaaatcacttccaagggccatatcaaatcacagaacgtttcagatataaaaatatcatcatcagtgccagtagaagttaatctcatgc

SEQ ID NO: 9401 - DNA, 461 bp, Diabrotica virgifera
  misc_feature (2)..(45): n is a, c, g, or t
gnnnnnnnnnnnnnnnnnnnnnnnnnnnnnnnnnnnnnnnnnnnngccccgagcgtagacgaaaataaatataaaagcaatattatgtctcttctattaccaacacacctacaaatgaaaattttgtataagatacaaatatgatatgttcagcatttgcgtatagagatagcacgaggcgtttttggagcctaattacactatcggaactaaaatagacatttcggatatcctacctgatagtattcatgtggattttcacacatcattattaatactaattatggagtagacaccaatgaaattgacatccactatcaaattgtagtcatgatgatgatcctaagttctcaaatgtgggctatgacaagaagtgatagagggtaaaataaggcacttgcctgaactattttctaccagctgaatacaacaatgacttacagtattcaatgtaaactggc

SEQ ID NO: 9402 - DNA, 920 bp, Diabrotica virgifera
  misc_feature (735)..(735): n is a, c, g, or t
  misc_feature (776)..(776): n is a, c, g, or t
  misc_feature (823)..(823): n is a, c, g, or t
tttgttatgatgtttttacaatctgataatacaaattaattaaaagtgtttttgtaactttttggaaactatgacgacttcggagcaaatcggtctaaataaaacatgggaactctctttgtacgagttacatcgaactccccaagaagcgatcaccgacaacaccgaaatagctgtgagtccaagaagcctccacagtgaattgatgtgcccgatttgtttggacatgttaaaaaagactatgactacaaaagaatgccttcataggttctgttcagactgcattattacagcattgaggtccggtaataaagaatgtcctacttgcagaaagaaactagtttcaaaaaggtccctgagaccagatcctaactttgatttgctaatatcgaaaatatatccaagcagagatgaatatgaggctcaccaagaaagggttttggctaagttgaacaaaagccattcacgagaagctttaatgcagtcaattaaagaaggaattaaaattcaatcccaaaacagacctaacagaggaagaaagactaacgaacccgtggttggtcaagagaataactccgaagaaaataatccaaatgctccaaacgctgcagatactgctgtacctgcaattactcagcctgtagcagccactcctcctgttcaaccacctcttcaaactaatgtgacaacagctccacctactgcaaatacaaatgctcccagcccatcaccatncaggcagaagtaccccttcacaaccacctagtcctgtctcnatctagtgttagttcaattaagtaagtctttgggggaagcggccaanaagtgtcttaacatctgaaagaagcgaagaaagtgaatctagtgagagacagacaacgatacggggggggtgaagggtcatctgagccatgactctt

SEQ ID NO: 9403 - DNA, 804 bp, Diabrotica virgifera
  misc_feature (762)..(780): n is a, c, g, or t
acacaaacgtcattttatattgacgtctccgctccggtatcaaatagtgcatagtgcagtgcaatagacacaaaaaggccaagactttagtagtctgaatggtgtatttatgttttaggaactaaaaatgcaagactctttagatgattacgttaaattagccaaaaacattcaatcagagggtagctccaaagagacgcagaaagatgtccagattgctgctctaaggaaaaaagaatgcgaaacgagagcgttcaaaattgttgagttttcaatagaaggaaaattgagaccagaaatttttaccagatgtcttccatacattaatcaatcacattatcaagatatagttgaagaaagggctattacaaagctatgtggctactcagtatgtggaagaaagattccagaaatgcccaaaaaaaacagttttacatatcaactaaacataacaaagtgtatgacatcacagatcggaagaactattgtagtaacttttgttataaagctagtatacatataaaaaaacagatcgatgatagtcctttatggttgcgcaagctagattccattccagagtaccaatttttaggtagtgaaggagggggcttaccaggtgaacttatagaccaaggcatatctaaacctgtagttgaacctttattcacttccgtgggtagctttactaatgtttctttagaagatatgatcaacaaagaaaaagggtccaatagagacccaaataaagcaaaacaaacaggnnnnnnnnnnnnnnnnnnntttggttaaaaccatgcaaacaat

SEQ ID NO: 9404 - DNA, 862 bp, Diabrotica virgifera
  misc_feature (72)..(92): n is a, c, g, or t
  misc_feature (102)..(123): n is a, c, g, or t
  misc_feature (223)..(244): n is a, c, g, or t
  misc_feature (605)..(605): n is a, c, g, or t
  misc_feature (831)..(831): n is a, c, g, or t
gtcattggccttattaattctttatgtattactaatagattctagaagtttgactggcttagaatgattagnnnnnnnnnnnnnnnnnnnnntttttaagcnnnnnnnnnnnnnnnnnnnnnnggtaaaaaatgccattctcttcagaatagaaagattagcatcagagatacgaaaaaatgtttaaatatgaaattgtaggttatttaattaccaagaactnnnnnnnnnnnnnnnnnnnnnntgcaaaaattgagtgaatcgtaaatgagtataccatcgaaaaacattgactttttagatataaaattaacactttcgatagcgaagaaatcgaaaactgttaatcttgtcaaaaaaatatatagaacgttttttgcctggactgaatgtttttatcaacttttgcggttaaggtatagtgggaaatttccacccctagatggggtggcgaccgcccccatggtagaggcgcctttcggcatcatatggattttgatccttggactgtccactgcttattctcaagttttcaagcaggtcggttcattctgtaaaaaatgcgaggtgaaaagcttcggttcctggactattcatcttaattntgttctctttctggacttacgagctcttgaaaatactcattccaccttctcattagttcctgtttctcgctaataattgtcccatttttggtcttgcaaactgttgatcttgtcatgtatccttttgtattgcttggtttccttgtaaaatttttgagtctctctttctgttgtataatctgtaatctgttgtatttttctattcacatttctctcttttctcagntctctatatgcccttctattctatcaggaat

SEQ ID NO: 9405 - DNA, 331 bp, Diabrotica virgifera
  misc_feature (6)..(28): n is a, c, g, or t
  misc_feature (219)..(290): n is a, c, g, or t
  misc_feature (295)..(329): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnct

SEQ ID NO: 9406 - DNA, 336 bp, Diabrotica virgifera
  misc_feature (2)..(142): n is a, c, g, or t
  misc_feature (153)..(191): n is a, c, g, or t
  misc_feature (194)..(213): n is a, c, g, or t
  misc_feature (215)..(256): n is a, c, g, or t
  misc_feature (259)..(289): n is a, c, g, or t
  misc_feature (308)..(326): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttaacnnnnnnnnnnnnnnnnnnnnnnnnnnnnnnnnnnnnnnnggnnnnnnnnnnnnnnnnnnnncnnnnnnnnnnnnnnnnnnnnnnnnnnnnnnnnnnnnnnnnnnccnnnnnnnnnnnnnnnnnnnnnnnnnnnnnnnccttaagggaaaacacggnnnnnnnnnnnnnnnnnnnggttcaaatc

SEQ ID NO: 9407 - DNA, 82 bp, Diabrotica virgifera
  misc_feature (22)..(22): n is a, c, g, or t
agtaatggaagatgtaacttanatcaacatttattaacataatgccttaattgttatgcataatagtgaaatatactttgca

SEQ ID NO: 9408 - DNA, 132 bp, Diabrotica virgifera
  misc_feature (7)..(30): n is a, c, g, or t
  misc_feature (40)..(40): n is a, c, g, or t
  misc_feature (79)..(101): n is a, c, g, or t
  misc_feature (115)..(115): n is a, c, g, or t
taacagnnnnnnnnnnnnnnnnnnnnnnnntcgataatanagattgcgacctcgatgttggattaagtttataattggnnnnnnnnnnnnnnnnnnnnnnntggtcgacttttanattttacatgatctgag

SEQ ID NO: 9409 - DNA, 544 bp, Diabrotica virgifera
  misc_feature (7)..(67): n is a, c, g, or t
  misc_feature (73)..(95): n is a, c, g, or t
  misc_feature (286)..(359): n is a, c, g, or t
  misc_feature (364)..(429): n is a, c, g, or t
  misc_feature (447)..(465): n is a, c, g, or t
  misc_feature (474)..(488): n is a, c, g, or t
  misc_feature (490)..(506): n is a, c, g, or t
  misc_feature (509)..(527): n is a, c, g, or t
tttgcgnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcttt

SEQ ID NO: 9410 - DNA, 346 bp, Diabrotica virgifera
  misc_feature (6)..(89): n is a, c, g, or t
  misc_feature (108)..(132): n is a, c, g, or t
  misc_feature (218)..(238): n is a, c, g, or t
  misc_feature (255)..(341): n is a, c, g, or t
gtgatnnnnnnnnnnnnnnnnnnnnnnnnnnnnnnnnnnnnnnnnnnnnnnnnnnnnnnnnnnnnnnnnnnnnnnnnnnnnnnnnnnnnacccttagggataacagcnnnnnnnnnnnnnnnnnnnnnnnnntccgataataagattggcgaactccaagggtgggataaaagtttataattgggggtagcagctttttttattaaagtttgggtccnnnnnnnnnnnnnnnnnnnnngtattggggggttaaannnnnnnnnnnnnnnnnnnnnnnnnnnnnnnnnnnnnnnnnnnnnnnnnnnnnnnnnnnnnnnnnnnnnnnnnnnnnnnnnnnnnnncccac

SEQ ID NO: 9411 - DNA, 612 bp, Diabrotica virgifera
  misc_feature (7)..(55): n is a, c, g, or t
  misc_feature (57)..(133): n is a, c, g, or t
  misc_feature (135)..(168): n is a, c, g, or t
  misc_feature (176)..(364): n is a, c, g, or t
  misc_feature (367)..(451): n is a, c, g, or t
  misc_feature (453)..(608): n is a, c, g, or t
aattggnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgga

SEQ ID NO: 9412 - DNA, 218 bp, Diabrotica virgifera; identical to SEQ ID NO: 7300
  misc_feature (6)..(28): n is a, c, g, or t

SEQ ID NO: 9413 - DNA, 1030 bp, Diabrotica virgifera
  misc_feature (2)..(656): n is a, c, g, or t
  misc_feature (658)..(671): n is a, c, g, or t
  misc_feature (680)..(680): n is a, c, g, or t
  misc_feature (705)..(732): n is a, c, g, or t
  misc_feature (735)..(817): n is a, c, g, or t
  misc_feature (821)..(857): n is a, c, g, or t
  misc_feature (998)..(1015): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnntaagcttanatttttttataagacgagacacccnnnnnnnnnnnnnnnnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnatannnnnnnnnnnnnnnnnnnnnnnnnnnnnnnnnnnnnataagattaattaccttaagggataacgcggagattttttttggggagttccaaccgaaaaaaagatgggggccccccccgggggggttaaaaggtttaatttggggggggaccaattttttttatattcgttttcccacnnnnnnnnnnnnnnnnnntttgggggggtaaaa

SEQ ID NO: 9414 - DNA, 722 bp, Diabrotica virgifera
cgcaggttcagggtcatttaagaaagttcagatacgcttatttaaagagtctgtccctggaatatcccttgaggcccgatagggtgttgtgtttggtttgagatgtatcatctgagggcactagcgggctctctttatatccaggctgcttacctggttcaccactgacaccgagtagagaaccccctcctctagaacaggatgtaacagaaagtacctgtgcaacagctacatagattttagattttgcattcctataatgattccaatttgttttttaagaaactaaggagacactattgaaattaagtctaatgtaaatttttcattttccaaataacagtgaaatctcgtgacggatatattcccccgccgctcgctgcgtaacctaaatggatgaacgactacatccataaaagccctaatgttacggtgctagtgtaccctattgtcttgccagcaaattatcggctgagccgcgtttgacgcaccgcgctgatgagattctgaataccgtgtgtctggagatagaactacgctatcaggccgaatttctagaaataggtacggacagagatcccgaacattttatcaagcaatcagtgcctacgtacagagagactacaattatcaaactagtctaaagcctggcggcacgtgatatattccaacgctggccactattgaaagaaattttgtggagaggtgagttttggaattga

SEQ ID NO: 9415 - DNA, 565 bp, Diabrotica virgifera
  misc_feature (61)..(164): n is a, c, g, or t
  misc_feature (173)..(188): n is a, c, g, or t
  misc_feature (190)..(223): n is a, c, g, or t
  misc_feature (225)..(237): n is a, c, g, or t
  misc_feature (253)..(271): n is a, c, g, or t
  misc_feature (286)..(304): n is a, c, g, or t
  misc_feature (439)..(472): n is a, c, g, or t
  misc_feature (474)..(503): n is a, c, g, or t
  misc_feature (505)..(526): n is a, c, g, or t
  misc_feature (528)..(556): n is a, c, g, or t
tatcgggaagctggtacccctgcaggcccgccccggaatccccggctccccccgcccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagacacnnnnnnnnnnnnnnnncnnnnnnnnnnnnnnnnnnnnnnnnnnnnnnnnnncnnnnnnnnnnnnncttaaaagagctaacnnnnnnnnnnnnnnnnnnncaaataactatctcnnnnnnnnnnnnnnnnnnncaatgctattccttcttacatacatccaattttttacgaaataaattatattcattcatccaacaatatatttatacttaaacatttttatattattaccatcacatatttttaggcatgagcttcatcataacnnnnnnnnnnnnnnnnnnnnnnnnnnnnnnnnnncnnnnnnnnnnnnnnnnnnnnnnnnnnnnnngnnnnnnnnnnnnnnnnnnnnnncnnnnnnnnnnnnnnnnnnnnnnnnnnnnntcatataca

SEQ ID NO: 9416 - DNA, 582 bp, Diabrotica virgifera
ggggagaaacctttctcatgtatgcgtcctcttgtgcctgttaagattctcaaatgtcaagaatctcctgttacacagttcacaacaaaaagatctgttccatgcccgttgtgttcaaaggtaatgaagagtacgaagcaattattaacgcatatgaatacccatgacgaaggacctcacaatccatttccttgtgataaatgcaagaagagttacaaaaatttattttctctaaatcttcatttaaaaattcacggaaatatcaggtattatcaatgtatgctttgctataaggtgtttactaacgctatctatttgctgaggcattccaattcatacaaaatattaagtcctcatgtttgtaatatccttatgatacgtgttcactactcgatacatcttaagagacaaatgtaactattttacactaaattcttatttagttcgtgatctgacatatttatgttttacaagcatgttcgtaaaacctatatttaaattattttccatttactcttgtatacaattttaatattataagaccgtaaattatataatagcatgtacgagtaaccaaagaat

SEQ ID NO: 9417 - DNA, 447 bp, Diabrotica virgifera
  misc_feature (13)..(55): n is a, c, g, or t
  misc_feature (67)..(85): n is a, c, g, or t
  misc_feature (92)..(92): n is a, c, g, or t
  misc_feature (99)..(157): n is a, c, g, or t
  misc_feature (188)..(206): n is a, c, g, or t
  misc_feature (280)..(299): n is a, c, g, or t
  misc_feature (310)..(329): n is a, c, g, or t
  misc_feature (351)..(374): n is a, c, g, or t
  misc_feature (378)..(431): n is a, c, g, or t
aagacgagaaacnnnnnnnnnnnnnnnnnnnnnnnnnnnnnnnnnnnnnnnnnnnattatttatatnnnnnnnnnnnnnnnnnnngtgatanaaataannnnnnnnnnnnnnnnnnnnnnnnnnnnnnnnnnnnnnnnnnnnnnnnnnnnnnnnnnntataagataaaataaccttagggatacagcnnnnnnnnnnnnnnnnnnnggtcaatcgaataataagattggggccccccccggttggggggttaaaaagttttaaatttgtggggtgaacgnnnnnnnnnnnnnnnnnnnncgttggtccgnnnnnnnnnnnnnnnnnnnnttgtatttggggggtataaccnnnnnnnnnnnnnnnnnnnnnnnngggnnnnnnnnnnnnnnnnnnnnnnnnnnnnnnnnnnnnnnnnnnnnnnnnnnnnnnaggaggggggggccac

SEQ ID NO: 9418 - DNA, 491 bp, Diabrotica virgifera
  misc_feature (475)..(489): n is a, c, g, or t
gaacagaaataatcacacaaaatgaggctggaatatgcattacttttaagtgtgttattggatatggcgaagtgtgcaattgactttactgattgtggaacaatattagaagtaactgatgtgaaatttggtaattgtatacaaacaccttgcacagttgaacgatactctgaagtgtcggtcgaaattgagttgagtcgaaaaactcatgttccgccattggattctgtgagtgcagttgctgaatatgtccatcgaggcatttcttgggagttggggatatcccccagcgatacatgtacgacttggacatgtccactacaagatgtaaatacatattcatatcaagcgaaaatttcttttgaacctattagttatttgagaccaggagaagtactaataaagaccttcaataccttgcaacctgatggagatcccattttctgcgcaagttgggacattaattttgtttagnnnnnnnnnnnnnnncg

SEQ ID NO: 9419 - DNA, 947 bp, Diabrotica virgifera
  misc_feature (513)..(532): n is a, c, g, or t
  misc_feature (627)..(669): n is a, c, g, or t
  misc_feature (684)..(684): n is a, c, g, or t
  misc_feature (700)..(700): n is a, c, g, or t
  misc_feature (716)..(733): n is a, c, g, or t
  misc_feature (837)..(837): n is a, c, g, or t
  misc_feature (888)..(888): n is a, c, g, or t
  misc_feature (913)..(913): n is a, c, g, or t
gtttatttgaaaatgatagaatatcaacaaatttaaagtatcaagattatgggcgaggaggaaatcacaccaaataatatcaaagaaaatcagagtgagaatatgaatgggaatataaatggtcaagaggaaaatccacctccagaagaaatggatacaaatggggaaaatgatgtaaatgaagatgatctggatgaagacaatgatgacatgtcgcctgaagagtttgctgcacttgatcaccagttagatgccttaaattctgctttagatgacatagaacagaaaaatgataatatacattcgcagttactagaactactccatgctaacagggaaatccggactcaattacagcaagataaagctagcacagataacagagaagacgtaaataaaacaaatgaaccaaaagcatgaaatgtagcattccggtaattatctgacattagatattattcatttgatgcattttgttgtcttttcagtatattctagtgtagaggaaaaccnnnnnnnnnnnnnnnnnnnnttattttaactatgtcagttataaaaataggctatattgttgatttactacattttgtcttacctttatgatgatacatagattagtcatcagcnnnnnnnnnnnnnnnnnnnnnnnnnnnnnnnnnnnnnnnnnnngtttggcattgttgnggtggatttttcttanatttctcaatttttcnnnnnnnnnnnnnnnnnncatgactataattattataaacttacatagtatcattaaaccttcatacaaacaattcaaaacttgtttatcaaataaagaaatatgtacctatactgtgtttncaacgttaaaagcagtatggttgtatatttgcagcgggtttgccattctantaattatcataaataatcctctacnagtacctgcctaatactacctttcacggacgctg

SEQ ID NO: 9420 - DNA, 970 bp, Diabrotica virgifera
gatgtatttactgacaatcgttctaagagaaagaggaatgctgaaagaagacaagactttacagtatttgccgagaaacggggtgaattaaacaagatgagaatcagtccccaactgacacttgccgcttatcaatatttaagtacaagtgtggaacccttccatccaaatgtgatatctgagacaatcttacgtcgtcttctcaaacaggacattgcagtacacatcaaaaagaacaaggaatggcgcacggatcctgctaacatcatttactcccaaggaaaatcggttgatttctttgttatcatcctagaaggtcgcgtggaagttactgttggtaaagaaagtcttatgtttgaaggaggaccgttcacatatttcggtacccaggctttagtacaaactgttggtattgaatccccttcagtggctgcatccactatgggcagtttggaatcgctgaatatcgattcacttctacgacatacattcattcccgactattcagtacgtgctagtacagaagtgctttacttaaaaatcaaaagaagtttatatctagcagccaaaagagctagtcttatggagcgttccaagaaaggagagcatcaaacacaacaacaatttgacgaagaagtcgataaacttttgcattcattggacgaagatgatggcataagtgccggtgcccagacaccgaaacggaaatcttcaagaagatcccaagaaatcaagccagaaaacttatctaacctctctagccagacgagtcccaaaactccgtcacactacagcaacaccagccctccgcacagagtcagcgccccgtgacgtaaacggctctataaaggcgagtccccgtagatgatatccaaatcgtgagccctaaagacgaagaaatactatgctgctacccaaaaattcatacggacattttaaggcccatttccggttagggggcggttttttg

SEQ ID NO: 9421 - DNA, 330 bp, Diabrotica virgifera
  misc_feature (37)..(106): n is a, c, g, or t
gagagaaaaattttatttagtgagagtaagatagtgnnnnnnnnnnnnnnnnnnnnnnnnnnnnnnnnnnnnnnnnnnnnnnnnnnnnnnnnnnnnnnnnnnnnnngataaatctctagatttatactattttcaaatctaaaagatctataagatacaagattgttattggaaaacgactatttatacatagttttttcgaggggcaagtgaatgcgatctcaaatataccaaatgatttaggaaatgaagtcagactttgtttttaagaatcatatgaacaatgacatatttttatattgatagtattagatatttctggggatgagc

SEQ ID NO: 9422 - DNA, 938 bp, Diabrotica virgifera
  misc_feature (13)..(37): n is a, c, g, or t
  misc_feature (817)..(817): n is a, c, g, or t
agactacataagnnnnnnnnnnnnnnnnnnnnnnnnncaagcagtttcttttatttcaagatatacaactttatactgttttgctaatttggttgattataatttgatactatttcagtcgaaggagtattcaatatcgagctttgttttcacagtagactgttgcatttagaggcgcgcattttatatattatatgtgtatattgtactaaaaagtttatctgtttggcatatctcagtcaatttctcgaaaattgaccagaaggtatattcttaatgacttcatctcgttcaaactgacagagtatatgccgtactgattaacataaataagtacagtatgtacagcgttttaactaagaattcttttttaaattgcaacggacaaatcttaaaatacacatttgcaaaggaagtgaaatatagcaataatatattactccatttttataacgttttaaagttacaagttacatattattattcgtagtagtggtcatgtttaaccttttgttgccaacatttacagtctgattaatcatttagttatgcgaagaaaaaaatacctccaatattaaacatttttccattttcaaaacagggcattcgataaaagagcagtacttcaagcaatgtgatatgtgtgcagctttcctcaaaagaatattgttcctataatattctccttatctagaacatctctagttttaatatttttaaaacattatcacattccctcctatttttcaatcgtaatatcgtaaatagaaaagcaaaaatgcgtgtctcttatcaagctggaaaatactgccctggntgaggggatatctgtcaagccaagaaataatgtgcacacattttctcactaatctccaaacggtatgtctaatattgctaatgttttactagaaattgtacaaataaatcgatcacataca

SEQ ID NO: 9423 - DNA, 913 bp, Diabrotica virgifera
  misc_feature (60)..(72): n is a, c, g, or t
  misc_feature (74)..(90): n is a, c, g, or t
  misc_feature (767)..(767): n is a, c, g, or t
  misc_feature (802)..(802): n is a, c, g, or t
  misc_feature (857)..(857): n is a, c, g, or t
acggcatataagagggtataccaggaaatggcttaccaacgaacagctgaaaaggcagtnnnnnnnnnnnnntnnnnnnnnnnnnnnnnntataaggaagactgtagaatgacgattgaactcctagatactgattcagatgacatgaagaaagttgaagatggaaaaaagtggagcgattacaaggaacattatgccaatattgttgatgaagcaaagcctagatcacctgtgtacttgcatcgaaatctcaggctgtatcagagaaaagtggtgaattgttccagtaagaacaggcgccaaattaaaaatcaccaatcaaatagagatgacgaatcacttggagagaataaaaagacagatggaaaaagtttcaatattctagatgccatcgaaagaaagcttaatgaaaggacagtacctctaagagatcatacacatcatcctggttatgaggttaatgacgaaacagaatgtaaatttaatgttcaagactcgaaaattatgttcaccatacaaaaagatagttatctatacaacataagtgccttccaccgagcaagaaagtctcatccccaggtaacgagaaaaaaagcgggtcgcttccgctcgtggctgaaagaatggactagcgagcatgttagtgacattcaagtgaagcagtgtacagattggctgatgggtagatgtgacggcgtggtacccaacagaacgcgcgtactaactgataacgatctaactaggactccatatgtatcttacaacanggtatcgtggtgaacatttgagctcgtcgatactntcagcgttttgaaatcaaaaatatttaaaaacggggcgatttcctagaaatttantagttttccataatactttgtcacgaatcaataattttgatacatttcaatgtcta

SEQ ID NO: 9424 - DNA, 852 bp, Diabrotica virgifera
  misc_feature (759)..(759): n is a, c, g, or t
gaagtatgttggtgtttctattagtcatactcgttgcatttttttatctttacaaaaaatggatctacacttattggaaacgaagaggagtgtatcagatgaaaccggagtttttctatggaaactttaaaccgatgaccacagggaagatgtctgttgcagaactgatcagagaaatatacactgaaatcaaagctaaaggagggcagtatggcgggttttaccaggtatttaaaccgggatttatgccagttgatcttgatattatcaaaggcattgttcagaaggattttggtcattttatgaaccacggtaactacaccaatccggaagtagatcctctctcgaatcatctgtttgcaatggaaggtgaggaatggaggaagatgaggtccaaactcacaccaacattcactacaggtaaaatgaagatgatgttccccactatggttgcttgtactcaaggtctaaacgaaatgttaaaagatcatgctagtattcaagacgctgttgacataaaagacctcatagcaagatttaccacagatatcatcggatctgccgcctttggcatcgactgtaatagtcttcaagacccaaattcagatttttagacaatttggaaagcaggtatttgaagttaccttttggaagagattaaagcgtctaatttctaccaatttaccctaagtggttactagatttaattcgtctgaagatggtcgaccaggcactcgaagatttctttatgggtatcgntaggagcacgattaaatttagagaacaaaataatgtatacagaagagacttcttgcatttaatgttgcagcttaagacaaaggaaaagttacg

SEQ ID NO: 9425 - DNA, 777 bp, Diabrotica virgifera
  misc_feature (493)..(582): n is a, c, g, or t
gaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgagacgtcctaccggtgggcttagctcgcaagggcggtccaactcaatcccgccgcggtgctcttgactgagtgtcgaggtgggccggtacgtttactttgaacaaattagagaagttaaagcaggccaaaacttcgcctgaatactg

SEQ ID NO: 9426 - DNA, 1119 bp, Diabrotica virgifera
  misc_feature (963)..(980): n is a, c, g, or t
  misc_feature (1074)..(1104): n is a, c, g, or t
gaatacttgaaatttctcattaatttgtaaatagataataatgacaagaaaacccttacttacaattatctcatgagaggatggtattgatatacttaaaatttaatggtttaaaatatctttgtgtgtttggaataaagtgagtcaaaatgagacttcctgagtttttttggaacacaactattccagaaataataagcagcagttccattccgataagaaatagagccgggtttgagaccatagctgtgatcttaccatcatttttctactcattaataatcgttgtattggaaacgtatatctcgctgaagacgtcatctaaatttgtcttagaattagccaccatagttttaccaataacattaggaatgacgctcttatcagaatattcaaatctaatgataggagtgctgagtatgttgagcgccctgttattgggtgtctcttacaaaaaaagaacgagcaccaagaagtctgattcattccatactagttttatcaccaattctagatctactattaacattttatctgtgatagctatattagccgttgatttcgacatatttccgtctagatttacaaaaatggacaccttgggatacagcctgatggacaccggcgttggcctctacgtcttcgctaacggcatcgtgtcaccggagtctcggggggtaaaaaaccccatctccaagtcaataaaaggttcattacctctgtttttgataggtagcgccagattcgtacttaccaaactcttccactaccacgtcccttgaggggggaagtacggagtacactgggaatttttttataactctagctgtcaccaaaatgttcacttcgttccttctcaacgtttttaagattaggaaatatttattgttaatgttacgatgctaaccctaacacaccaaaaattaataaggtggcggactccaaaaattccttctttgaagnnnnnnnnnnnnnnnnnnttttgccagggttaaaaaagaaaggactgggcccctccctttggtttccttctctttggtttcccctatcccgttcctttttgggtaatgaaannnnnnnnnnnnnnnnnnnnnnnnnnnnnnntccttaagggtggtt

SEQ ID NO: 9427 - DNA, 101 bp, Diabrotica virgifera
  misc_feature (5)..(64): n is a, c, g, or t
  misc_feature (66)..(100): n is a, c, g, or t
gttgnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnng

SEQ ID NO: 9428 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttgggtnnnnnnnnnnnnnnnnnnnnnnnnnnnnnnnnggaagg

SEQ ID NO: 9429 - DNA, 280 bp, Diabrotica virgifera
  misc_feature (16)..(58): n is a, c, g, or t
  misc_feature (64)..(86): n is a, c, g, or t
cggacgcgtggattcnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatggaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 9430 - DNA, 810 bp, Diabrotica virgifera
  misc_feature (523)..(557): n is a, c, g, or t
  misc_feature (591)..(608): n is a, c, g, or t
tttgcttttgttggatgctgttgaattgtatggatttgggaattgggagttaataagtgaacatgtagaaactcgtagtgcagaagaagtaaaagaagaatacatagcccgatatgtagatggaaatctagggaaagtcactatgactaatccgaatctcaaaaagccggttttagttgatcataccatagatgatgatgcctctgtgacaccagcacctccattagatgttacactggaagaagccaatctgttagggtacaaaccatatagagatgattatgaaatggagtacaatatggaagctgaaggattagtatcaaaactaagtttagaccctgaagaggacagtggtgtagaaatagtgttaaagttgatgattgtagatatgtatatgcgaagactgaaagaaagaactcgacggaaaaagattgtcaaagattatcaattagtagctaaatatttcgagaaccttaggatggatccatataaagcacagataactagagatcaaagagaattnnnnnnnnnnnnnnnnnnnnnnnnnnnnnnnnnnncggccggccgattacgaacgaataacatccagcnnnnnnnnnnnnnnnnnncttcgtcatcggttatcggaactcacaaggtaccgtagtctcggtcttcgaactcaggaagaaattaaccagtacgaacaacatgtggtacagaggcagaacagcgaacctggtaccagcagcatggtgcaactgggatttcatcaaaatggaaatagcgacgagcaagatattccgatggatatcatatccggagaaacag

SEQ ID NO: 9431 - DNA, 572 bp, Diabrotica virgifera
  misc_feature (66)..(86): n is a, c, g, or t
  misc_feature (435)..(455): n is a, c, g, or t
acagtacctacactttctgccaagtatgataggaatatgccaaatggttttaaagtactgggtacnnnnnnnnnnnnnnnnnnnnncataatatgaatcatatcataaattaatcaaaataactgtgccgtttcatatttaacttcaaatatctcgaaaaataatgattttaccgttaccaatgaagtacgtagaaattttacgtagaaatgaatttacgtagaaagtattggagaatctaaaaatggcactaaaatagtaatttctccagtggcgtagaatttgagaagagtcaaccaatcaccatcccctgtcgtacgcctctggtagtagctagaaacgtttgtttattaaaatttagtagggtgtacagtacctacactttctgccaagtatgataggaatatgccaaatggttttaaagtactgggtacnnnnnnnnnnnnnnnnnnnnncataatatgaatcatatcataaattaatcaaaataactgtgccgtttcatatttaacttcaaatatctcgaaaactgataattttatcgatacgaatgaacagtatattatttatat

SEQ ID NO: 9432 - DNA, 683 bp, Diabrotica virgifera
  misc_feature (636)..(653): n is a, c, g, or t
attaaccgtgaacagtcgaagtttgtgagttggttcactaataccgtcaaaaaatgttcggtgggcttacgattttgtcacttgtgtgcttttcagctgccttggctgcaggattaaacgagacgaaacctcccaataaatgcgaaattcctgcatcagcgccaaaaaaggtcgaggaagtaattaaccaatgccaggatgaaattaaactagccattctttcagaagcgttggagactataaatgttaatgaaaatgcccatagtcgtgcaaaaagggcagcatttactgatgatgagaaaagaattgctggttgtttactacaatgtgtatacaggaagatgaaagcggttaacgaaattggttttccaactgagtctggtttaatatctctatatacaagcggaattccacacaaagagtacattagagctacagttgaagctgttacgttatgtctcagagatgccaagaaaaaatatttggttaacaggaagtcactagaagaagatggcaagacatgcgacgttgcatatgaagtcttcgattgtgtgtcggatgaaattgggaaatactgcggacagacgccataacattgtggatccagtatgatagagttaagaattagttaccatnnnnnnnnnnnnnnnnnncttgtaaatctaataaacacttttttgtgt

SEQ ID NO: 9433 - DNA, 882 bp, Diabrotica virgifera
  misc_feature (165)..(182): n is a, c, g, or t
  misc_feature (784)..(801): n is a, c, g, or t
  misc_feature (814)..(814): n is a, c, g, or t
  misc_feature (837)..(837): n is a, c, g, or t
gtgtctgtgacgttaagtcgttagaaaactattaaataattgtagagagatatgaagtaatatagtgagtgtttcgttattcgtgtgtttgtcaaataaatgtaggaaattggagcagaaaagttaggaattataattacaagacctatcttatcaagtgcagtnnnnnnnnnnnnnnnnnngaaaatgatattaaaaataattctatcctgttccatcctcaacgtagtatggtgtatatcccgccatccaatccttatcataatttcctacgacgcattcagatataatctcttcgacacgaagctactgccaaatatggaaaatctgaggaaagcaggaacctacgcagactacatgacaaacatctttccgacaaaaacttttcccaatcattactccatagcaactggtgtatttgcggaaacgcatggagtgattggagccagttatcttgacgcagctacacagaaggttgtgaagaaagttgaagaaatgtttcattataatgaagatgttgtgcctatttggcgatggaatgaagcacaaggagatggtagatattctgcttcatttatgtggccaggttcagattttccttaccaaggtaaagacataacgtacaaccaaaaatttgccagaaatttcacccatgtccaaaaagttgataagatgttatcttggttaaccgatccagtgaaacctgcaaatttggttatgctatatattgaaggaattgattatccagcacatgtatatggttcaaattcggcacagttcatgnnnnnnnnnnnnnnnnnngacactctcacgnaatatattgaggatcaattgatnaaacacaatttatcagaaagagccaatggtgtccagctaagcgat

SEQ ID NO: 9434 - DNA, 875 bp, Diabrotica virgifera
  misc_feature (132)..(151): n is a, c, g, or t
  misc_feature (827)..(827): n is a, c, g, or t
atttgatattgatgtgtgtatgtaattttcacttatatcctgctcgaatgtttaatctggatatagacgatatttgtattatttttactattattaaagtgcatcgacaatcattcatttttgtttgataannnnnnnnnnnnnnnnnnnntggttcttctggttataatactcttaatcttactaccactagttctttacgactactttactaccgcaattgctcctcctgcaactttgaatatctttaatgatatagcactaactagttctagaaatgatttagacagatcgtcaatccccgataaagcttccacagacagtgcatcaattcatcctaaagctattacagataatactaccagaactcctggttgtggtgttacaagctctaaaactaatctggaaagatcagagactagacgagataataacgaaacactggcatcatctggaggagattcaagttcatcaagaatgataaatcaacattttatgaaacatacgaacacaaccgcccttataccagtacgcaaaaatccagaaatattaacacatgtattcaatattttatacaattttaatataaaattgactaatgatgtatttcaattagaaagtctgagagaagagtcctgggaatatcaacgtattaagagcatattttttcaatctaataaaagtttctgtaaattacatagcatcgagaaagtacacaatccttatcttcaactacattacgcacttaaaaaagatgaatacattcgtaaaggaatccgttacatggaaacaatgctgttccacggaacaaggagagcaattattanagatatttgccgaaataattttaactggagattaacaggtaccgcttt

SEQ ID NO: 9435 - DNA, 810 bp, Diabrotica virgifera
  misc_feature (13)..(38): n is a, c, g, or t
  misc_feature (318)..(334): n is a, c, g, or t
  misc_feature (586)..(586): n is a, c, g, or t
  misc_feature (621)..(621): n is a, c, g, or t
atttaatcaaagnnnnnnnnnnnnnnnnnnnnnnnnnnacaccctgtataaataattatgttaatgtttatattagtaaatataaaaattcaataaactttcaaatgagctgtcacgcggcccctattctcatttaaaaaagatcatcgattgcgtcatcgcgctcagatggatggcgtcactggtattgtatatatgccaaaaggtcctacctaatttaaaaataagaatcgacccgtctgaggatttctcttggaatttgcccgttctcgagatatgaatttgtgcaggctcaggcgtcctcacttgtactgcagnnnnnnnnnnnnnnnnntagcaattaaagggacaaaggggttttcgatgttttgttgcaaagaactcttcgggattttatcaattaatgtttgaagagtgtctacgtatcttggcaacattgaaatttttggatgggtgtccgatttagggttgaaaatggccgatttcgcaattttcaagattttcaatcgctcatgtacaaaagctattaacttgggagaaaaatcactaaggacgttttctgtttgaggtgattcaagggacctanaaaaaaattgttcgatgcaagaagaatagttttgngaaggacccctaatttttcccctcgcctggcggggtcttgtgctcttcggagtcgcctgtcattgtacacatttcttctgaatgacttgctcaagcacatacttgggtttgagccttacaggagaaagtttattttacatcctaagtttgcacttttcgattcccctggtggatacacgtgcaccactg

SEQ ID NO: 9436 - DNA, 816 bp, Diabrotica virgifera
  misc_feature (575)..(595): n is a, c, g, or t
  misc_feature (628)..(645): n is a, c, g, or t
  misc_feature (681)..(753): n is a, c, g, or t
  misc_feature (794)..(815): n is a, c, g, or t
tagttgctgacttatctattaacagcaatattactcacctgtttgtattatttcggactgttacccctgttgaaaaagatgctccaaatcttcttcatttcgctagccgtcctagatgaactctcaaaacttctgagcttaccatcaaaagtccagaatctcctcagcaaagtcagggcctacatattcaacagcctcgtgtttccatgcagcacattagtagtttttacgttttggtctatctgggctgtggatagagaactgatattcccgaaagttatggacacattctttccatcgtggttgaatcatgtgttacatactttcatagctattcctttagttatagagatattgctgccaaagaaagataattttgtgcaattcaagaatgcagctcctattttattattttatgctggattataccagacattgtatttttccatatacctcagggatggagtatggctatatccaatatataaagttcttagcataccccaaatggtgttatttaatatagtacaaatgttattgatattaggattccagtatgtaggtataagtctccnnnnnnnnnnnnnnnnnnnnncggaagtaggtaaaaagaaagtcaagtgattcnnnnnnnnnnnnnnnnnngcaataaacgcactagcaataaataaaatgttcagnnnnnnnnnnnnnnnnnnnnnnnnnnnnnnnnnnnnnnnnnnnnnnnnnnnnnnnnnnnnnnnnnnnnnnnnngggagccaatataaaagatacaaaattttattaaaacatannnnnnnnnnnnnnnnnnnnnng

SEQ ID NO: 9437 - DNA, 65 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttggataa

SEQ ID NO: 9438 - DNA, 548 bp, Diabrotica virgifera
  misc_feature (11)..(11): n is a, c, g, or t
  misc_feature (14)..(15): n is a, c, g, or t
  misc_feature (25)..(26): n is a, c, g, or t
  misc_feature (30)..(30): n is a, c, g, or t
  misc_feature (35)..(35): n is a, c, g, or t
  misc_feature (42)..(42): n is a, c, g, or t
  misc_feature (57)..(57): n is a, c, g, or t
  misc_feature (62)..(62): n is a, c, g, or t
  misc_feature (65)..(65): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (85)..(85): n is a, c, g, or t
  misc_feature (93)..(94): n is a, c, g, or t
  misc_feature (101)..(101): n is a, c, g, or t
  misc_feature (105)..(107): n is a, c, g, or t
  misc_feature (109)..(109): n is a, c, g, or t
  misc_feature (135)..(135): n is a, c, g, or t
  misc_feature (141)..(141): n is a, c, g, or t
  misc_feature (147)..(147): n is a, c, g, or t
  misc_feature (155)..(155): n is a, c, g, or t
  misc_feature (160)..(160): n is a, c, g, or t
  misc_feature (162)..(163): n is a, c, g, or t
  misc_feature (173)..(173): n is a, c, g, or t
  misc_feature (182)..(182): n is a, c, g, or t
  misc_feature (184)..(184): n is a, c, g, or t
  misc_feature (196)..(196): n is a, c, g, or t
  misc_feature (201)..(202): n is a, c, g, or t
  misc_feature (206)..(206): n is a, c, g, or t
  misc_feature (212)..(212): n is a, c, g, or t
  misc_feature (218)..(218): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (228)..(228): n is a, c, g, or t
  misc_feature (245)..(245): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (277)..(277): n is a, c, g, or t
  misc_feature (283)..(283): n is a, c, g, or t
  misc_feature (295)..(295): n is a, c, g, or t
  misc_feature (302)..(302): n is a, c, g, or t
  misc_feature (311)..(311): n is a, c, g, or t
  misc_feature (318)..(318): n is a, c, g, or t
  misc_feature (336)..(336): n is a, c, g, or t
  misc_feature (339)..(340): n is a, c, g, or t
  misc_feature (373)..(373): n is a, c, g, or t
  misc_feature (391)..(391): n is a, c, g, or t
  misc_feature (399)..(399): n is a, c, g, or t
  misc_feature (424)..(424): n is a, c, g, or t
  misc_feature (450)..(450): n is a, c, g, or t
  misc_feature (452)..(452): n is a, c, g, or t
  misc_feature (466)..(466): n is a, c, g, or t
  misc_feature (481)..(481): n is a, c, g, or t
  misc_feature (488)..(488): n is a, c, g, or t
  misc_feature (491)..(492): n is a, c, g, or t
  misc_feature (497)..(498): n is a, c, g, or t
  misc_feature (506)..(506): n is a, c, g, or t
  misc_feature (526)..(526): n is a, c, g, or t
ctcacacaggnggnnaagattaatnnatgnatgtntgagtanactccctaagaaggngaaancgngaaaggntnattaaatnagntatggttnnttagatngtannnanatttatttggatctctgaggaaattntagagntaatanatggaaanagagntnnaaagggaganggaaggagngnttttattagatnaaaannaatnggtggngggttngntngtnatngtataaattggtgaatntgaataantttaagntgatngtanggtntngnatgggngaagtatatttnaaatgtntgtattatnaaatgtngatggtaggttttgagantannatggttgtaatgggtaaaggggaattagggttngatattggagagggagantgagaaangagatatatatttaaggaaggaagnaggagagtaaattatttattcctggnanggggaggtagtgangaaaaataaagatangggattnatnngaggnnttgtaatnggaatgagttgaatataaantttttaatgaggatgaattgga

SEQ ID NO: 9439 - DNA, 579 bp, Diabrotica virgifera
acgcagacgtacatgctttgcaaataaatagcattattaccgctcctagcaatcatggtcataatatgattcctgtatatgcctctcattcttaccagaacaataaagcactactctatccctattaatactctacacttaaagaaccaaaaatgtcaacactgtaatgtcaaacaaatacttaacatcaattcttagacctaaccagacaaccaccatgagaaataactccaatatacctagaccaattactgatcctattaattcaaaatgtagtttatacctttctctttatatatttcagaatcttaaatttcttcgaacatgagaaaaccacctacttcctcttaatcttttccttatatactgatcctgttcacacatttacacatatccaaaaatgagatccacttacaacaacaatgttcacatctgctcccccacaagaactgaaaccaatgtatggtgaaaaattatttccacttaaccaacgaacttattattatttggaaaccgtaatctctgttatattaattaagattgataacacgaagttgtttcaaacattgaaacaacaag

SEQ ID NO: 9440 - DNA, 388 bp, Diabrotica virgifera
  misc_feature (10)..(80): n is a, c, g, or t
  misc_feature (84)..(85): n is a, c, g, or t
  misc_feature (100)..(100): n is a, c, g, or t
  misc_feature (120)..(202): n is a, c, g, or t
  misc_feature (220)..(238): n is a, c, g, or t
  misc_feature (289)..(333): n is a, c, g, or t
  misc_feature (343)..(364): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnattnnattatataataattnatttaattgggggtgattannnnnnnnnnnnnnnnnnnnnnnnnnnnnnnnnnnnnnnnnnnnnnnnnnnnnnnnnnnnnnnnnnnnnnnnnnnnnnnnnnnacccttaggataacagcnnnnnnnnnnnnnnnnnnnggtcaaatccaaaataaaattggggccccccccgcggggggggttataaannnnnnnnnnnnnnnnnnnnnnnnnnnnnnnnnnnnnnnnnnnnngttggtcccnnnnnnnnnnnnnnnnnnnnnngtgttctgggggggtaaaaacgcg

SEQ ID NO: 9441 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9442 - DNA, 822 bp, Diabrotica virgifera
  misc_feature (210)..(228): n is a, c, g, or t
  misc_feature (738)..(738): n is a, c, g, or t
gagaaagataagtcgatggttcaagagctacttgattttaaagatgcaatggataatgttgtttctacatgttttgctaaaaatgagaagtttaccaattctcttaaagaggcatttgaacattttgttaatcaacgaaccaataaacctgctgaacttattgcaaaatttgtggattataaacttcgtgccggaaataaagaggctacnnnnnnnnnnnnnnnnnnnctattagataaaataatggttatattccgttttattcaaggcaaagatgtgtttgaagcgttttataaaaaggacctagcgaagaggttattggtgggtaaatcagccagtgttgatgctgagaagagcatgttaagcaagctcaaacaggagtgtggaggtggattcacgtcaaaacttgaaggcatgtttaaagatatggaattaagtaaagatattaatgtggcgtttaaacagcatctgagtgtgaacagtagaaatttggcacctattgacatgtcggtgagcattctcaccatgggctactggcccagttatcaagcaatggaagtcagtcttccataccacatggtgaagtttcaagatgtatttaaagacttttatctcagcaaacacagtggaagaaaacttcagttccagccaacattaggacactgtgtattaaaggcaagctttaaaggtggaaaaaaagaattggttgtatctctttttcaacagtagttattctgntatttaatgattatgatgaactgagtttggaggacataagagcagctactaatattgaagatggaaagctacggagaacattgc

SEQ ID NO: 9443 - DNA, 163 bp, Diabrotica virgifera
  misc_feature (10)..(45): n is a, c, g, or t
  misc_feature (47)..(160): n is a, c, g, or t
agtaaaagcnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntta

SEQ ID NO: 9444 - DNA, 889 bp, Diabrotica virgifera
  misc_feature (39)..(60): n is a, c, g, or t
  misc_feature (788)..(788): n is a, c, g, or t
  misc_feature (815)..(815): n is a, c, g, or t
  misc_feature (854)..(854): n is a, c, g, or t
gttgccgttctgtgcttgggatgtaacaaaagctaacgnnnnnnnnnnnnnnnnnnnnnncaagattttaaaaataagagatctcagcctagagacacagagagacggtatgatcagagagatcagaagagagatagcggatttaggggcaagagagattccgatagatctgaatctgggagaaggtttgagaatgggaacaacagcgatagaagaagttttaacaataattcaggtggtaacaggtttaatcgatcacaggcatcgcgaaatgaggataatagagcttccgaagcaaatgtggaagatgaagaggaatggggttctagtcctaaagatagctcagatgacatcaaaattcaatcaaatacacaaatggcaaaggaatcgactggtaatgccgctcaaaaaaggattgaacaaatcaaagaaaaacctgtagattctgaagacagtaatgtcaaagaaaaacctctagattctgataaagacattgatgttaaagacagtaatgtcaaagaaaaacctgtagattctgataaagacagtaattttgaagtagagaaaaacaatgttgagccagaaaagaaattgaatgattctgtgaaatgtttctttgaattaccaaagcctattaaagctttgaaagatggagatcaagtaaaaattattgaccaagctaataatcaacttatcgttaaaactaaagaatgttttgcgaaaggcaaggaaatcgtcgaatatataaaaaatttggataaagacactttattattaaacgaagttanagaaggtcaaatgattatatgtgctanagatggcgcgccgaatctttgcagagctggtgtgcttanagtagattcacccgacatagcacagtgacatactt

SEQ ID NO: 9445 - DNA, 937 bp, Diabrotica virgifera
  misc_feature (807)..(807): n is a, c, g, or t
  misc_feature (885)..(885): n is a, c, g, or t
ataatgtatttatgtttgtttcaattttataaaaagaggtttaaacttttttataagatagaaagatacataaaagtataaaagattaaaatagaagagttttaaaaatggaatcttcaacacccaccagacgaacaccacgaactaagaaacccagtttaaaagccctagaatctctttattcccttaaaatacaaaattcaggtattgttcaagctatagtaacaagcgatgatgaatctgaagatgaaatagatctggacaatatagacgtagatgtaaacaagccgaaagttatgcatgaaaatgaggtagtccatggtgaagacatatttactttccaaaaaagaaagaacagtgaagcaattgctcaaaaagtagctgaagcctgtgatttaaaaactcctaagcatgttcgaacaaagacaaaaagtaggatagcaaaaatgatacaggaggatagtgagagtgaatttgaagtctcatctgaagagtctgagagtagtagcagcagtaatgagagtgaagacagttctggctcagattctgatgagaaaagcacaaaggacactaaaaacaaaaagatgatattcagagaagctaatttacaaaccacaaaaactaggagcagaaactaccatatcaaaactgatgaatacttcgaaaaaacatcatccaagaaaatagaaacctcaaataatacccttgaaagattagagactccaagactgccccaatataaacttcaaaagttattacacacagtttcccattcaagtcaacacattgaggccatacacaaattanaaaaagttaatgaaagttgcttcgcaaaatggtggttctttttaaacgaaaactttaacatacttttatatggattanggtcaaagagatctattatcagtaagttcccaagttatacctaaacatcatc

SEQ ID NO: 9446 - DNA, 301 bp, Diabrotica virgifera
  misc_feature (4)..(59): n is a, c, g, or t
  misc_feature (255)..(286): n is a, c, g, or t
ggcnnnnnnnnnnnnnnnnnnnnnnnnnnnnnnnnnnnnnnnnnnnnnnnnnnnnnnnnccattttttttgattatagattaatttaccttagggaaaaaagcgtattttattggaaagttcaatcgataataaagatggcacccccatagtggattaaatttattaatggggacccgcttttttatttagttgtgttcatttttaaaatttaaaaggatttggggtaaaacgggggggaacccaggttgggttnnnnnnnnnnnnnnnnnnnnnnnnnnnnnnnncgacggaaaaggacc

SEQ ID NO: 9447 - DNA, 453 bp, Diabrotica virgifera
gtcaataagaaatctatgcttataaactcaaaatgactgtatgatcccagatggtcgcaagggatatggattattcatgatctaatgattattttctacatactgagacgggaagacggcgaagatggtgttgcaaccataatacttaggagctccttctatggcactggcgtcgatccaggttttatcggtctctctaatcttgtaacgagatatattatactttttaataagcatgatgttcattgtgaggaatggtgacatctgcaaagctaaacccctatggggtcaaagattcagtctatgatggtatgaaaaaggtatcgatatgtaatgacgatcttcaaagggtttcacatttcaaagaatagcctgttgtttctttagacaggaatgtcttatacgaaccacacagattctcgatggaatcattgatgtcaattagtgtgatgt

SEQ ID NO: 9448 - DNA, 854 bp, Diabrotica virgifera
  misc_feature (4)..(21): n is a, c, g, or t
  misc_feature (107)..(125): n is a, c, g, or t
  misc_feature (159)..(177): n is a, c, g, or t
  misc_feature (621)..(621): n is a, c, g, or t
  misc_feature (669)..(669): n is a, c, g, or t
cctnnnnnnnnnnnnnnnnnnaaaaaactataattcgcctggttcggaaatacttacatacacatttagtacacgtctgatgacttaaaattataatgaataaaagnnnnnnnnnnnnnnnnnnnctaaataagcagatgtggcggacagtgtttcatnnnnnnnnnnnnnnnnnnngagagtgtaattacatagcttatattgtaacccagtgtgtaaaattgtgacagtgagcaaaagcaaaaaatttgaaaaatgagttctgccacaccaatggaacagtttgaacaggaagatctcttaaataaagatcaagcagggaattctgtttctatagttagaaaccatgaaaaatttagatttgggcgtagtaaaattcctgtccgtttttggataggattaatggttttctttacgacgtatgtaaattatgcaacgagagttaatatggccatatcaatcatctctatgacaaagggtaaatcaaagaagacaccggaatgtctactagacgaaatgactaattcgtcatctgcaactcagaagggtctcccagattatggaccaagatacgattgggatgagcacattcagggaataatacttggcagttacttttgnggctataccatattttcattacctgcgggagctgtttctgagttatgnggtccagcaagagttatattttggaccacaatagtatcgctgattttaaattctgtcagtgttccagcagctaatggtcattatggattgctgattgcctgtagatttctcattggagcagtaggtggattggtatatccagctcttcaggtattaatagcaaaatgggccccaccagccgaaaa

SEQ ID NO: 9449 - DNA, 510 bp, Diabrotica virgifera
  misc_feature (14)..(33): n is a, c, g, or t
  misc_feature (247)..(327): n is a, c, g, or t
  misc_feature (334)..(353): n is a, c, g, or t
  misc_feature (364)..(383): n is a, c, g, or t
atctttcggactgnnnnnnnnnnnnnnnnnnnngatagaaaccatcctggctcacaccggtttaaactcagatcatgtaaaattttaaaagtcgaacagacttaataatatagctgctacaccaattataaactttaatccaacatcaaggtcgcaatctttattatcgatatgaactctccaataaaattacgctgttatccctaaggcaatttattcttataatcaataaaattgtatgaaaatnnnnnnnnnnnnnnnnnnnnnnnnnnnnnnnnnnnnnnnnnnnnnnnnnnnnnnnnnnnnnnnnnnnnnnnnnnnnnnnnntgagagnnnnnnnnnnnnnnnnnnnngcttatgtagnnnnnnnnnnnnnnnnnnnntacaatatatcaaatatttatatttaaatatgatgaatgttttttttttaaaccacgcatatatttatgaagaagatatacgatcaatcaatgaattcagtaacatatgttgcccaggaaatgaaaa

SEQ ID NO: 9450 - DNA, 269 bp, Diabrotica virgifera
  misc_feature (10)..(10): n is a, c, g, or t
  misc_feature (19)..(20): n is a, c, g, or t
  misc_feature (42)..(42): n is a, c, g, or t
  misc_feature (45)..(45): n is a, c, g, or t
  misc_feature (216)..(261): n is a, c, g, or t
ctttgatccnatttttttnngatatagaaataattaccttanggnatacagcgtattttttattggagaagtcaatcgataataagatgtcgaactcgaggttgggattaagggtttatattgggtgtacagctaaattttttttaggtttttccaacctttaaaatttttcttgatttgagggttaaaccgggggggggggcgcgcgtggggggnnnnnnnnnnnnnnnnnnnnnnnnnnnnnnnnnnnnnnnnnnnnnngggggccc

SEQ ID NO: 9451 - DNA, 79 bp, Diabrotica virgifera
  misc_feature (7)..(78): n is a, c, g, or t
ggggggnnnnnnnnnnnnnnnnnnnnnnnnnnnnnnnnnnnnnnnnnnnnnnnnnnnnnnnnnnnnnnnnnnnnnnnnt

SEQ ID NO: 9452 - DNA, 754 bp, Diabrotica virgifera
  misc_feature (562)..(652): n is a, c, g, or t
cctgccagtagtcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactgggggtgtcgtgggacggtcctacccggggggcttaactcggaaggggaggtcccaagttcattc

SEQ ID NO: 9453 - DNA, 488 bp, Diabrotica virgifera
  misc_feature (31)..(77): n is a, c, g, or t
  misc_feature (96)..(126): n is a, c, g, or t
taaattttgttatgagaatttaataaatgcnnnnnnnnnnnnnnnnnnnnnnnnnnnnnnnnnnnnnnnnnnnnnnntttcaaaccaaaaagtcannnnnnnnnnnnnnnnnnnnnnnnnnnnnnngaatatattaacaaatacaacaaaaaataaggggggacacttcaaatagcgccatcatatatcacatctttatctgatgcaaaggctcgtgatacgtgtcctgagatatcttatttctgtggagaagatatctaatatatctacttcgtaaaaaatctatgtgctcaaccgaaaaatttctattcatttcaaaatgctcaatttccagcggtgatcttatttaaataatccctacccataacgctccgcttctcaaatagaaattaagaccacctactgcacttactctataccatgatgcgcgcattattttgatatatgattgtcatttttttttgcaggaagctattgatcatcataca

SEQ ID NO: 9454 - DNA, 174 bp, Diabrotica virgifera
  misc_feature (3)..(82): n is a, c, g, or t
  misc_feature (85)..(107): n is a, c, g, or t
  misc_feature (109)..(145): n is a, c, g, or t
  misc_feature (147)..(147): n is a, c, g, or t
  misc_feature (150)..(151): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnatnnnnnnnnnnnnnnnnnnnnnnngnnnnnnnnnnnnnnnnnnnnnnnnnnnnnnnnnnnnnantanntattttttgatcaattttttgat

SEQ ID NO: 9455 - DNA, 165 bp, Diabrotica virgifera
  misc_feature (98)..(149): n is a, c, g, or t
gtataaatataagtctcgccggccactgattaatttgatggccgcgtatttgaccgtgctaggtagcatatcattagttttttattgaagctggatgnnnnnnnnnnnnnnnnnnnnnnnnnnnnnnnnnnnnnnnnnnnnnnnnnnnntaaaagctaaattttt

SEQ ID NO: 9456 - DNA, 814 bp, Diabrotica virgifera
  misc_feature (638)..(655): n is a, c, g, or t
  misc_feature (779)..(796): n is a, c, g, or t
actattcgtcttaatatgtttgtaaaagtggcagttctagttttttgcttggtttgtcttgctgatggaaaattaccttcatacttcaaggtctgcaaacgttcggaccccaatctagacaaatgtgttacggattcagttatgactcttaaacctcaacttgcaaaaggaataccagagttagaaatcccaccattggaaccattcgatttagatacaatagttttaaaaagtggaaatgctggagtcaggatagacgcaaatttttctaagcttattgccacaggagcgtctggatttgaagtatatgatataaagtgcgatatacccaaaaacgtatttttatttaagctcaaaataccacatttagaattcaatggtgattacgacattgatatgaatgtcttggttttaaagtacaaaggtagcgggccaatttccggaaactttaccgacctggacgtacaagttagattaaaaggccacataaaaaaaattgatggtaaaaattaccaaacattcgaaaaaattttaatactgttgaaagttggaggttcgcacttaaaactgggaaacctgtttcttaatcaaaaaggtttaggagatgccacgaatcaggttgttaacgacaatgctgnnnnnnnnnnnnnnnnnntacgacctgccctagtagactctttatcagacaaattcactttaatagcgaataaaagtgtgtagaatgtttacttatgacgagctgttcccaatgtaatctctattaaagtgatacatgagtnnnnnnnnnnnnnnnnnngatagttttttaggtaat

SEQ ID NO: 9457 - DNA, 821 bp, Diabrotica virgifera
  misc_feature (666)..(666): n is a, c, g, or t
  misc_feature (738)..(738): n is a, c, g, or t
  misc_feature (762)..(784): n is a, c, g, or t
agcgcattaacttaaacaataaaggttttatgctacttataggaatataaccagtttttatgaggaccccgctttccaaaaatgtacaggtactagaagagaaattatgtgtattattgttcaacaacaaggttatcaagtcattcaatatttgatctaagagcattaagagtgaaattgtgaaatggaaagaagtgaaattccaggattattaataggaatagatgacagtagtgggtatgcatgcagacactatctacttaccccagtattacacccaggtatttattgataattgctaaataaatagtaggttatttaatagacataaatatctttttaggtaatgatcaagaaaataagatttttaccatagtactcatgtgagaacaagaaatgtagaaaagctatttggaacctggaaaagagtttccttgtcttcaacaaggtctacaaaccaaattatatacatgtcttgcaataatatgtgctacagcagtaccttacaatctaggtaaataatgatctggtggtaaatagacatgttaatgatgtggaacaatttctaaatttttggtgacatttttttcaacaatattttgcatgagaatacattattgaatacctactcttattgtgtttgattttttgtctattatttctcanaatatcatgatcattgttcgacagccctttttgtttgagttttggtctcttgaggaatacagctccattccnatctatttcaggatttgttcttgnnnnnnnnnnnnnnnnnnnnnnncatgtcttattctgtttgttccttatatctaatctat

SEQ ID NO: 9458 - DNA, 134 bp, Diabrotica virgifera
  misc_feature (29)..(29): n is a, c, g, or t
  misc_feature (72)..(72): n is a, c, g, or t
  misc_feature (79)..(101): n is a, c, g, or t
  misc_feature (104)..(104): n is a, c, g, or t
  misc_feature (109)..(130): n is a, c, g, or t
taacagcgtaattttattggagagttcanatcgataataaagattgcgacctcgatgttggattaagtttantattggnnnnnnnnnnnnnnnnnnnnnnntgntcgannnnnnnnnnnnnnnnnnnnnnagtt

SEQ ID NO: 9459 - DNA, 275 bp, Diabrotica virgifera
  misc_feature (2)..(91): n is a, c, g, or t
  misc_feature (93)..(118): n is a, c, g, or t
  misc_feature (120)..(165): n is a, c, g, or t
  misc_feature (212)..(255): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnncnnnnnnnnnnnnnnnnnnnnnnnnnnnnnnnnnnnnnnnnnnnnnncgggggggggaacccccccccaaagtggggggggggagcccgggggnnnnnnnnnnnnnnnnnnnnnnnnnnnnnnnnnnnnnnnnnnnncgcaaaaaaggaaaaggggg

SEQ ID NO: 9460 - DNA, 719 bp, Diabrotica virgifera
  misc_feature (2)..(517): n is a, c, g, or t
  misc_feature (524)..(561): n is a, c, g, or t
  misc_feature (581)..(594): n is a, c, g, or t
  misc_feature (597)..(619): n is a, c, g, or t
  misc_feature (627)..(649): n is a, c, g, or t
  misc_feature (679)..(710): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggacc

SEQ ID NO: 9461 - DNA, 93 bp, Diabrotica virgifera
  misc_feature (11)..(44): n is a, c, g, or t
  misc_feature (49)..(85): n is a, c, g, or t
gaagggttggnnnnnnnnnnnnnnnnnnnnnnnnnnnnnnnnnngattnnnnnnnnnnnnnnnnnnnnnnnnnnnnnnnnnnnnncgagagac

SEQ ID NO: 9462 - DNA, 199 bp, Diabrotica virgifera
cggacgcgagttatcgacaaggtaatactgcctttcgcatagaaggagataaagattttactttaaggtgactgattaataagtggcgccaatatgatctaatcagccccctgtaaactttttctacgtccaatggctaacaataatatatgattacgaaaaaactaatgagcttagtgccatcgacagaggaaagaac

SEQ ID NO: 9463 - DNA, 106 bp, Diabrotica virgifera
  misc_feature (6)..(98): n is a, c, g, or t
  misc_feature (104)..(104): n is a, c, g, or t
gcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattngg

SEQ ID NO: 9464 - DNA, 344 bp, Diabrotica virgifera
  misc_feature (26)..(156): n is a, c, g, or t
  misc_feature (160)..(160): n is a, c, g, or t
  misc_feature (281)..(300): n is a, c, g, or t
  misc_feature (309)..(329): n is a, c, g, or t
aaagcttaatttttttaaagacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccanttttttttgatataggaataaataacttagggatacagcgtattttttattggagaagtcaatcgaaaataagatttgggccccccatggttggggttaagattttaaatttgggggagcnnnnnnnnnnnnnnnnnnnntggggcccnnnnnnnnnnnnnnnnnnnnntctgggggtttaacc

SEQ ID NO: 9465 - DNA, 478 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 9466 - DNA, 53 bp, Diabrotica virgifera
  misc_feature (2)..(50): n is a, c, g, or t
gnnnnnnnnnnnnnnnnnnnnnnnnnnnnnnnnnnnnnnnnnnnnnnnnngtg

SEQ ID NO: 9467 - DNA, 773 bp, Diabrotica virgifera
gaacagttccccgtctatctttttaatagtggaaaacttaacctaagatttgatgtacacaaaacaaaacgtttaatgttaaatgttaatatttagttaaaacttattaaacataatggttattgagaataaacgccgggcagatgatgctgctcttgttcccgtttctaaaaaacaaagaaatgaaatcgtccaaagaaataaaaatacttcagttcttcaagcaactgctccaagaacttcaaacctatttgcacctataatgcaattagaagggcatgaaggagaaatttttagtgtagattttcatccagaaggtcaatatctagcgtccacaggttttgacagaaaaatatttctatgggcagtatatggagaatgtgagaatatatcagttatgacaggtcatacaggagctgtaacagaaatgcactttaacacagatggatcacaaatttttacatctagcacagatcatactttggggctttgggatgtagctacctctcaaagaataaagaaatacaaaggacataccacttttgttaattgcgtacaaggggcaagaaggggtccacaactgatgtgttccggaggagatgataatacagtgaaactttgggatacaaggaaaaaaacaaaatgtgggttcaataaatactccctatcagaacactgctgtcagttttagcgatacgacagaagaaatatttagtggaggaattgataatgaaataaggggtttgggacatgcgtacatatgaactcttata

SEQ ID NO: 9468 - DNA, 518 bp, Diabrotica virgifera
  misc_feature (6)..(100): n is a, c, g, or t
  misc_feature (104)..(127): n is a, c, g, or t
  misc_feature (130)..(158): n is a, c, g, or t
  misc_feature (163)..(186): n is a, c, g, or t
  misc_feature (188)..(201): n is a, c, g, or t
  misc_feature (208)..(276): n is a, c, g, or t
  misc_feature (383)..(401): n is a, c, g, or t
  misc_feature (407)..(424): n is a, c, g, or t
  misc_feature (465)..(504): n is a, c, g, or t
taatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcnnnnnnnnnnnnnnnnnnnnnnnnacnnnnnnnnnnnnnnnnnnnnnnnnnnnnnggttnnnnnnnnnnnnnnnnnnnnnnnncnnnnnnnnnnnnnncgcggtnnnnnnnnnnnnnnnnnnnnnnnnnnnnnnnnnnnnnnnnnnnnnnnnnnnnnnnnnnnnnnnnnnnnnaagaataaattaccttaggataacgccgtatttttattggagagttcaatcgataataagattggggaccccgagggtggattaaagtttataattggggaaacacnnnnnnnnnnnnnnnnnnnttcccnnnnnnnnnnnnnnnnnngaacctgagtttaaaacccgggggggggcccggggtggggnnnnnnnnnnnnnnnnnnnnnnnnnnnnnnnnnnnnnnnncccaaaagggggcc

SEQ ID NO: 9469 - DNA, 237 bp, Diabrotica virgifera
  misc_feature (2)..(32): n is a, c, g, or t
  misc_feature (192)..(217): n is a, c, g, or t
annnnnnnnnnnnnnnnnnnnnnnnnnnnnnntacctttaagggataacaggcgttaattttttatttggggagaggttccaaatccgaaaaataaaagaatgggggaaccctcgcatgggtgggatttaaaagtttttataattgggggggaaccggcctaattttttattttaaggtttgggtgtcccannnnnnnnnnnnnnnnnnnnnnnnnngaatctgggagtttttaaaa

SEQ ID NO: 9470 - DNA, 1223 bp, Diabrotica virgifera
  misc_feature (470)..(514): n is a, c, g, or t
  misc_feature (998)..(998): n is a, c, g, or t
  misc_feature (1059)..(1079): n is a, c, g, or t
  misc_feature (1089)..(1184): n is a, c, g, or t
cggacgcgtgggcaaatatcattctgaggactttcctttcaaatatcagcaatttatttatttctcgctgatgtagagtccatgtttcactcccatatgtaacaactgggcgaataattgacatgtacagtcttaatttgatcgtcgatttgcatgaaagttggtgactggttggagcgtgccttaggaaacaaaaccgatttggtgccaacttgcgcttttgctctgggggtggatgccaccccttgtcgggggtgaaaactattttattaaaaatagccacactaatcgatagagggacaaattttaagcagaatttgttatatcaaattattaaggatcaaaaatttgaatttttcttgaaacaaacgcgatttttcataaataattcaaaaactgtaagttttaacaaaatagttatgattaccaaaattgaaggtaataaaaaatcgaatagattctttacgtgnnnnnnnnnnnnnnnnnnnnnnnnnnnnnnnnnnnnnnnnnnnnntatatatttttttcagctagtactcaaatctaagtattcaagcttaaataacgggaaaacgatgcattttgtaaaatatacttactaaacacttttgtcaaagtactcaagaatacctatcaagtgagctccagatgaagttgataacatcaaagctaagcaagtgatgatgaaaataagcgaaccctttcgaaaagaagcgaaccctttcgaaaaagtgaaaattaaaacatacgctatattaattaacagaataatttcaaaggaatttcgggaatgaagttaggattataatttaataattaaattatcaagttcgttttattacaattcaaatataacaagctaaaattgcgagcattattataacgaaaacttttttttatgtattttaaattactaaatatgggaaaattactaatcatatgcaattatatcctttatattttaaatattgtggagctataaagggtacttttactgnggccattttaacctttccgatgaaccaacccttttttttggttaacccggaatggaccaannnnnnnnnnnnnnnnnnnnncccccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttaataaaatttgtgtttctctaaaaaaaaagtgg

SEQ ID NO: 9471 - DNA, 375 bp, Diabrotica virgifera
  misc_feature (2)..(77): n is a, c, g, or t
  misc_feature (79)..(128): n is a, c, g, or t
  misc_feature (130)..(147): n is a, c, g, or t
  misc_feature (165)..(237): n is a, c, g, or t
  misc_feature (239)..(301): n is a, c, g, or t
  misc_feature (308)..(339): n is a, c, g, or t
  misc_feature (357)..(374): n is a, c, g, or t
gnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnngnnnnnnnnnnnnnnnnnncgagaaaaccctataaannnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnatccacnnnnnnnnnnnnnnnnnnnnnnnnnnnnnnnncttagggggtaaaggccnnnnnnnnnnnnnnnnnna

SEQ ID NO: 9472 - DNA, 344 bp, Diabrotica virgifera
ctctatccttctgtaagtagagagtttgaaagaactcccttccaatgggacagcagcttagtttgccggatttaccgacggaacatctacttggatgacggacaaaaacaaaattgatatctgcaatcgtagccgatgagcttatagatgataaattacattttgtcatttaataatgctcatggaagtggaggaatattttatgttgtacatcgaaaaatgcagggagtgttcgtggaaacgatacaaatggattccaaggaatatggtgtatcaagaaatatcgtaggtatactgatcataaagacctcattgcatcagaaagagacactgatatgggatga

SEQ ID NO: 9473 - DNA, 468 bp, Diabrotica virgifera
ctcgaatgtatgattatctgacttccatccttaattgtgaggttagtattagtgcttataaaatacaaaaaagggagtggtcatgctactcgctctcgtcagtacttgataaattaactaattatcttacttctagtatatactcatccacactttccaataattaagatgtttataaattcttatccgtctcatatctctataaaatattgacggtaggtaatgttgtatctttcagtatttgccctacctccattgtgtggagagcttggatatacaataaagactacaaattcactctttcatttgtgatcacgcatatacattggtggtagagcttgatccagcatttcgcgatagtcatgcgacttcctcatgattttatctctgctgctgtatgtacaatgagactggagtctctccttacttgttcgactatgctagtttgcctctgccatgatgcatagt

SEQ ID NO: 9474 - DNA, 495 bp, Diabrotica virgifera
cgggattcccgggccccccctcccgcccgcgtagcggagggttatgtttttagacaagagctcttaaagatattgaatagttctactatcgatatgaggagattgtataattgagcttctgtccaaattgtgtagtcattatttattatatgtcatcttgttcaagtacttattaagaatctatattctcacctaggcattatgattgtagtggtatcgcgaatgtttactgtattgcatctttcatatatatcggaattccctactggaagatgtgtttgttctaaatgaggattagtggcaactaagacattttgccgatcgtatgagacatgagaaaactacgcttcagagagaaacgtttcatgatactataccgtgtttctggccatatacctagctgaaggagccctaatcgcctgggtgccccctttgtaggaaggccattcgtgtaagaaaaggcgattaccccgattttggattcggagctaatat

SEQ ID NO: 9475 - DNA, 55 bp, Diabrotica virgifera
  misc_feature (34)..(52): n is a, c, g, or t
ggggattttgaccgggctaaggtaatcataatcnnnnnnnnnnnnnnnnnnnaaa

SEQ ID NO: 9476 - DNA, 865 bp, Diabrotica virgifera
  misc_feature (767)..(781): n is a, c, g, or t
atgattataagaacgataaggaatattctagatcgatagcagtaaattatatataaatctttgtccaaattgtgtcgtcattcaaaacaaactgtgagattgtttagatacatatagtgagtccatattagtacctaatattattaaagtgtttttattgtgaaaaattactgtttgtatatttgtttaaaatggaatttccacatttaggcaagcattgttctaaatctgactgtggtaaattagactttttgcctatcaaatgcgacgcttgcaaacaactcttctgtgaggaacatttcagctacaatacacatagctgcccatatgcataccagaaagataaccaagtgcctgcgtgccccctttgtagtaggcccattcctgtgggaaaaggggagcaccccgattttgtagttggtgctcacatagacaacgattgtcaatcagatccagcgaaaaatcgccgcagtaaagtgtttactaataggtgttcctacaacaaatgtaaaacgaaagaactgttaccatttgtttgtcaagactgtagtaaaaacttttgtattaaacatagacatccctcggatcatatctgtgaaggcaaaaaatcaaaaatatccagcagaaacacccacatgcaaactatgatcagtgaagatgaggctctagctcgagctctagccctttccatgcatgacaatgcaccaatggagtagaagaagacaggaagaattagatatggctctagcaagacaactacaggcctnnnnnnnnnnnnnnncacaggacctagtcgaaagtcagatagatgccatgtgtcatgattttttatggaagatcatgatttttacaaaaatatatactt

SEQ ID NO: 9477 - DNA, 733 bp, Diabrotica virgifera
  misc_feature (3)..(16): n is a, c, g, or t
  misc_feature (21)..(268): n is a, c, g, or t
  misc_feature (270)..(534): n is a, c, g, or t
  misc_feature (541)..(578): n is a, c, g, or t
  misc_feature (598)..(611): n is a, c, g, or t
  misc_feature (614)..(636): n is a, c, g, or t
  misc_feature (644)..(666): n is a, c, g, or t
  misc_feature (696)..(727): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9478 - DNA, 806 bp, Diabrotica virgifera
  misc_feature (677)..(677): n is a, c, g, or t
cggacgcgtgggcaaagacaaaaatattatgtatttttggtgtgttaagaatttttattctacacaataatttgcttaacaagtatgttttactgtaaagattgtaacttgaaaccattctcgtctcagtctgctttagttacacacagaaatgcagtacatggtgctgtacgtgtccaaacgtaccccatagatgttcatgccaataaatgtttagatggatgtttaatttcatttccaacagtaaaagatttaagacaacatttagcccgaatccacaagatattaacaggacaagaaattttcgaatttgatgacaaggatgaatttctaaaatggatggaaaatataaacagagatccaagacgtaaatacatcaaaacatgtgaactacaagacaatgaatacttgttggttacccattatgactgcaaacctataaaagattccatatcaaatgatgaagattcagataattcatatgccattcaagaagatggcgaatctccatcgtgtactagccagatattagttgtaaataatttaagaacaaatttgatagtggtaacatttttcaaaaaccattatggccacacgaaagatatgggtcacttggaaaagccagtcagttatgtatgcaggaagtcgttgagttgtgtttctaaaaacttacttanaacacctgcacaattgcctgttagggttacaaatgctggtgatgaacttgtagaaacagacagaaggaaaacacagttcagtgaatttaatccccagcacaaaaagagaaaaaaacgaatggttcaagt

SEQ ID NO: 9479 - DNA, 997 bp, Diabrotica virgifera
  misc_feature (840)..(861): n is a, c, g, or t
  misc_feature (932)..(950): n is a, c, g, or t
  misc_feature (961)..(992): n is a, c, g, or t
caaatctgtaatgtcaataccgcaactgtcaaataaatgttaccaatttatgccaatttatacctttgttcaatcgcagttagagtgtaatccgaacaagtgtgctttataaaaacgctttatattccacttatacagattaaacgaaacaagttagggtatatttctttatatttaaattaatagaaatctttcaatattatttctacgcgtatataataaaatatgtctagtggctgtaattccagtgtaccctgctaaacgattctaaaaaggaacacacctacgacttaaataatcgtgtgacgtcacgtgctataacgcggatgacgtgcaacggtgtctatattgtacggactgtattgaatgtgttaagtgtgtttaatatttaatattccgataactaatcgaataaaggattacagattacggtaaatatttattaaacatatatgattacaaacttttgtacatgttttattttagaccgtgacaagtgctctgatctgattgacgttgacaatgtgacaaatacactgacacctaaaggtgtgttcacactatacactaaacaaagtgttcaccaggtttcgcgtggtaaattgaaaacaaaacgtgactttctgttatgcaagccatatttttgttgaattcaacattttattggtcaccatttatgattagttaactagtaatttgttatgttgaatttggttatgcgatatccgataagaacttagcctctccgccctagtgcgtcactattgcaagggatatataccatcgtataatacattcttgtagaccgcctatgtcaaaatctgagccaaatcgggactnnnnnnnnnnnnnnnnnnnnnngaaaaacatacaatccccatccacccccgcagggttattaaaaggagtagtaacgtacccaaaaattccgnnnnnnnnnnnnnnnnnnngagggaatatnnnnnnnnnnnnnnnnnnnnnnnnnnnnnnnnccctt

SEQ ID NO: 9480 - DNA, 191 bp, Diabrotica virgifera
  misc_feature (16)..(36): n is a, c, g, or t
  misc_feature (48)..(90): n is a, c, g, or t
  misc_feature (93)..(156): n is a, c, g, or t
  misc_feature (160)..(189): n is a, c, g, or t
aacccctatatgaggnnnnnnnnnnnnnnnnnnnnngtttttttaagnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnntccnnnnnnnnnnnnnnnnnnnnnnnnnnnnnncc

SEQ ID NO: 9481 - DNA, 132 bp, Diabrotica virgifera
  misc_feature (7)..(30): n is a, c, g, or t
  misc_feature (36)..(84): n is a, c, g, or t
  misc_feature (92)..(131): n is a, c, g, or t
cccctannnnnnnnnnnnnnnnnnnnnnnncaaggnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnc

SEQ ID NO: 9482 - DNA, 171 bp, Diabrotica virgifera
  misc_feature (2)..(89): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggataaccggggaaattttttttgggagaggcccaaatcccaataaaaaaaattggggccccccagaggggggga

SEQ ID NO: 9483 - DNA, 771 bp, Diabrotica virgifera
  misc_feature (189)..(221): n is a, c, g, or t
  misc_feature (437)..(463): n is a, c, g, or t
gaattagaaagctcatacggacctccaccccaaaaagcgcttagcgattcgtatggtgctcctttaaatacagtaacaggatcagggggtgttgtaagcgcatctggtgaagaagcccatgggcatggacaacatgacctatcacatcacgatcatcaatccaatgttaatataggcttttcagctctnnnnnnnnnnnnnnnnnnnnnnnnnnnnnnnnngagtataggatacgaaatattccctaatggagcagccactatcttgggaggtcaaccctctggctcatacaaaccaccagtacaatctggcaattcttatgcttcaggacattcttatagtacgtcatttggctcctcccagcattctcatggttctttcagctcccatagaggcagtggatacaaaggattatccttttcatcttctggaatcgnnnnnnnnnnnnnnnnnnnnnnnnnnngtgctcctagtggttcttatggaactcctctattttcaggtccaaaattaggaccacccaaacattccaatgcaggttttctgactaacacctttggatcaaacggccactctgcaatctcataccagaatgttaaccatggaacgtcttctggcaccacgagctatcatgcaccattaaacatagttgatggatcttataatcaacatcaaacaggtccattgcaaggtggcaatttatacagttcaagtcaatcacatggttccagcccattcaagtggtgggaatgaaatagtatctctccacta

SEQ ID NO: 9484 - DNA, 684 bp, Diabrotica virgifera
  misc_feature (238)..(259): n is a, c, g, or t
catcgcttgacgaagaatgtttactaagttagtggttttattcttcctttatacgttcgtgtctgcaagaacgccatgcagaatttatgaatccgttaataaagagaatattagaaattgtttacagacaagacttggagatgttaacgagacaagatttactgttccaaacaccaacgaaactaccttcagtatttccaacttaaatttcaaaatatctaacaacaccctcaacatnnnnnnnnnnnnnnnnnnnnnncgaatcggaagaaaaatgaagcaatccactgccaacttgctccaatatgcccttgtacctgccttcttcatgtccggaatgatgccatggatcatgcccaaaatccagatgatggtgatgatgctgtcgatgatgaacaacatgatgtttagtagtgctctgtttaccatgatacgaaactatgtttttgagaaaacaccgaatgaacatgtagtctatgttaataacggattcaaaaataggatacatacacgttatagctagtaaggagaatatatgcgtgttatagataattaatagaactattcgatacctgaagcattgtttgagaacttagcttgaacagatcttatttggtttttatagggttgattattataatcaacagttaactaatcgcttaaattattttttactaatacgta

SEQ ID NO: 9485 - DNA, 1124 bp, Diabrotica virgifera
  misc_feature (14)..(45): n is a, c, g, or t
  misc_feature (57)..(119): n is a, c, g, or t
  misc_feature (122)..(591): n is a, c, g, or t
  misc_feature (731)..(751): n is a, c, g, or t
  misc_feature (770)..(785): n is a, c, g, or t
  misc_feature (787)..(825): n is a, c, g, or t
  misc_feature (829)..(864): n is a, c, g, or t
  misc_feature (868)..(975): n is a, c, g, or t
  misc_feature (977)..(1073): n is a, c, g, or t
  misc_feature (1095)..(1112): n is a, c, g, or t
ctccccccgggccnnnnnnnnnnnnnnnnnnnnnnnnnnnnnnnnttctggaaaagnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaataaagggattccgcaacttttttttccccggttaattaaaaactgtctttttggattaaatataaaggatcccctggcccctggttaattttgaagggcgcgggatttttaccccggcttaaggaacctaaacnnnnnnnnnnnnnnnnnnnnnctgggaaggaagggtgggnnnnnnnnnnnnnnnncnnnnnnnnnnnnnnnnnnnnnnnnnnnnnnnnnnnnnnnaagnnnnnnnnnnnnnnnnnnnnnnnnnnnnnnnnnnnnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggggggaaaaccgcgcgcnnnnnnnnnnnnnnnnnnaggggggtccca

SEQ ID NO: 9486 - DNA, 482 bp, Diabrotica virgifera
  misc_feature (52)..(53): n is a, c, g, or t
aaactgctgggtagtagattgtcccccaacagtttacctatgcagtttttgnnatttccaggtcgctactcaactagttagtttattactgttgcataatatattatctgtactttgggcatcagcgatgattgattaataattatatagttattaacctcgcgttatatatgagcttcaagaatcaaagatttaaaggaaaaaaacgagatgctgtgcaatttttaggtatggaaggatattcgtttttaagttatagatgatgttcgagaaaatggataacgtttcgatatcagctatatgttgtactcgtgatgaatttttatattatgaatatctaagagatgaagggatcagattataaatgttgctttatcaggtgaaaactattgcgtcacacttaggattacagattcttgtatttcacaacatgttatgatccattgacatatatttgcattttaattctccatcattgtttt

SEQ ID NO: 9487 - DNA, 251 bp, Diabrotica virgifera
  misc_feature (2)..(37): n is a, c, g, or t
  misc_feature (45)..(45): n is a, c, g, or t
  misc_feature (211)..(247): n is a, c, g, or t
tnnnnnnnnnnnnnnnnnnnnnnnnnnnnnnnnnnnnaccttagnggatacagcgtatttttatttggagagtcaaatcgataataaagatgcggacctcgatgtttggattaagtttataattggtgtagcagtatattaaataaagcctgttcgacttttaaaattttacatgaactgaggtaaaaccgtggggggccccagggtgggnnnnnnnnnnnnnnnnnnnnnnnnnnnnnnnnnnnnngggc

SEQ ID NO: 9488 - DNA, 796 bp, Diabrotica virgifera
  misc_feature (134)..(151): n is a, c, g, or t
  misc_feature (329)..(364): n is a, c, g, or t
  misc_feature (583)..(583): n is a, c, g, or t
  misc_feature (636)..(636): n is a, c, g, or t
  misc_feature (690)..(690): n is a, c, g, or t
gagatacagaacatgaaagatgaataaaaggaaattaataatcatatcttggatatattatttgcttacagaaaagtgttattggtgtgcataaaatataattaactatttagatgggaaacaagccacaaccnnnnnnnnnnnnnnnnnngtattaacgctccaacggccaaatcgggtgtcgttgtcaaaatacaaaatactaccaaaccaaacaaaaatgttgttgcttagtaaaaaaaagaatgtgtgtgtactttgtacgcacgtaagaagttatacttctctattatgatttcaacaaaatcaatatatctactttaaacagnnnnnnnnnnnnnnnnnnnnnnnnnnnnnnnnnnnnctagaaagaactaaaagaataccaaaaaaaaatgcattgtccgggattcgaacgtgggaccttccgatctctaggcgaatgctctatcgacgagctaccgaggttacccatacgtacgattatttctcggtcataataatgacaatcgcggtgacacatagataattgaataaagattttcgataatatttattaccgtactcccaaagtaccgtactnaaaacactaatatattcttttcacgcacaccttagttgcgctacataatttanaagatttagcgactaacaccatactgtcgctgtgcgcatgcgccggtaacgttnaaatttcaccctcaatcgcgcctaaagaagtataacttcaaaaaatcttctaataattaaccccatctgacccacttataccggcaactcagacacatattacaca

SEQ ID NO: 9489 - DNA, 882 bp, Diabrotica virgifera
  misc_feature (38)..(62): n is a, c, g, or t
  misc_feature (202)..(281): n is a, c, g, or t
ggttcgcgctgcgatttttatttcaaattcgatgcgannnnnnnnnnnnnnnnnnnnnnnnnctccattcgtcagtagatttttaaaaagttcgcggtttgtagtgattctatacggaatagaactattcgcgagtcaagaatggtgctattttcgacgagatcagagatggatgacacgatgccacagactgtaccatcannnnnnnnnnnnnnnnnnnnnnnnnnnnnnnnnnnnnnnnnnnnnnnnnnnnnnnnnnnnnnnnnnnnnnnnnnnnnnnnagtctcaccatctactcaattctacccccaaagttacgagaccgaaaagctacttcaaccaaaaatattaacaagtttttatccatcgccgagatccgatccggaatcagatctggaacaactagctccagattttcagactctattggtaccgactgatacgaaaaaatattctggaaatatttacttggaggttccgagtccgtactcaccgatttcacaagggcttttatcgccaaacgaccagttctctagctacagagaaacgaattactatccaagttccccagagcaatctgtatatacgccctctcctagttctgtttattctacatcaccttgcggtgaagaatatcttcagaaacactacataaaaaaagaaacctcacctgtgcccaactttgcccaattttctgtaaaagaagaatcttatatcttgccgacaagtcctgcctcatacacttctaattcttctgataacctttgcatacaaatcgataaattcgaatgtcctcgatctgctcagaacagtaggaagtcaaaaagagatttaaaaagagccgctgaccctttttggtagttttcaaagggatcaaacact

SEQ ID NO: 9490 - DNA, 957 bp, Diabrotica virgifera
  misc_feature (808)..(808): n is a, c, g, or t
  misc_feature (871)..(872): n is a, c, g, or t
  misc_feature (876)..(876): n is a, c, g, or t
  misc_feature (884)..(884): n is a, c, g, or t
aaagattagaatgggaagaaaaaggtataaaaatttgtggacaacgcttgaaccatctaaggtacgccgatgtcatcgtattgataaccgataaaaaagaagaattgtttgaaatgatgaaagaactggacatagaagccggaaagataggccttaatatgaattacagcaagaccaaaatcataacaaatacagatgaggacatcacaatgaggatcggacaagatgaaatagaacaagttcacgattatatatatctgggtcaaattataaaacttaacaaggaaaaccaaacagcagagatcaaaagacgagttagactggcatgggcggcatttggaaaactaagctacatccttaaaaacaaaagatatccacaacatcttaagaccaaggtatacaatcaatgcgtactccctgttctcacttatggttcacaaacgtggacgtttacaaaagcaaacatggacaagatcataaagacgcaaagaggaatggaaaggcaaatgttgcacataaaactattggataaaaagagaaacgagtggataagagagaaaaccaaagttagggatgttagacaagaagttgcaaagttgaaatggagatttgccggacacactataagacaaaaggaagaccgatggaacaaaattctcataaattggagaccgtggcaatataaacgaagcagaggaagaccacaaatgagatgggcggatgatgtcaagaagcacgttggctctaggtggataactgtagcgacagacagagaagaatggaaaaggattggggaggcctatgtccnaagatggaccgaagaaggctaattagatagatagaatgctattccactgcatatatttaattnngcanttatattnctatgattttttgtaactctacaggcatctacccgcatttttttaagaatatatttatgaaataatagtcatt

SEQ ID NO: 9491 - DNA, 716 bp, Diabrotica virgifera
  misc_feature (25)..(25): n is a, c, g, or t
  misc_feature (46)..(439): n is a, c, g, or t
  misc_feature (441)..(496): n is a, c, g, or t
  misc_feature (503)..(540): n is a, c, g, or t
  misc_feature (560)..(573): n is a, c, g, or t
  misc_feature (576)..(598): n is a, c, g, or t
  misc_feature (606)..(628): n is a, c, g, or t
  misc_feature (660)..(682): n is a, c, g, or t
tcccttaagcccggataatattagnatgaaaaaattggatattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgaagcccaggttggttnnnnnnnnnnnnnnnnnnnnnnngtttagtacgaaaaggaccaaaaatataacataa

SEQ ID NO: 9492 - DNA, 884 bp, Diabrotica virgifera
  misc_feature (107)..(124): n is a, c, g, or t
aaatcattacctactgattacgtttaaaatgagtatttagtcattaacttatatttagtaattaacattattaaaagttattaatacctgctttttaatctcagagnnnnnnnnnnnnnnnnnnagatttaatttcaaaatttaagttattaaattttctgcgcaaaaataagcgaacctataaactcagtttttgtgctcttttcaaatttgtaaacggtgttttaaaatttcaatatacagggtgttgcttcaaggtcacaattcctttatgcttttttgttaatccggacctggatttttcttgtgattagtaaatgggtcgttctagtgtagtaaataagtattgcttacttttaaaatgagtacctatttgttcattaactttaatagtttattatcaaaagttaataatacctgctttttaaactaaagagttcttaaaaacttcgatattatttcaaaataaaagtcattaaattgtctggccgaaaaatttaagcgaaccattaaacttagttttttgtgctcttttcaaatatgcaaacggattttaaaaatttcaatatacacggtattgtttcaaggtcagaaagaatttataatcttttttagtccggacctgcattttcttgtgattagtagttcgatggtttgtgtttgaagtgagacatgtgtgccaaatgtcaaaaaaatatacagggtggttctagagttgtgggtccagaaaaaaatgggcaaaatcgataaaacaccctgtaactcggatataaaaataggtaaggccataaatgtggaatatctggaaccgcctcagtggacatctattccccctttcaaggattttccggttccccatgaaacaccctggattaaaatggttt

SEQ ID NO: 9493 - DNA, 912 bp, Diabrotica virgifera
  misc_feature (855)..(855): n is a, c, g, or t
  misc_feature (861)..(861): n is a, c, g, or t
aaacacttccagttcctcgactttatttcgtatagaacatatgttgtataaaataatagaaaatttacttacaatattcgattcagatatactggtatccagtttatcacctaccacacttacaatattatttacaaaacaactgtttggtgatgataaaagcaccgtttctattggatttacttgactaaaaaagagtctggtctatcttctccagttgacagacctctattgtgatgctctcgatctaaaaatcttcttcctaacctaaagttaaatcgttcgatgccaatttttttcggccaaaaagcaggattgtaaatttcttcccttaagtcgggtagtacacctatcatgaaacattgattatcccttcttttcttttcagttggtaacaattttacttgtatatcctcacagtttgtctcagttattatgaaactcttgatgtgatccgcatttacactatccggaacttttgagatgaaaagccacaattttttgtctggtttttcggattttccatggaaatccttatcaccaattccagttcccattattttcttgcgtctttttgtcacaatctgatatccttcatcgttcgttttattctctgaactccccattgtgatataattaagattcatttttgtgctttcttcatttttaacagttaaatttgtaatgtattcacatgtctgtttggtttgaatttccattatttgtgcatttaattcgtttgtaataatttttgaattgccctgtatattgttgacatctgattgaattggttgtttatatttattttcgatgtttttattttctgggcaacacacatgtctgggtatatctgtncacccncattttatgtcctaactacttgcatgatgcagtctgttcaatatcccttct

SEQ ID NO: 9494 - DNA, 54 bp, Diabrotica virgifera
  misc_feature (4)..(4): n is a, c, g, or t
  misc_feature (10)..(53): n is a, c, g, or t
attnttttannnnnnnnnnnnnnnnnnnnnnnnnnnnnnnnnnnnnnnnnnnng

SEQ ID NO: 9495 - DNA, 508 bp, Diabrotica virgifera
  misc_feature (21)..(21): n is a, c, g, or t
  misc_feature (30)..(30): n is a, c, g, or t
  misc_feature (32)..(32): n is a, c, g, or t
  misc_feature (55)..(55): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (80)..(81): n is a, c, g, or t
  misc_feature (95)..(96): n is a, c, g, or t
  misc_feature (98)..(98): n is a, c, g, or t
  misc_feature (100)..(101): n is a, c, g, or t
  misc_feature (105)..(107): n is a, c, g, or t
  misc_feature (121)..(121): n is a, c, g, or t
  misc_feature (140)..(140): n is a, c, g, or t
  misc_feature (148)..(148): n is a, c, g, or t
  misc_feature (154)..(154): n is a, c, g, or t
  misc_feature (158)..(160): n is a, c, g, or t
  misc_feature (162)..(163): n is a, c, g, or t
  misc_feature (165)..(166): n is a, c, g, or t
  misc_feature (170)..(171): n is a, c, g, or t
  misc_feature (180)..(180): n is a, c, g, or t
  misc_feature (184)..(184): n is a, c, g, or t
  misc_feature (205)..(206): n is a, c, g, or t
  misc_feature (208)..(208): n is a, c, g, or t
  misc_feature (221)..(221): n is a, c, g, or t
  misc_feature (230)..(230): n is a, c, g, or t
  misc_feature (238)..(238): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (248)..(248): n is a, c, g, or t
  misc_feature (262)..(262): n is a, c, g, or t
  misc_feature (269)..(269): n is a, c, g, or t
  misc_feature (277)..(277): n is a, c, g, or t
  misc_feature (286)..(286): n is a, c, g, or t
  misc_feature (297)..(297): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (314)..(314): n is a, c, g, or t
  misc_feature (326)..(326): n is a, c, g, or t
  misc_feature (328)..(329): n is a, c, g, or t
  misc_feature (331)..(332): n is a, c, g, or t
  misc_feature (337)..(337): n is a, c, g, or t
  misc_feature (343)..(344): n is a, c, g, or t
  misc_feature (347)..(347): n is a, c, g, or t
  misc_feature (349)..(349): n is a, c, g, or t
  misc_feature (359)..(360): n is a, c, g, or t
  misc_feature (365)..(366): n is a, c, g, or t
  misc_feature (368)..(370): n is a, c, g, or t
  misc_feature (376)..(376): n is a, c, g, or t
  misc_feature (380)..(380): n is a, c, g, or t
  misc_feature (402)..(402): n is a, c, g, or t
  misc_feature (408)..(408): n is a, c, g, or t
  misc_feature (413)..(413): n is a, c, g, or t
  misc_feature (415)..(415): n is a, c, g, or t
  misc_feature (418)..(419): n is a, c, g, or t
  misc_feature (424)..(424): n is a, c, g, or t
  misc_feature (430)..(431): n is a, c, g, or t
  misc_feature (433)..(433): n is a, c, g, or t
  misc_feature (452)..(452): n is a, c, g, or t
  misc_feature (466)..(467): n is a, c, g, or t
  misc_feature (473)..(473): n is a, c, g, or t
  misc_feature (481)..(481): n is a, c, g, or t
taacaccggtccgaataattnttgaagatntnaattgatccccttagaagaaggngtnatntgngtatntgatattgttnnatatattgtggaannanannattnnntaatattatatagnaatgaaagtttgttttttnaataaatntatatntgtnnntnnanntttnnttgtatggnaggngaagttggtggtatttaggtnntntaattatatggtngaagtatantgtttttntntgnttnantgattagatttaantaatgtntggagatntgatttttntggaaaatagntttatngtnagnttatngttgattaattntnngnntagtnttattnnttntngtttgtgatnnaaagnntnnntaaagntttntttagagtatagattaaaaaangggggnaaaananaannccgtngtaatnnangtttgataggtagtttttnagtatgaataggtnnaatttnaagagaanatatttgattgtaatataagtatttta

SEQ ID NO: 9496 - DNA, 867 bp, Diabrotica virgifera
  misc_feature (629)..(647): n is a, c, g, or t
ccttttgcgtccggagaattttctttactttatagaaggctgctctggctttttcgatgcgtattcttatttctttgtttttatctcagttactccgatgcttcgaggggcataaggagtgtcgagaaagaagaagatatcccagttatcgttaactttggcacccaaataggtgatattttggactctttctaactttattccatacaacaaccataaatttggtcttgaagtattgttttagcccatattaaacacatgtttcggtcatcctgtttgtaagtcgttaaactctttggaagcaattagtaccgtgtcgtcttcgtaactgagatggttgacattaattccgttgattttaatgcttgcatcttcatctaaggcttctttgaaaataaattttgagtatatattaaacaatagaggcaatataatacacccttgcctcactccacgttgtatttccactgcgtccgtcgtgttctggccaactggtatgtttgcacaaggatgccaatacaaatttttgataataccgaggtcttcgtcatcaattcccacttcttgcaagccacctatcagtttgtcgtggatgaagtgtttgcatttaattccctttttgatcactnnnnnnnnnnnnnnnnnnntattatcgataagttgtcattttgacaaccatattatgtcaagtgattaaaaagcagcttaacacattgattgttaacacgaagtgaacattattaacacattcgcggtcatgactgcatatgaagtcatttactccataagaatacgtgtataaaatgacagcgtggtcgcgaacgtgttaagaaggttgacttggtcatatcactttcccaaatcaaa

SEQ ID NO: 9497 - DNA, 795 bp, Diabrotica virgifera
tctcactgggccgcggaaattttaagagatcattatcgtatgtctatttgaaaaaagagatagagagtttgatgcccattagggaaaagattgagccggccaatgaggatcgtaagatgtgtagcgttaggaaacattcgaagagttttcggcattttccaaagatcgtcgtgcatcctccagatgaaactaacttgtcgagtagcatgccgaatatccacacgtttgtccacaacgacatgaatgatcttatgattaaccacgtgtttgatcagaatgcatcttgtcctgatctaacagacgataggtatttcactaatgataacactagtattgatacagacgatgttttcgaaagtttcgatgagtttgcagaaaatatttctgtctgtagcgagagttgtataccggatattaattttaaagacttcggtgagactcatactcggaaatataattcgttggctgaagccagaaacttctttgtcatagaacccggtaagtagcaaaccaagactaataccactgcctaaacgcacaaagaaggacgaaacgccctagtgactatctaaaacgcaactggaaggaaaaactttctgcttcaatgcctaaattatataaaagacaaaacactgaaccatccttcgaaacttatataacaccacggtgggatgaacttcaccaaccacttttcccggattaaccacatttccatcacctccaccttttcgatccttcctttgcctccttacgctagaacccgcagccccttgaacatggttttcacgggaagtt

SEQ ID NO: 9498 - DNA, 542 bp, Diabrotica virgifera
  misc_feature (17)..(17): n is a, c, g, or t
  misc_feature (25)..(27): n is a, c, g, or t
  misc_feature (52)..(79): n is a, c, g, or t
  misc_feature (81)..(82): n is a, c, g, or t
  misc_feature (90)..(91): n is a, c, g, or t
  misc_feature (101)..(106): n is a, c, g, or t
  misc_feature (111)..(111): n is a, c, g, or t
  misc_feature (114)..(120): n is a, c, g, or t
  misc_feature (122)..(122): n is a, c, g, or t
  misc_feature (129)..(131): n is a, c, g, or t
  misc_feature (143)..(144): n is a, c, g, or t
  misc_feature (148)..(148): n is a, c, g, or t
  misc_feature (150)..(150): n is a, c, g, or t
  misc_feature (156)..(157): n is a, c, g, or t
  misc_feature (166)..(166): n is a, c, g, or t
  misc_feature (183)..(184): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (204)..(204): n is a, c, g, or t
  misc_feature (207)..(208): n is a, c, g, or t
  misc_feature (219)..(219): n is a, c, g, or t
  misc_feature (231)..(231): n is a, c, g, or t
  misc_feature (240)..(241): n is a, c, g, or t
  misc_feature (243)..(243): n is a, c, g, or t
  misc_feature (251)..(252): n is a, c, g, or t
  misc_feature (258)..(258): n is a, c, g, or t
  misc_feature (268)..(268): n is a, c, g, or t
  misc_feature (274)..(274): n is a, c, g, or t
  misc_feature (282)..(282): n is a, c, g, or t
  misc_feature (286)..(286): n is a, c, g, or t
  misc_feature (301)..(303): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (333)..(333): n is a, c, g, or t
  misc_feature (361)..(361): n is a, c, g, or t
  misc_feature (369)..(369): n is a, c, g, or t
  misc_feature (383)..(383): n is a, c, g, or t
  misc_feature (390)..(390): n is a, c, g, or t
  misc_feature (394)..(394): n is a, c, g, or t
  misc_feature (396)..(396): n is a, c, g, or t
  misc_feature (402)..(403): n is a, c, g, or t
  misc_feature (406)..(406): n is a, c, g, or t
  misc_feature (429)..(429): n is a, c, g, or t
  misc_feature (442)..(442): n is a, c, g, or t
  misc_feature (448)..(448): n is a, c, g, or t
  misc_feature (450)..(451): n is a, c, g, or t
  misc_feature (463)..(463): n is a, c, g, or t
  misc_feature (472)..(472): n is a, c, g, or t
attacaagggtccgcgntgttggtnnntgttgggtggggtggcccttgcaannnnnnnnnnnnnnnnnnnnnnnnnnnnanngaaaaagnngggggggaannnnnnaaaanggnnnnnnnanacaaggnnnaaaaaagagacnncgcngncaaggnngcggccggnaaggcacaaggaaaagnngnagcggncangggcgccgncgnngacgcacaacncgaagaagaacnacccccaanncnaaaggcannggaagnacaaaaccgncaaccnaggcgggncccngaagccgcccagcannngggagagaacacagnccgnacnanggcnanggagggcaccgaaggcaccggccgcggncaacaggncaacgacacagganacccaanccgnancccggnnggngaagcaacccagggccgaaacangaacggcaaaggngaaccnanngacgaaaggggncccaagganacagacaagagagcaaccacccaccgcagaagccccggaaaaccgagacaagaacgaaaagcaaagaaac

SEQ ID NO: 9499 - DNA, 907 bp, Diabrotica virgifera
  misc_feature (498)..(498): n is a, c, g, or t
  misc_feature (658)..(683): n is a, c, g, or t
tgaaccagtcctgcccgcgtgccccagtcccctaatacactccgtgatcacgctccaataagcgctcggtctcacgacccaacagaagacatctcgacactctaccttctaacacatcgccggattccgtcgcgtcctacccaaagcgtgatccccgtctgcgcggactgtgagcaacccggctcgccccagtacgctggcgctcgcccactatctctcctttcttttggctcgcctatctgctgggacgctggggggggccatcccgacattcacgcttctggtggggccatcgctgccgccgatggtggtctctggggttggcaggtccgctacgcttcatggtctcctgcttaggttccttcgtttggtctcggtcccggcggctctaccggtttcacgcagccggatcggagcctattggcccttcccaatctatccgtatgactggccagttctggagctcactgtggagaacagcgcccattccctcagccncggggcgggcgcgctggcccggccctccccccgcgttccttcccgttggatatggatccgctcgctggcctcattccctggcagttgggcggcggcccttgctttcccccctacttgccccctcctgccggcgggcccttcccccggcttacgtccgccnnnnnnnnnnnnnnnnnnnnnnnnnntcccgggcccctcccctgtcgccgggccccgggaacgcgccgcccccccttctccttcctttccttcctcttcgcgccgtcttatcgttacactctctcccgtgtctcctcccacgccggcctccgggccctccccctcccccttggcttccctcttcggggctctcttcccttacgggcggttcgccgccccccccacgcggctcccctcttgttccccctct

SEQ ID NO: 9500 - DNA, 1250 bp, Diabrotica virgifera
  misc_feature (600)..(600): n is a, c, g, or t
  misc_feature (653)..(670): n is a, c, g, or t
  misc_feature (758)..(785): n is a, c, g, or t
  misc_feature (791)..(820): n is a, c, g, or t
  misc_feature (889)..(910): n is a, c, g, or t
  misc_feature (1083)..(1101): n is a, c, g, or t
  misc_feature (1139)..(1157): n is a, c, g, or t
  misc_feature (1164)..(1182): n is a, c, g, or t
gtccccttcctacgtccgctcaccagttttactatcttttcctcatttctacctcgctgatgacaaatatagaactgcattggaaggagtgtccccacctgatccagaaaagcacgccttctacatggatgttcaacctgaaatgggctcagcgatgtctgctaaagctcgcatccaaatcaacttggctgtttctcaagtaatagacataaaacaagttgccacattcccagacatcattttccctatcttgtggttcgaagagggcttggattctcttccagcagagatgaccggtctcatgaaaatcgctactacagttccaccaatagccaagatcgtcatatcagtctcactgtttgtcattggaatagttctactcattatcgccatctggcggctacttagaggtgcgaataggcttagttcgcttcacctagcgcctggacatgtgggacaatcaataaagaccaaggatgtcccaatggcgaatgttccaaaatactaagacatattagataatagagacggtggttaaaaatcgttttgaaaggtggttcctggttcatgaaaaagacatttacattatacctactgttngtttgggacagagatatacttattaaagttttttaccatgctgttctcccttnnnnnnnnnnnnnnnnnnagggctatagaggtttggaccaggaaaatccttttttatttacattgaatatcataaaaattgaaaaaatagttcttaacttatttgnnnnnnnnnnnnnnnnnnnnnnnnnnnncaatgnnnnnnnnnnnnnnnnnnnnnnnnnnnnnnctatatgcggatagtgttccccttttttttctgttacttgtacttacgaaatttcccaccagtttaccnnnnnnnnnnnnnnnnnnnnnncctaaaatccgatatgggtgtgtttaaaaaataaattttggaaaacgggctccctcatcgaacttggaaacgtccgtaaaaaaaatggatttataatctctaaaatagagggtggtctttccgcggaaaaacaattaaaatttgaccaaataaatttagttcaacaaaatacnnnnnnnnnnnnnnnnnnntaaaaatgtggttttctcaaggcggtggcgggcttgtnnnnnnnnnnnnnnnnnnngggccannnnnnnnnnnnnnnnnnnctcttttcaaaaggaacagacaaatccgatacatagaaaaataattcctcacaaaaataattatggca

SEQ ID NO: 9501 - DNA, 329 bp, Diabrotica virgifera
  misc_feature (9)..(9): n is a, c, g, or t
agggctggncgggggataccggcgagctgcccactggcactggggagcgaaaactcttcacgctggacgacggcagcttgctgacgctgaacgcacagagccgggcgattgcgcgtttcgacgcacaccagcgtgtgctggagttacgggagggggagttgctggtggacgtggtcaaggacccggtgcggcccttcgtggcgcaaaccccggcatggccagattcgcgcgttgggcacccgattcatggagcagcgtgacgaagcgtccatccatctggtcgacgctgcattcgcgagtgtaagcggccactcaggacggcgcgcgtc

SEQ ID NO: 9502 - DNA, 1177 bp, Diabrotica virgifera
  misc_feature (64)..(86): n is a, c, g, or t
  misc_feature (1014)..(1045): n is a, c, g, or t
  misc_feature (1053)..(1076): n is a, c, g, or t
  misc_feature (1114)..(1139): n is a, c, g, or t
tccacagggtccggtctatgatacgaatataggtcgatctgtcttcatctgcttgccggatgannnnnnnnnnnnnnnnnnnnnnncatacatagacaaatagaattcaacctgttgcttgtttaagatgtttggttcaattctaccaaatataaatattttatgtgtcaaacagtgacgagtagttcagtaggcatataatacatgccaacgacctgtacgactttactcgtcatcgcgctcgaccgcaaagggttaagataacgtaagtactcattttcttctaaacttactattcaattgttcttgtcttccttattaaattatttgactagttttgagtgaaattgagtctaatatattgttatttttagatttttaactgaatggaacaaaagtttggggccaaaactcaattatttttaattcacaatgcaatagttactacatttacttggtgcttgcattttttattatctacttaaagtacttgtaaccatagccatcctcaatgacagactaaaatcaattctcttaccacaaattccccaagaacaatgcggaattgtcccaggtaggggaacacgagaatacattcttaatattcgtcaaattatagaaaaaccgatccctgcatattgatgtattgcctaaacacttgcgtttagaccagtacatgagtattgttggcaaatgattataggacattataagggacatcctaaaaaagtagcattacctataaatgagttctcaaccctacctctaataacgctagatcagaaccgtaaattctgaaaaattcttggatttaccttaaacaaccttaaggggccccttcgaatcgatttggtaaagaaaaaaatagcctcacctttctataaaaaaaaatctggttaacatcaaatttcaaggaaataatttagaattttcaaagaacaaaattttctttgtccgaatcccatcttcaaaataggaatccttttcgggaaagtggcccatccgaaggtaatnnnnnnnnnnnnnnnnnnnnnnnnnnnnnnnncctaaggnnnnnnnnnnnnnnnnnnnnnnnncaagtatttcaaaaaaaccgagaaatttaaaccttctnnnnnnnnnnnnnnnnnnnnnnnnnnttggtttaattccaaaaaaccccaaaagtggttttttt

SEQ ID NO: 9503 - DNA, 504 bp, Diabrotica virgifera
  misc_feature (32)..(32): n is a, c, g, or t
cggtctcccacccaagtccgaacatgttgtgntttcaataataacaaaaatctttaagattcaaatgatcttttaaattattatttgtcaatgaatatcaataacatatgtaggatatgcttggaaataggtccgaagcttatgccaatttttgatcctgtaaaaccagcacatttttcaatcctaattatggcttgtgcagcagttcaggttttacaaggcgatgggttacccccttatatatgccagaagtgtttgtcaaagcttaacattgcattccagtttaaaaaacaatgtgaatcatccgatgcaaaattacggcagtgtttcgaacactttcacaatcttcctccaactccagattttactggctttatagaactgaaaaaagataatcacaccgaagacacctttagagaaaagaatgatggaggaacgaataatataactcatatcgaaacacagaataatctttaagtggaggaaatacacaagacattgatt

SEQ ID NO: 9504 - DNA, 955 bp, Diabrotica virgifera
  misc_feature (16)..(16): n is a, c, g, or t
  misc_feature (23)..(23): n is a, c, g, or t
  misc_feature (27)..(27): n is a, c, g, or t
  misc_feature (53)..(53): n is a, c, g, or t
  misc_feature (59)..(59): n is a, c, g, or t
  misc_feature (71)..(71): n is a, c, g, or t
  misc_feature (73)..(73): n is a, c, g, or t
  misc_feature (76)..(76): n is a, c, g, or t
  misc_feature (90)..(90): n is a, c, g, or t
  misc_feature (95)..(95): n is a, c, g, or t
  misc_feature (98)..(98): n is a, c, g, or t
  misc_feature (106)..(106): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (152)..(170): n is a, c, g, or t
  misc_feature (173)..(174): n is a, c, g, or t
  misc_feature (197)..(197): n is a, c, g, or t
  misc_feature (212)..(213): n is a, c, g, or t
  misc_feature (238)..(238): n is a, c, g, or t
  misc_feature (277)..(277): n is a, c, g, or t
  misc_feature (295)..(295): n is a, c, g, or t
  misc_feature (306)..(306): n is a, c, g, or t
  misc_feature (332)..(332): n is a, c, g, or t
  misc_feature (337)..(356): n is a, c, g, or t
  misc_feature (365)..(365): n is a, c, g, or t
  misc_feature (395)..(395): n is a, c, g, or t
  misc_feature (411)..(411): n is a, c, g, or t
  misc_feature (612)..(636): n is a, c, g, or t
  misc_feature (829)..(864): n is a, c, g, or t
  misc_feature (878)..(897): n is a, c, g, or t
taaagggcgtagttgnttttttnttgntaatggattagaagaatttaataganaaaatntttgaagaaatngnatntggagaatttaaanaagtnaantataagtntttgaaattggattttgatgaaganagaaaattnatnaaagaaatnnnnnnnnnnnnnnnnnnngtnnaaagaatagaagaaggtgaaatnaagagagataatatnnatgatttatactggtttgaagtttngattcttaatgtagtttaagatttgtatggagagaattntaaagaagggttggaagngaaagaaattnttaaagaatgtattttaagagttaantatgnnnnnnnnnnnnnnnnnnnnggatatgtngatgtgattgttggaaggagtgatggaagntagaatatgatgaggnagaatgattctagttgatgatgaaagaattgatgataaaatgaaatataaattaggaagttagtaaggaaagataaagagggatatgtattcaattgtgagatttggtggagaaaagatagtgtcataatttataggagcatggaaaaatgatagtatgaatgggaaattgtgtagatcattatggagaaaaaacagcagnnnnnnnnnnnnnnnnnnnnnnnnnatgttatatttgaatttgacaattgataataaatgtggatatggattcgcactagtaggaaggtttttttaggtgtaggaggatttaattatccggaactggtaataaacgggaggtaataaatgttataggttagggggatattatgggtcacttgttttaaatggtaataccagaggaagggatggaacgnnnnnnnnnnnnnnnnnnnnnnnnnnnnnnnnnnnncatgatatgtaacnnnnnnnnnnnnnnnnnnnngaagaataaggaaagaagccatttttggtttttttttgagaaaattgttataagaaaa

SEQ ID NO: 9505 - DNA, 217 bp, Diabrotica virgifera
  misc_feature (14)..(15): n is a, c, g, or t
  misc_feature (17)..(17): n is a, c, g, or t
  misc_feature (19)..(19): n is a, c, g, or t
  misc_feature (21)..(42): n is a, c, g, or t
  misc_feature (51)..(51): n is a, c, g, or t
  misc_feature (55)..(55): n is a, c, g, or t
  misc_feature (57)..(58): n is a, c, g, or t
  misc_feature (61)..(61): n is a, c, g, or t
  misc_feature (67)..(68): n is a, c, g, or t
  misc_feature (75)..(75): n is a, c, g, or t
  misc_feature (77)..(77): n is a, c, g, or t
  misc_feature (81)..(81): n is a, c, g, or t
  misc_feature (87)..(87): n is a, c, g, or t
  misc_feature (97)..(97): n is a, c, g, or t
  misc_feature (101)..(101): n is a, c, g, or t
  misc_feature (108)..(108): n is a, c, g, or t
  misc_feature (113)..(113): n is a, c, g, or t
  misc_feature (131)..(131): n is a, c, g, or t
  misc_feature (136)..(137): n is a, c, g, or t
  misc_feature (157)..(157): n is a, c, g, or t
  misc_feature (170)..(170): n is a, c, g, or t
  misc_feature (178)..(179): n is a, c, g, or t
  misc_feature (197)..(197): n is a, c, g, or t
agtcaatggtccgnngntntnnnnnnnnnnnnnnnnnnnnnntaaacaaangaanannacncaaagnngaaaggncngaangagagnggggcaaaangganaaaaagncaggnacatgcaaacccactaanaaatnngcagccaacaatccgagagnatgaaaaacactncgcagaannagaaaaggagaaagaccnaaaacccccagaaacgaaca

SEQ ID NO: 9506 - DNA, 1056 bp, Diabrotica virgifera
  misc_feature (13)..(15): n is a, c, g, or t
  misc_feature (27)..(27): n is a, c, g, or t
  misc_feature (31)..(31): n is a, c, g, or t
ccccacagtccgnnngtttatatgtantaanaagggagccctttaaacttgtcgtacacattggttgtcattctttttatatcttcaaaattatgttaattacgatgatgtttgtgtcataccgagctggtatttatcagcagatatgcagttgttcataattgctaatataatcttaataccattatctgtaatacttgcgaaaagcagcaaaaacttcaaattagtaatgggaatttgctggacattaaatatattatttactgtattacccttagctgctagacttatatggacagaatacgacaatccatacgatacacattctagaattattgactacagcattggtataatgatgggaatctatatacgtgaaacgaagagtagcaaatatttagtgaaatctaagatcgtgaattttgttatatggattattgtgctcacttcaatgggtgcttgcgctattctatatcaagaggttgtctattcattaagatactctcagactgttcaagctttctactacagtttttcaagaccaatctggtgtctaggaataagttggataacatactcttgttatcatggttacggaagaataagtaactggatcctaaccaaacactcttgcaaaaccggcaaacgggcctactgaacggattcggacaggaattgcctaaacgcccgtttctacgcagttataactagctacttttacccattaaaatgggctcaagcagggggggcatttttaaagaaaaactggggtttcccttcatctggacctttacttttgagcccccccctcgtaaaggaaaaaaatatgcaatcaaagaaggcgcaatccaaaaaccaaacaccctgataacaaaaataagcccaaacctgcccgttgattcttagcaacccttccaccgggtggtctccccacctaattccctggggccacttcatccctcaaccttctcctcgacacccacccccactttcaccacacaagaaatctttacctctacactggcgccaaaaaccatcgccgaaatctttcccctc

SEQ ID NO: 9507 - DNA, 56 bp, Diabrotica virgifera
  misc_feature (13)..(13): n is a, c, g, or t
  misc_feature (47)..(48): n is a, c, g, or t
ctacatgggcggntattattgtgttttttggtagtccttaagagaannaaaaagaa

SEQ ID NO: 9508 - DNA, 1030 bp, Diabrotica virgifera
cttcctggagtccggaagacaataagattcagaacatttccaacgttcttcgagtctttgtagatgtaattcttgacgtacccgagcacagaagaataccactttataaacaacttctggagcagatagaagttaagaatcacctatatctctttttgctattaatttttgaagctcaagttacacatggtgctcatgacaaacagagaaaagaaaattctcagaaaagattagatatagcttcagaattatgtagggaattttccccaaagatcgttattgccaattgcatctacctaataaaatatttgagtaaattaccagatgaaaaagaggaaaatatggaagtagatagcgatgtaactactattttcaacatcgctgcacatacgcccaaagactttagacattacaaatatgtgttggtaaaatccactggtaatctcttaggttttccagagtttgtaaatcaagttgcttcccttagcgatgaagatgaacttaacctggaacctctgttcaaagagatgatcgtcaacacgcttcaatatatacaaagaatatcgaaagtttgcgacaaagcttcaaatacaccacaagcgcattactggaaagttttattgcatttgagttacgatattttggacagtgttaacgctcttctaacaccacagatgttcctactggttactaaaggcctgatgatacacacattgtcgactggtagaaaaagagttttggaattggtaaataataaattacagcataagttcacaattttttgaagaatgtagtaaaaacggagttatatttcgttaattccaacctatcttagcaataaaccaaggtctaaatgaaaaaagcgacgccgagcagggaataaatcttacaaacgattttattggctttaaaactacttaattaacctttcccgccgggcaaggaaccggaaaaaattttgtcaaatctttaaactttcttcccgggggggggtaaaaatccgggaaaagtctaaaaaaaatttgtttgg

SEQ ID NO: 9509 - DNA, 1056 bp, Diabrotica virgifera
  misc_feature (482)..(482): n is a, c, g, or t
  misc_feature (709)..(734): n is a, c, g, or t
  misc_feature (903)..(935): n is a, c, g, or t
  misc_feature (968)..(986): n is a, c, g, or t
  misc_feature (992)..(1024): n is a, c, g, or t
  misc_feature (1032)..(1054): n is a, c, g, or t
cttcctgcgtccgaaaccgagaagataatagatactatcttcccgtaatagtaagcatagcaccaaatttaaatacgtttcagtgtaattcacaaacgaacgctttatatactagtgttccattctactactcttttataaaaagagaaatgactaaaaatcacttagaagactgcatacttccagcatatccaaaaaatgggaaatggtttcttgaaggaggtatagaaaaaaaacctggtgatattgtactgtccagcacgatcttaaggttttcatgtaatatgcgacatatattgtcctctaggtcaccatattatgactgtcaaagttttgaagatcatcccacctgtttaagagtatgtcctaaaatatcattacctgccggatcacaaatattatgcaaaaattttaaggaccaatatatagactgcaacgacattgccgatggtagcagcataacgtttacatgtccaaacggntttgtatcagacagaggcacacccactagcacaagatactgccgcaatggagtgtatggtaattctgcacctcctggacagacattaagcaaaagtctgtgtacgtctcttatacattattacaattccaaaccaaaaatagaacttgcccctacgaaaacaacttagaagtaagattaccccccccaaaatctgaatttacttcaaaaaagccactcccaattccnnnnnnnnnnnnnnnnnnnnnnnnnntttgttatttaccttgaaggggggggatataaggggctccctcttataaaaattttgagcccaaggttatggcccacctttaaataaccaaggctatttggctcttatttcagagggagaagttgacttctgaaggaaaggggactaaatttctttccatggcggaggnnnnnnnnnnnnnnnnnnnnnnnnnnnnnnnnngggtgggacaccattggggggggaggaaactgnnnnnnnnnnnnnnnnnnngggtcnnnnnnnnnnnnnnnnnnnnnnnnnnnnnnnnntgggagannnnnnnnnnnnnnnnnnnnnnnac

SEQ ID NO: 9510 - DNA, 427 bp, Diabrotica virgifera
  misc_feature (12)..(41): n is a, c, g, or t
  misc_feature (69)..(69): n is a, c, g, or t
  misc_feature (112)..(163): n is a, c, g, or t
ccctcagtaacnnnnnnnnnnnnnnnnnnnnnnnnnnnnnntttagatggccggggatgcaagggaatngcgaacagcggcatccactccatttccaaacaatcaaaatggnnnnnnnnnnnnnnnnnnnnnnnnnnnnnnnnnnnnnnnnnnnnnnnnnnnncaaatctactactactgcacatttaatttaccaatgcgacgataccgccaaacgtacccatcgaaaagccccaaaaaagaagcccaagaaatgggtaaaggtccattcaaccatgcccgggaactcgacacacttaaagactagagataacgtggtattacccttgacatcgccttgcggaaactcgaaaccgttaaatactaagaaaccataattgatgacccccgaacacagaaactcccccaccaacccgaccacagaaac

SEQ ID NO: 9511 - DNA, 479 bp, Diabrotica virgifera
  misc_feature (26)..(26): n is a, c, g, or t
  misc_feature (34)..(34): n is a, c, g, or t
  misc_feature (65)..(66): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (125)..(126): n is a, c, g, or t
  misc_feature (148)..(148): n is a, c, g, or t
  misc_feature (150)..(150): n is a, c, g, or t
  misc_feature (166)..(166): n is a, c, g, or t
  misc_feature (174)..(174): n is a, c, g, or t
  misc_feature (188)..(188): n is a, c, g, or t
  misc_feature (197)..(197): n is a, c, g, or t
  misc_feature (200)..(200): n is a, c, g, or t
  misc_feature (233)..(233): n is a, c, g, or t
  misc_feature (235)..(235): n is a, c, g, or t
  misc_feature (255)..(255): n is a, c, g, or t
  misc_feature (268)..(268): n is a, c, g, or t
  misc_feature (281)..(281): n is a, c, g, or t
  misc_feature (329)..(349): n is a, c, g, or t
  misc_feature (356)..(378): n is a, c, g, or t
  misc_feature (396)..(415): n is a, c, g, or t
  misc_feature (429)..(460): n is a, c, g, or t
cccccccaggaccggaaaataatagnggtaaatngaaaagattgcttaaggtgattgaaggaggnnaaggntngatttgggntgtagtggcattggatggatggatattttaaattaggttgttnnattattttttgtatgttttgtntnaataaaaagttttgtngaatattnattgatattatgtnttttatagnttnggaaataacagatgttttagtatgataaaaagnangaagtaaaaaataaatgtgnaattatagatagntattataaatgtnaatatttttatggattatgaaatattataatataggatatatataggnnnnnnnnnnnnnnnnnnnnnatgtagnnnnnnnnnnnnnnnnnnnnnnnggatgataaaagtaatgnnnnnnnnnnnnnnnnnnnngaggataaaaaagnnnnnnnnnnnnnnnnnnnnnnnnnnnnnnnntttattgattaatgtgttt

SEQ ID NO: 9512 - DNA, 779 bp, Diabrotica virgifera
  misc_feature (14)..(46): n is a, c, g, or t
  misc_feature (48)..(653): n is a, c, g, or t
  misc_feature (655)..(778): n is a, c, g, or t
cttcccattgtccnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9513 - DNA, 324 bp, Diabrotica virgifera
  misc_feature (15)..(15): n is a, c, g, or t
  misc_feature (25)..(30): n is a, c, g, or t
  misc_feature (34)..(35): n is a, c, g, or t
  misc_feature (55)..(55): n is a, c, g, or t
  misc_feature (58)..(58): n is a, c, g, or t
  misc_feature (61)..(62): n is a, c, g, or t
  misc_feature (70)..(70): n is a, c, g, or t
  misc_feature (72)..(72): n is a, c, g, or t
  misc_feature (74)..(75): n is a, c, g, or t
  misc_feature (78)..(78): n is a, c, g, or t
  misc_feature (85)..(85): n is a, c, g, or t
  misc_feature (91)..(91): n is a, c, g, or t
  misc_feature (104)..(104): n is a, c, g, or t
  misc_feature (114)..(115): n is a, c, g, or t
  misc_feature (131)..(131): n is a, c, g, or t
  misc_feature (135)..(136): n is a, c, g, or t
  misc_feature (142)..(142): n is a, c, g, or t
  misc_feature (152)..(153): n is a, c, g, or t
  misc_feature (173)..(173): n is a, c, g, or t
  misc_feature (181)..(181): n is a, c, g, or t
  misc_feature (202)..(203): n is a, c, g, or t
  misc_feature (211)..(211): n is a, c, g, or t
  misc_feature (221)..(251): n is a, c, g, or t
  misc_feature (254)..(254): n is a, c, g, or t
  misc_feature (258)..(283): n is a, c, g, or t
  misc_feature (285)..(285): n is a, c, g, or t
cccaaccaggtccgntagttgttannnnnntgtnnggtgagatcctttaaggtantanatnnagaggggngngnnatnatggaanatgggntggggagagaaanggaaaagggnnttattaatttaagganatanntaattnattatgtagnnattgaatgtagagttttatnggattatntgggtgtggagaaatggtttnnttagaatnttatttggannnnnnnnnnnnnnnnnnnnnnnnnnnnnnnggnttgnnnnnnnnnnnnnnnnnnnnnnnnnntntagtagaaataggagggtggaaagaaggttatgttaaat

SEQ ID NO: 9514 - DNA, 521 bp, Diabrotica virgifera
  misc_feature (18)..(45): n is a, c, g, or t
  misc_feature (60)..(60): n is a, c, g, or t
  misc_feature (63)..(65): n is a, c, g, or t
  misc_feature (79)..(79): n is a, c, g, or t
  misc_feature (83)..(83): n is a, c, g, or t
  misc_feature (101)..(101): n is a, c, g, or t
  misc_feature (109)..(109): n is a, c, g, or t
  misc_feature (117)..(119): n is a, c, g, or t
  misc_feature (129)..(129): n is a, c, g, or t
  misc_feature (132)..(133): n is a, c, g, or t
  misc_feature (135)..(137): n is a, c, g, or t
  misc_feature (141)..(141): n is a, c, g, or t
  misc_feature (143)..(143): n is a, c, g, or t
  misc_feature (146)..(149): n is a, c, g, or t
  misc_feature (190)..(190): n is a, c, g, or t
  misc_feature (192)..(192): n is a, c, g, or t
  misc_feature (195)..(195): n is a, c, g, or t
  misc_feature (203)..(203): n is a, c, g, or t
  misc_feature (205)..(205): n is a, c, g, or t
  misc_feature (209)..(209): n is a, c, g, or t
  misc_feature (211)..(211): n is a, c, g, or t
  misc_feature (219)..(221): n is a, c, g, or t
  misc_feature (224)..(225): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (242)..(242): n is a, c, g, or t
  misc_feature (244)..(244): n is a, c, g, or t
  misc_feature (257)..(258): n is a, c, g, or t
  misc_feature (267)..(267): n is a, c, g, or t
  misc_feature (274)..(274): n is a, c, g, or t
  misc_feature (276)..(276): n is a, c, g, or t
  misc_feature (278)..(278): n is a, c, g, or t
  misc_feature (288)..(289): n is a, c, g, or t
  misc_feature (295)..(295): n is a, c, g, or t
  misc_feature (319)..(319): n is a, c, g, or t
  misc_feature (329)..(329): n is a, c, g, or t
  misc_feature (339)..(339): n is a, c, g, or t
  misc_feature (347)..(349): n is a, c, g, or t
  misc_feature (378)..(378): n is a, c, g, or t
  misc_feature (414)..(414): n is a, c, g, or t
  misc_feature (435)..(435): n is a, c, g, or t
  misc_feature (440)..(441): n is a, c, g, or t
  misc_feature (444)..(444): n is a, c, g, or t
gggatcaataggttagannnnnnnnnnnnnnnnnnnnnnnnnnnncctttaaagaaaaangannncatgcaacaaaaangacngcacaaagggaaagacgngaacgggnagcagggnnnaacttaaggnganncnnnaaanancgnnnncgaccaaaaggcaacccacacagcacacagcaaaacggacncncancagaaggnancaancnacgccgcnnnaanncaaacanaanccnaaancnacaaccacagaanncacaagganacggccncncnccagaaagcnnagaaangcggaccagcaaagggggccacgnacagaacganagaacacagnaagcacannnaaacggaaaaacgacaaagagggaacggnaacgcacaaagagagaagacgcccgcaaaaaagaanacccacacaagccacaaacgnacggnnccncgaaagaaaggacacacccgaggccaccagcaccccaacaggaagaaaacaaagacccaaaaacaacacaaggaaaa

SEQ ID NO: 9515 - DNA, 536 bp, Diabrotica virgifera
  misc_feature (13)..(13): n is a, c, g, or t
  misc_feature (15)..(16): n is a, c, g, or t
  misc_feature (21)..(28): n is a, c, g, or t
  misc_feature (30)..(31): n is a, c, g, or t
  misc_feature (33)..(33): n is a, c, g, or t
  misc_feature (37)..(37): n is a, c, g, or t
  misc_feature (39)..(39): n is a, c, g, or t
  misc_feature (60)..(60): n is a, c, g, or t
  misc_feature (62)..(63): n is a, c, g, or t
  misc_feature (77)..(77): n is a, c, g, or t
  misc_feature (82)..(82): n is a, c, g, or t
  misc_feature (84)..(84): n is a, c, g, or t
  misc_feature (90)..(90): n is a, c, g, or t
  misc_feature (123)..(123): n is a, c, g, or t
  misc_feature (131)..(132): n is a, c, g, or t
  misc_feature (149)..(150): n is a, c, g, or t
  misc_feature (162)..(162): n is a, c, g, or t
  misc_feature (189)..(189): n is a, c, g, or t
  misc_feature (197)..(198): n is a, c, g, or t
  misc_feature (214)..(214): n is a, c, g, or t
  misc_feature (220)..(220): n is a, c, g, or t
  misc_feature (234)..(234): n is a, c, g, or t
  misc_feature (267)..(267): n is a, c, g, or t
  misc_feature (270)..(270): n is a, c, g, or t
  misc_feature (307)..(307): n is a, c, g, or t
  misc_feature (312)..(312): n is a, c, g, or t
  misc_feature (386)..(386): n is a, c, g, or t
  misc_feature (389)..(389): n is a, c, g, or t
  misc_feature (413)..(413): n is a, c, g, or t
  misc_feature (448)..(448): n is a, c, g, or t
  misc_feature (482)..(521): n is a, c, g, or t
ctactgggtccgntnnagggnnnnnnnnannangggngnctccgtaatagaagataaaanannggaaattaagaaanaaagntnaatagngattggtttatatggaggtagaaatgtagtttnaatgttanntggaggtggtattggtnnagaattaatggnatatgtaagggaggtatttaagtatgntgtagaannagtagattttgaagtnattganatagattaaaaatnagaatataatgtagagttggaatatgtaattanatntataaaagggaatggtgtggatattaaagggaatatngaaanaaaaagtgaaagtgatgaagtaatattaagaaatgttgtaattagaaatgaattagatttttttgaaaatgttnttnatgttaaattataagaaggtgtanatgatagataaaaagatattgagattgtaattatnagggagaataaagagggtgaatatgttatgttannnnnnnnnnnnnnnnnnnnnnnnnnnnnnnnnnnnnnnnttgtgaaagaattaa

SEQ ID NO: 9516 - DNA, 601 bp, Diabrotica virgifera
  misc_feature (16)..(44): n is a, c, g, or t
  misc_feature (60)..(60): n is a, c, g, or t
  misc_feature (62)..(62): n is a, c, g, or t
  misc_feature (71)..(116): n is a, c, g, or t
  misc_feature (123)..(365): n is a, c, g, or t
  misc_feature (384)..(406): n is a, c, g, or t
  misc_feature (414)..(414): n is a, c, g, or t
  misc_feature (423)..(449): n is a, c, g, or t
  misc_feature (466)..(483): n is a, c, g, or t
tcaaccccggtccggnnnnnnnnnnnnnnnnnnnnnnnnnnnnncttttagggaccttgngnatcagggannnnnnnnnnnnnnnnnnnnnnnnnnnnnnnnnnnnnnnnnnnnnnctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgttattattgagtnnnnnnnnnnnnnnnnnnnnnnnctcataancttttcacnnnnnnnnnnnnnnnnnnnnnnnnnnnttacgtactgactgacnnnnnnnnnnnnnnnnnncttcgcaactaggcaacaacacatacgtctcatcacggcctcccgcaacatttttaacacccgtttataaaaaacctgcctttttgtataaaccacaagccccccctgcccaccgacc

SEQ ID NO: 9517 - DNA, 1064 bp, Diabrotica virgifera
  misc_feature (15)..(44): n is a, c, g, or t
  misc_feature (46)..(320): n is a, c, g, or t
  misc_feature (323)..(323): n is a, c, g, or t
  misc_feature (326)..(326): n is a, c, g, or t
  misc_feature (337)..(338): n is a, c, g, or t
  misc_feature (352)..(352): n is a, c, g, or t
  misc_feature (357)..(379): n is a, c, g, or t
  misc_feature (381)..(381): n is a, c, g, or t
  misc_feature (383)..(384): n is a, c, g, or t
  misc_feature (388)..(389): n is a, c, g, or t
  misc_feature (391)..(391): n is a, c, g, or t
  misc_feature (408)..(409): n is a, c, g, or t
  misc_feature (411)..(411): n is a, c, g, or t
  misc_feature (427)..(427): n is a, c, g, or t
  misc_feature (436)..(436): n is a, c, g, or t
  misc_feature (442)..(566): n is a, c, g, or t
  misc_feature (568)..(643): n is a, c, g, or t
  misc_feature (645)..(718): n is a, c, g, or t
  misc_feature (901)..(930): n is a, c, g, or t
  misc_feature (940)..(995): n is a, c, g, or t
cctcccctgggccgnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaanatttttttcanntgtttattaaaaanatgtnnnnnnnnnnnnnnnnnnnnnnntngnntggnnantgattaatttgaatggnngnggtattttgaccgtgntaaggtagnataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnatagaataaataccttagggtaccagcgaaattttattgagaagtcaaatccgataaccaaattgcacccccaaggtggataaaggttataattggcggaccactatattataaagcctgtcaacttttcaattttaaaggatccgaatttaaaccggggggaaccagggtggtttcttttcnnnnnnnnnnnnnnnnnnnnnnnnnnnnnnggaccaattnnnnnnnnnnnnnnnnnnnnnnnnnnnnnnnnnnnnnnnnnnnnnnnnnnnnnnnncccctcctaaaggtccccactttctacccggggctcggacgcccatattctctcttaatggggccccaa

SEQ ID NO: 9518 - DNA, 1185 bp, Diabrotica virgifera
  misc_feature (17)..(17): n is a, c, g, or t
  misc_feature (29)..(29): n is a, c, g, or t
  misc_feature (32)..(32): n is a, c, g, or t
  misc_feature (40)..(40): n is a, c, g, or t
  misc_feature (62)..(62): n is a, c, g, or t
  misc_feature (65)..(65): n is a, c, g, or t
  misc_feature (70)..(70): n is a, c, g, or t
  misc_feature (72)..(74): n is a, c, g, or t
  misc_feature (77)..(77): n is a, c, g, or t
  misc_feature (80)..(81): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (99)..(99): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (137)..(137): n is a, c, g, or t
  misc_feature (139)..(139): n is a, c, g, or t
  misc_feature (143)..(143): n is a, c, g, or t
  misc_feature (149)..(149): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (182)..(182): n is a, c, g, or t
  misc_feature (185)..(185): n is a, c, g, or t
  misc_feature (200)..(200): n is a, c, g, or t
  misc_feature (203)..(203): n is a, c, g, or t
  misc_feature (212)..(212): n is a, c, g, or t
  misc_feature (218)..(221): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (236)..(236): n is a, c, g, or t
  misc_feature (245)..(245): n is a, c, g, or t
  misc_feature (247)..(247): n is a, c, g, or t
  misc_feature (249)..(250): n is a, c, g, or t
  misc_feature (254)..(255): n is a, c, g, or t
  misc_feature (258)..(258): n is a, c, g, or t
  misc_feature (261)..(261): n is a, c, g, or t
  misc_feature (266)..(267): n is a, c, g, or t
  misc_feature (269)..(269): n is a, c, g, or t
  misc_feature (272)..(273): n is a, c, g, or t
  misc_feature (281)..(281): n is a, c, g, or t
  misc_feature (284)..(284): n is a, c, g, or t
  misc_feature (293)..(296): n is a, c, g, or t
  misc_feature (299)..(299): n is a, c, g, or t
  misc_feature (304)..(305): n is a, c, g, or t
  misc_feature (315)..(317): n is a, c, g, or t
  misc_feature (320)..(320): n is a, c, g, or t
  misc_feature (323)..(324): n is a, c, g, or t
  misc_feature (332)..(332): n is a, c, g, or t
  misc_feature (336)..(337): n is a, c, g, or t
  misc_feature (340)..(340): n is a, c, g, or t
  misc_feature (346)..(347): n is a, c, g, or t
  misc_feature (353)..(353): n is a, c, g, or t
  misc_feature (355)..(355): n is a, c, g, or t
  misc_feature (361)..(361): n is a, c, g, or t
  misc_feature (364)..(365): n is a, c, g, or t
  misc_feature (367)..(368): n is a, c, g, or t
  misc_feature (371)..(372): n is a, c, g, or t
  misc_feature (380)..(380): n is a, c, g, or t
  misc_feature (386)..(386): n is a, c, g, or t
  misc_feature (394)..(394): n is a, c, g, or t
  misc_feature (398)..(398): n is a, c, g, or t
  misc_feature (400)..(400): n is a, c, g, or t
  misc_feature (417)..(417): n is a, c, g, or t
  misc_feature (422)..(422): n is a, c, g, or t
  misc_feature (424)..(424): n is a, c, g, or t
  misc_feature (439)..(439): n is a, c, g, or t
  misc_feature (446)..(446): n is a, c, g, or t
  misc_feature (453)..(453): n is a, c, g, or t
  misc_feature (464)..(464): n is a, c, g, or t
  misc_feature (467)..(468): n is a, c, g, or t
  misc_feature (478)..(479): n is a, c, g, or t
  misc_feature (484)..(484): n is a, c, g, or t
  misc_feature (532)..(533): n is a, c, g, or t
  misc_feature (541)..(543): n is a, c, g, or t
  misc_feature (550)..(550): n is a, c, g, or t
  misc_feature (559)..(560): n is a, c, g, or t
  misc_feature (577)..(578): n is a, c, g, or t
  misc_feature (594)..(594): n is a, c, g, or t
  misc_feature (599)..(599): n is a, c, g, or t
  misc_feature (606)..(606): n is a, c, g, or t
  misc_feature (611)..(611): n is a, c, g, or t
  misc_feature (622)..(622): n is a, c, g, or t
  misc_feature (624)..(625): n is a, c, g, or t
  misc_feature (639)..(639): n is a, c, g, or t
  misc_feature (656)..(656): n is a, c, g, or t
  misc_feature (689)..(689): n is a, c, g, or t
  misc_feature (691)..(691): n is a, c, g, or t
  misc_feature (716)..(716): n is a, c, g, or t
  misc_feature (723)..(723): n is a, c, g, or t
  misc_feature (743)..(764): n is a, c, g, or t
  misc_feature (787)..(805): n is a, c, g, or t
  misc_feature (874)..(915): n is a, c, g, or t
  misc_feature (917)..(955): n is a, c, g, or t
  misc_feature (957)..(970): n is a, c, g, or t
  misc_feature (972)..(1005): n is a, c, g, or t
  misc_feature (1012)..(1045): n is a, c, g, or t
  misc_feature (1047)..(1064): n is a, c, g, or t
  misc_feature (1075)..(1179): n is a, c, g, or t
ttaaaccctagttgatnaaggttatattnggnttggaggntaccctttaaggggatgaaggnggntttgntnnnaanatnntnaanaanaaagaaggtntngaantnatnaaggttgttattgaaaatggtggatananaggnaagatngaaattggtatggatgttgntgnatntgaattntanaaagaagggaaatanganttagaattnaaaaannnnaantnnganaaaagnaaatggatnantnntgannaanttnttganntntannaagaattnatnaaagaatannnnatngtttnnattgaagatnnnttngannaagatgantggnnagnatggtnnaaaatnantggtgnaanntnnatnnaaattgtnggtgangatttaanagtnanaaatttaaaatgtattnaaatngnagtagagaagaaagnttgtaantggttgnttttgaaagtnaannaaattggtanngtganagagtttatttaagtttataatgtgtgtaaggttaaaggttggggtannatggtttnnnaaaggtntggtgaaanngaagatatttttattgnngattttgttgtaggtnttttnaatggtnaaatnaagaatggagntnnttgaagattagaangtttggtttaataaaanaaaatttttggtattgaagaagagttaggattngnagataaatatgatggaaaatatttngtaaaanttagtaagtgaaattaggannnnnnnnnnnnnnnnnnnnnntgagggtattgttaagagaaagnnnnnnnnnnnnnnnnnnngttaagagaaaagaaaaggtatgtttgtaaaaatggaataattggattaaataagtggaatggatgagnnnnnnnnnnnnnnnnnnnnnnnnnnnnnnnnnnnnnnnnnngnnnnnnnnnnnnnnnnnnnnnnnnnnnnnnnnnnnnnnntnnnnnnnnnnnnnngnnnnnnnnnnnnnnnnnnnnnnnnnnnnnnnnnnaatattnnnnnnnnnnnnnnnnnnnnnnnnnnnnnnnnnngnnnnnnnnnnnnnnnnnnggaggggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattt

SEQ ID NO: 9519 - DNA, 507 bp, Diabrotica virgifera
  misc_feature (5)..(36): n is a, c, g, or t
  misc_feature (40)..(112): n is a, c, g, or t
  misc_feature (114)..(293): n is a, c, g, or t
  misc_feature (300)..(337): n is a, c, g, or t
  misc_feature (357)..(370): n is a, c, g, or t
  misc_feature (373)..(395): n is a, c, g, or t
  misc_feature (403)..(425): n is a, c, g, or t
  misc_feature (455)..(472): n is a, c, g, or t
cgggnnnnnnnnnnnnnnnnnnnnnnnnnnnnnnnnctgnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnctatattttaagtacgaaaaggacccaaatatatc

SEQ ID NO: 9520 - DNA, 785 bp, Diabrotica virgifera
  misc_feature (123)..(171): n is a, c, g, or t
  misc_feature (627)..(650): n is a, c, g, or t
cctccccggtccggcatctcgcccagttccttgagtttaattccatcataaccttatcattaggtgatagcaacggtaaatgcttagccgtcttattgaaatatttttcacttttcatctgannnnnnnnnnnnnnnnnnnnnnnnnnnnnnnnnnnnnnnnnnnnnnnnngctgtgaatcacttacagggacaaaaccttttaacttacggccaaataacagctctgcaggagatggtatacaatgactgataggtgtattacgaatttctaataaagcaacatacatatctttttgatcaaacaaaatctttttaaacatcttttgtaggtttgcacatatctttcaataaacccatttgattgtgggtatctaggtgaactagttttgtgaataatttcccattccttaaaaaacttttgaatgtaccctttggtgaactgaggaccaccatccgaaaagataacatctggcctgccatgtcttgcaaaaattgctttaagattatgaatagacttaggctaatatgcaaattgcatataatgcataaaaaatgcaaaaatgtcaaattttgcatatttttataaaagtgagcataaagtgcatataatttgaaaatttggtgnnnnnnnnnnnnnnnnnnnnnnnnacttacagatagcatgaaaatgccaatatttaaattttgttttataatcactatttggtattcaaattcttgggttgataggaactaataaaagaacagcgggtttatagtttttgtcacgtttttgtccctgga

SEQ ID NO: 9521 - DNA, 866 bp, Diabrotica virgifera
  misc_feature (13)..(43): n is a, c, g, or t
  misc_feature (45)..(651): n is a, c, g, or t
  misc_feature (668)..(705): n is a, c, g, or t
  misc_feature (744)..(761): n is a, c, g, or t
  misc_feature (771)..(793): n is a, c, g, or t
  misc_feature (824)..(853): n is a, c, g, or t
ccctcgagatccnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctttaggataacagnnnnnnnnnnnnnnnnnnnnnnnnnnnnnnnnnnnnnntgcgaactcgatgttggattaaagttaataattggtggnnnnnnnnnnnnnnnnnncctggtccannnnnnnnnnnnnnnnnnnnnnnagttaaaaccggggtgagccaagttggtttnnnnnnnnnnnnnnnnnnnnnnnnnnnnnngaacgaacaggac

SEQ ID NO: 9522 - DNA, 425 bp, Diabrotica virgifera
  misc_feature (17)..(48): n is a, c, g, or t
  misc_feature (59)..(61): n is a, c, g, or t
  misc_feature (72)..(72): n is a, c, g, or t
  misc_feature (82)..(82): n is a, c, g, or t
  misc_feature (101)..(101): n is a, c, g, or t
  misc_feature (105)..(105): n is a, c, g, or t
  misc_feature (107)..(108): n is a, c, g, or t
  misc_feature (113)..(113): n is a, c, g, or t
  misc_feature (115)..(115): n is a, c, g, or t
  misc_feature (138)..(139): n is a, c, g, or t
  misc_feature (141)..(141): n is a, c, g, or t
  misc_feature (153)..(153): n is a, c, g, or t
  misc_feature (178)..(178): n is a, c, g, or t
  misc_feature (245)..(245): n is a, c, g, or t
  misc_feature (247)..(247): n is a, c, g, or t
  misc_feature (329)..(329): n is a, c, g, or t
  misc_feature (399)..(399): n is a, c, g, or t
ggagctaggggacccgnnnnnnnnnnnnnnnnnnnnnnnnnnnnnnnnttcaagcgacnnncacgacggcgngagaaaggcngccgcagaagcgccaccanggcnannggaangngcaacacccccaaggaccagccnncncaggcggcaggnggagcggcagaggccccgaacagcncaaagccaccgacaccgaacccgaaagagaagacccaacggccaagccagacccaccggcgcggcgnanccaaaaaccacgaccgacgcacacagaccaagaagcaagaacgacacacccgaggaaacacgacaaaagaacgccagaacangaagaacgccccaacgaaagagggaggaaacgacgagaccaacacccggacgaggaagaacaagcacaancggaaaagcaaaaaacaaaacacaca

SEQ ID NO: 9523 - DNA, 632 bp, Diabrotica virgifera
  misc_feature (15)..(15): n is a, c, g, or t
  misc_feature (20)..(20): n is a, c, g, or t
  misc_feature (23)..(23): n is a, c, g, or t
  misc_feature (56)..(57): n is a, c, g, or t
  misc_feature (59)..(59): n is a, c, g, or t
  misc_feature (64)..(64): n is a, c, g, or t
  misc_feature (74)..(95): n is a, c, g, or t
  misc_feature (97)..(98): n is a, c, g, or t
  misc_feature (104)..(104): n is a, c, g, or t
  misc_feature (107)..(107): n is a, c, g, or t
  misc_feature (116)..(116): n is a, c, g, or t
  misc_feature (127)..(128): n is a, c, g, or t
  misc_feature (134)..(135): n is a, c, g, or t
  misc_feature (139)..(139): n is a, c, g, or t
  misc_feature (145)..(145): n is a, c, g, or t
  misc_feature (147)..(148): n is a, c, g, or t
  misc_feature (166)..(166): n is a, c, g, or t
  misc_feature (177)..(177): n is a, c, g, or t
  misc_feature (190)..(190): n is a, c, g, or t
  misc_feature (195)..(195): n is a, c, g, or t
  misc_feature (198)..(198): n is a, c, g, or t
  misc_feature (208)..(208): n is a, c, g, or t
  misc_feature (220)..(220): n is a, c, g, or t
  misc_feature (237)..(239): n is a, c, g, or t
  misc_feature (250)..(250): n is a, c, g, or t
  misc_feature (268)..(268): n is a, c, g, or t
  misc_feature (274)..(274): n is a, c, g, or t
  misc_feature (278)..(278): n is a, c, g, or t
  misc_feature (286)..(286): n is a, c, g, or t
  misc_feature (290)..(290): n is a, c, g, or t
  misc_feature (295)..(295): n is a, c, g, or t
  misc_feature (320)..(320): n is a, c, g, or t
  misc_feature (335)..(335): n is a, c, g, or t
  misc_feature (338)..(338): n is a, c, g, or t
  misc_feature (344)..(344): n is a, c, g, or t
  misc_feature (361)..(361): n is a, c, g, or t
  misc_feature (371)..(371): n is a, c, g, or t
  misc_feature (375)..(375): n is a, c, g, or t
  misc_feature (383)..(383): n is a, c, g, or t
  misc_feature (394)..(394): n is a, c, g, or t
  misc_feature (398)..(398): n is a, c, g, or t
  misc_feature (402)..(402): n is a, c, g, or t
  misc_feature (408)..(408): n is a, c, g, or t
  misc_feature (425)..(425): n is a, c, g, or t
  misc_feature (428)..(428): n is a, c, g, or t
  misc_feature (458)..(458): n is a, c, g, or t
  misc_feature (464)..(465): n is a, c, g, or t
  misc_feature (476)..(476): n is a, c, g, or t
  misc_feature (495)..(530): n is a, c, g, or t
  misc_feature (545)..(545): n is a, c, g, or t
  misc_feature (547)..(592): n is a, c, g, or t
  misc_feature (596)..(628): n is a, c, g, or t
cttaacagggccganaagantgnagataaatttatagataagtatttataatattnntnaaaantgaaaggaannnnnnnnnnnnnnnnnnnnnntnnaaattnaanataattttntttataggtanntatttnntttnttgttnannaattaatgttgtggttgnataataattgntgttaaaaattanataanatnattgaatatnagtaaaaattanaataaattattgattannngtaaaaattanataaaattgttgaatatnagtaantatntaattatntaanatttntttagtgatattgtaaaaggtgatnggaattgttgataanatntggttntttttatttgataaatnttttagtatntaanattatttnatgttttaaanaatntaantttgantgtttgtaagataaagntgntataaaataattaagaatggattgatatanaaaagnngttgaagaatnaatatagattatatgtgannnnnnnnnnnnnnnnnnnnnnnnnnnnnnnnnnnngttaaagttatgtantnnnnnnnnnnnnnnnnnnnnnnnnnnnnnnnnnnnnnnnnnnnnnnggannnnnnnnnnnnnnnnnnnnnnnnnnnnnnnnngaat

SEQ ID NO: 9524 - DNA, 371 bp, Diabrotica virgifera
  misc_feature (17)..(17): n is a, c, g, or t
  misc_feature (57)..(57): n is a, c, g, or t
  misc_feature (63)..(64): n is a, c, g, or t
  misc_feature (74)..(74): n is a, c, g, or t
  misc_feature (170)..(187): n is a, c, g, or t
cctacaggtccgcctgngaattttgttgtttgttggttttcctcttgcattacaganaatcgnnatgatgaagntccccttagtgctgacatttgttgcatttctgtggatttgggaggctaatggatttaccgcagaacaaataaatgaaattcgtagtatttgcagcnnnnnnnnnnnnnnnnnnccacgtaaaaaagggataggggttttccggaattccgggggactagctccccattttttggggaatcggacctccaggaaaaactaaaaaggggtcccaagaaccccccgaaaccccggccaaaggggcccccggggggggaggaatcccggatcggctaggattaagggggggtggtcctggg

SEQ ID NO: 9525 - DNA, 388 bp, Diabrotica virgifera
  misc_feature (16)..(36): n is a, c, g, or t
  misc_feature (55)..(55): n is a, c, g, or t
  misc_feature (57)..(61): n is a, c, g, or t
  misc_feature (63)..(63): n is a, c, g, or t
  misc_feature (66)..(66): n is a, c, g, or t
  misc_feature (68)..(69): n is a, c, g, or t
  misc_feature (71)..(71): n is a, c, g, or t
  misc_feature (75)..(77): n is a, c, g, or t
  misc_feature (79)..(81): n is a, c, g, or t
  misc_feature (83)..(84): n is a, c, g, or t
  misc_feature (91)..(91): n is a, c, g, or t
  misc_feature (97)..(117): n is a, c, g, or t
  misc_feature (124)..(144): n is a, c, g, or t
  misc_feature (198)..(225): n is a, c, g, or t
atatcgtagacaccgnnnnnnnnnnnnnnnnnnnnngggtttccccctaaagggnannnnnanacnanngnaaannnannngnnaatattntgaagnnnnnnnnnnnnnnnnnnnnnttccccnnnnnnnnnnnnnnnnnnnnngagtaggaggggatgggaacggtccacccgctatattatcatttctagcgctgnnnnnnnnnnnnnnnnnnnnnnnnnnnnctcttgacctcccatttaaattccttaacgcatcggaaaggacttctcatgcgcaccctcactgcacggacagatagttgtccaaccgtcccatgtcaaataaacagcgacccctgatagcttcaccccacccccaccgcacgtggcagcagcgggaggacca

SEQ ID NO: 9526 - DNA, 460 bp, Diabrotica virgifera
  misc_feature (23)..(23): n is a, c, g, or t
  misc_feature (26)..(26): n is a, c, g, or t
  misc_feature (58)..(58): n is a, c, g, or t
  misc_feature (62)..(63): n is a, c, g, or t
  misc_feature (66)..(66): n is a, c, g, or t
  misc_feature (73)..(73): n is a, c, g, or t
  misc_feature (79)..(79): n is a, c, g, or t
  misc_feature (89)..(89): n is a, c, g, or t
  misc_feature (91)..(92): n is a, c, g, or t
  misc_feature (99)..(99): n is a, c, g, or t
  misc_feature (107)..(107): n is a, c, g, or t
  misc_feature (110)..(110): n is a, c, g, or t
  misc_feature (116)..(116): n is a, c, g, or t
  misc_feature (131)..(131): n is a, c, g, or t
  misc_feature (135)..(135): n is a, c, g, or t
  misc_feature (147)..(147): n is a, c, g, or t
  misc_feature (150)..(150): n is a, c, g, or t
  misc_feature (152)..(153): n is a, c, g, or t
  misc_feature (162)..(162): n is a, c, g, or t
  misc_feature (165)..(166): n is a, c, g, or t
  misc_feature (171)..(171): n is a, c, g, or t
  misc_feature (173)..(173): n is a, c, g, or t
  misc_feature (178)..(178): n is a, c, g, or t
  misc_feature (181)..(181): n is a, c, g, or t
  misc_feature (184)..(184): n is a, c, g, or t
  misc_feature (190)..(191): n is a, c, g, or t
  misc_feature (203)..(203): n is a, c, g, or t
  misc_feature (209)..(209): n is a, c, g, or t
  misc_feature (212)..(212): n is a, c, g, or t
  misc_feature (215)..(215): n is a, c, g, or t
  misc_feature (220)..(220): n is a, c, g, or t
  misc_feature (224)..(226): n is a, c, g, or t
  misc_feature (252)..(252): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (265)..(265): n is a, c, g, or t
  misc_feature (280)..(280): n is a, c, g, or t
  misc_feature (283)..(283): n is a, c, g, or t
  misc_feature (286)..(286): n is a, c, g, or t
  misc_feature (292)..(292): n is a, c, g, or t
  misc_feature (295)..(295): n is a, c, g, or t
  misc_feature (317)..(317): n is a, c, g, or t
  misc_feature (321)..(321): n is a, c, g, or t
  misc_feature (338)..(338): n is a, c, g, or t
  misc_feature (346)..(346): n is a, c, g, or t
  misc_feature (360)..(360): n is a, c, g, or t
  misc_feature (386)..(387): n is a, c, g, or t
  misc_feature (456)..(456): n is a, c, g, or t
cccacacaggtccgatgaagtantgnaagatttataggagtttccttatgataggagnttgnnatntgttaantggtgnaaatgaatantnngaagatntagagtanttnttgtangaagataaagaaggnaatnttaaagtagagngtntnntaaagaggngannagaantnttgtngtngtntggatnngatgtaaagtantttttnttnagnaagtntaannntggagatgaagaaggtgtggagattnanagnaanaacanagagaaattgaaaanganatnatttanaanaaagagagaaattatttttatngagnatggatggaaggatagncataaggnagatgttaattatnatgtaagagaatatatagtgagggannaagatgttaatatttttgttgttaagtggagtaaaattgttgaaaaaggttatttaaagtataggggtntatg

SEQ ID NO: 9527 - DNA, 693 bp, Diabrotica virgifera
  misc_feature (10)..(29): n is a, c, g, or t
cttcactggnnnnnnnnnnnnnnnnnnnncagaatgcatccttctttaactcatctatatatggctattgcctctttcaactggtcatccactgttggcagtttggttacaatataaattatacagagaaaattatggaataaattcatttttttcgagaatagggcatttacggtgtttttctccaaagtggcctattctcgaaaaagtgaatttattccataattttgaacctctctatgaatatatgagtctctatgcttcatctgttatcttatcaatcttaaacatctgttatcttagtaatgatagaagtaagtatgatttttagtatatttttcatgaaaatacacataaaaatatgttttcggtcttaactacataactgtttcacatgcataatttgtattgtgtacctatatagcagttagcatattatgtaaattcggcttttaaataaaagtttattaaaacgttatttaaataaaagtttgttacgattccccacttttcatacaccatgtaaaatataaactaaaaactcttcaatttctctccaacaccaaaacaatccgaaatacaaaaatttgcaagactggttgatattctccattttatttatttcacattttttaagcgtataaacttgccatatcttaaaagcatattgctgaaaatcaacatattttcaat

SEQ ID NO: 9528 - DNA, 586 bp, Diabrotica virgifera
  misc_feature (54)..(54): n is a, c, g, or t
  misc_feature (56)..(56): n is a, c, g, or t
  misc_feature (65)..(65): n is a, c, g, or t
  misc_feature (67)..(68): n is a, c, g, or t
  misc_feature (74)..(74): n is a, c, g, or t
  misc_feature (79)..(79): n is a, c, g, or t
  misc_feature (83)..(83): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (110)..(110): n is a, c, g, or t
  misc_feature (114)..(114): n is a, c, g, or t
  misc_feature (125)..(125): n is a, c, g, or t
  misc_feature (137)..(137): n is a, c, g, or t
  misc_feature (142)..(142): n is a, c, g, or t
  misc_feature (144)..(145): n is a, c, g, or t
  misc_feature (150)..(150): n is a, c, g, or t
  misc_feature (154)..(154): n is a, c, g, or t
  misc_feature (161)..(161): n is a, c, g, or t
  misc_feature (187)..(187): n is a, c, g, or t
  misc_feature (191)..(191): n is a, c, g, or t
  misc_feature (214)..(214): n is a, c, g, or t
  misc_feature (321)..(322): n is a, c, g, or t
  misc_feature (344)..(344): n is a, c, g, or t
  misc_feature (434)..(434): n is a, c, g, or t
  misc_feature (453)..(453): n is a, c, g, or t
cccttcaggtcctttctgtctagtgagcagtgatcgaccaccccttaaacaggngngacgacgangnngcggcncaggncgangacaacgganccggnangngcaaagcngganccgccggagangacgcaccccgngccgncnnccccncaancgacggncgcccaaggcaacaaggcgccagggncggnacgggacaaaaagacccacacgnaggagacgaagcccaaagcaaaagaggcacccacacaccgaaacaccccacggaacacggcaacaccaccaacggggacgacagggaaaaacaccggcaccacaccnnccacaacgaacgccgagcagcnccagaagaacacccaggccccccccacagaagccccacccaaccccaaggcaaacagagaaaagaggacccgaaccacgaccgaaaccancaaaacacccgccaagaangaagccacccaagccgaaccccccccgaacgcagccggccgaacaaaagagaacggaggggacgcgggaaagggcggcacccacaccggccccaagccccgaaggcgccgcaccaaccccacgccaaccgccg

SEQ ID NO: 9529 - DNA, 297 bp, Diabrotica virgifera
  misc_feature (11)..(11): n is a, c, g, or t
  misc_feature (13)..(13): n is a, c, g, or t
  misc_feature (17)..(17): n is a, c, g, or t
  misc_feature (21)..(21): n is a, c, g, or t
  misc_feature (55)..(56): n is a, c, g, or t
  misc_feature (58)..(58): n is a, c, g, or t
  misc_feature (69)..(69): n is a, c, g, or t
  misc_feature (73)..(73): n is a, c, g, or t
  misc_feature (89)..(89): n is a, c, g, or t
  misc_feature (97)..(97): n is a, c, g, or t
  misc_feature (102)..(102): n is a, c, g, or t
  misc_feature (113)..(113): n is a, c, g, or t
  misc_feature (124)..(124): n is a, c, g, or t
  misc_feature (138)..(138): n is a, c, g, or t
  misc_feature (176)..(176): n is a, c, g, or t
  misc_feature (203)..(203): n is a, c, g, or t
  misc_feature (227)..(227): n is a, c, g, or t
  misc_feature (233)..(233): n is a, c, g, or t
aataatttttngntttntttntaaagtattaagggataagtgagagaaaaaaagnntntgagaagaatnatanaataaaattgtgtgtnggttgtgnttttnggaaaaggaantaaattgtgtntttgataataattntgaaaaaaagaatttagaagattttggagaaagatgtnatttttaggaaaatatgtgaaaattgnagtaaagtggttgttaaaatgaangaattnatagagagatgtattaggagggagaagaatattaaggaaaaatgtattgaatatttgaaagaga

SEQ ID NO: 9530 - DNA, 837 bp, Diabrotica virgifera
  misc_feature (373)..(389): n is a, c, g, or t
  misc_feature (543)..(561): n is a, c, g, or t
  misc_feature (656)..(675): n is a, c, g, or t
  misc_feature (701)..(723): n is a, c, g, or t
  misc_feature (775)..(775): n is a, c, g, or t
agatcaaagaggtggtggaagagatatagaaagacgagacagttacgggtaagtttagttttttaacgtaacacaattattaaattacaatttaagaaaggagtatcgaagtttgtggtgtataatcgtatttttaaatgaaggaaagttaaaagtgatatgtaacgtcagaatttgtattatattctacgtgtaccgtccaaagaagaagacaggataatatgatccggatttgatatatttcaagaaattaaacttactaccaaagatttgcaagaagcgaattatcaagtcattcgacatttttatctgtaaattaaaagctgttaactaaaaaaatggtatttttgtatataccggaagatattggcannnnnnnnnnnnnnnnnctgaagaagtagaggattatcatggattgatgatatggagaagaacttaaaattctaagggtcagaagatgagggaaattttaggaatcaatgtatgtggcaacttctctatgagaagaccaagttctctaaagaattgttgagccatttatgnnnnnnnnnnnnnnnnnnncttaaggcggttttccacttatttctttttgcataaaactcattgcattataaccaaaccacttgggtgtaagattctgttctgtgttagattcnnnnnnnnnnnnnnnnnnnngttcctttcacgttgatgttcgtgannnnnnnnnnnnnnnnnnnnnnnatttctatccagttgatatcaatttggcaatttctttgtactaatccatatncagatgtgatccatattattacttcagaaatctatcttcagaaatggtctgttacatttcac

SEQ ID NO: 9531 - DNA, 130 bp, Diabrotica virgifera
  misc_feature (10)..(79): n is a, c, g, or t
  misc_feature (81)..(123): n is a, c, g, or t
tttttattcnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctc

SEQ ID NO: 9532 - DNA, 840 bp, Diabrotica virgifera
  misc_feature (2)..(777): n is a, c, g, or t
  misc_feature (789)..(789): n is a, c, g, or t
  misc_feature (801)..(828): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattattgatangttcttttagtnnnnnnnnnnnnnnnnnnnnnnnnnnnnctaattcggcgt

SEQ ID NO: 9533 - DNA, 507 bp, Diabrotica virgifera
  misc_feature (179)..(200): n is a, c, g, or t
cccctcttaagatcattttccttaaaacctagcaagaagggtagcgtgactactagtacacgattattgggggagaacatcgattctttagcaattatctcattgctgtgcgacccttgtgtgcccggcagcaccctgttagacttacctgttcattattttcgactacatctaaaggnnnnnnnnnnnnnnnnnnnnnnctgctatattgggcggattacttgttcctcgtgatgcgttatgcgattcgtaatgtatctattgattgtataatttattaacatgaattttgtagcattatctttgtaattaaatatctgtaaatgagtaatatggcaaatactagcgtatgatctgtcgaatgattctggattgctattcaattgatgtatcaaagtaacgtttctgagttttcatattttttgacacgcaatttttcaatcttatacctcattattatcatgttttataattctgctaataacttattgccatgatttatgtcaa

SEQ ID NO: 9534 - DNA, 131 bp, Diabrotica virgifera
  misc_feature (11)..(80): n is a, c, g, or t
  misc_feature (82)..(124): n is a, c, g, or t
atttttattcnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctc

SEQ ID NO: 9535 - DNA, 300 bp, Diabrotica virgifera
gggtcgctcgtaggggcggtcctagtcggtgggccgatagacgtactaacggaatatgaatctgtaaatcgaaaaagcggcaagaaaacgcacgcagcgccagttcaccggtacctggcgactggtggacgtggcagtggcgggggaagggtaattacacccagcaagaaaaggggggaggataatgacgataataccatctttattatacgttttctacaagatagcaccatcacaaacatacattattgcctaaattggccattcacctcttcgtggtcagtacctggtcattttggg

SEQ ID NO: 9536 - DNA, 828 bp, Diabrotica virgifera
  misc_feature (2)..(819): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaatta

SEQ ID NO: 9537 - DNA, 889 bp, Diabrotica virgifera
  misc_feature (794)..(815): n is a, c, g, or t
aggagagcaatatttatgaaactgtgcatgcaagtgcagtgacacagaaggcatctgttgtcatattttttgttactgttccacttcccgtttcaccggaaatacccctgtcccatttgaagtaaataagctatggggatttccggtgaaaccggaagtggagtagtaggggaaaatatggcatcagatgccttttgcgtcgctttacttgcatgcggggtttcatgaatattgttcttttcgtttcggagatatttgcttggttctgtactttatcccaactctgtatatttatttgctatcaccagatatgccagtaacgagttgacattgatgtctaaataatgaatgatgaataatgaataatctctgctttactttctccgtatctataaataaatcgtaattgttttgttatgatttcatacctgaatgtgaccatgaaatattattagtacaaaattgctgactccgttgtttttcaaaacgagtggtctacattgcagaagcaatgtcacctactttacgaaatcaaaacaatgcgtgtaaataatatttgtttgagacttttaaaaactaaatcgatatggattactcttatttttttttaatactaatataaatcctgtacactgttttcattttattgaaggaaagagcgtcgttttatttcgagtccgcggttgtattgttcacttagctcacatcccaaatacttgcatcggggtactttctctacttgtcctttaacgtagattgtttcgtttcaatcttgttcttactgacaatcatgnnnnnnnnnnnnnnnnnnnnnncaggggcatttcatacctctcgcagtactgcgtacgcgtagtgcgatcaaccaaatgtgcagcccttctctgct

SEQ ID NO: 9538 - DNA, 885 bp, Diabrotica virgifera
  misc_feature (13)..(31): n is a, c, g, or t
  misc_feature (33)..(82): n is a, c, g, or t
  misc_feature (84)..(128): n is a, c, g, or t
  misc_feature (136)..(875): n is a, c, g, or t
tttttatcttatnnnnnnnnnnnnnnnnnnncnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttagt

SEQ ID NO: 9539 - DNA, 554 bp, Diabrotica virgifera
ttaagcaaatacaactattcagaatggccacaaaatatatcaccgtactcttggtttgcatgtatcttcacacaggatattgctcacttagttttcaagatttgggtgaacatctacaaactgatggtatcaaatgggcagaacgttgccatgccattactggagttaccgaagaagcagtcgaagatgccatgaaaggaatatttccagacacctttgggccatatattacttgtctttggttaacttcagaagtgatgactccaactatggatattatacccgaaaaactgaaatattatttgaacgaaaaggttcttaaatcagatgaaattgcacaatacattccatgtgctgccaatgccagaaagttaggagacgatgtacccttcaataaaaaagtcttggaaatgaacaagtgccattacaaaattaatccagataaatacatcatattttaagacagcttaagaggaaccggactgatttaatttatgtcaaaaaacttggcttgatacttatttgtagaaactgtaatatatattctccacaac

SEQ ID NO: 9540 - DNA, 51 bp, Diabrotica virgifera; identical to SEQ ID NO: 9123
  misc_feature (2)..(44): n is a, c, g, or t

SEQ ID NO: 9541 - DNA, 648 bp, Diabrotica virgifera
  misc_feature (83)..(103): n is a, c, g, or t
  misc_feature (124)..(142): n is a, c, g, or t
  misc_feature (145)..(157): n is a, c, g, or t
  misc_feature (163)..(191): n is a, c, g, or t
  misc_feature (193)..(222): n is a, c, g, or t
  misc_feature (240)..(290): n is a, c, g, or t
  misc_feature (292)..(424): n is a, c, g, or t
  misc_feature (427)..(512): n is a, c, g, or t
  misc_feature (575)..(587): n is a, c, g, or t
  misc_feature (590)..(603): n is a, c, g, or t
  misc_feature (608)..(635): n is a, c, g, or t
aaaacacttttacgaaaaggaaaggaaaaatttcactacacggtcgttaaatacgtaaccgggggagaaacatttcattttcnnnnnnnnnnnnnnnnnnnnncggaccttggggatcaggggnnnnnnnnnnnnnnnnnnntcnnnnnnnnnnnnngaattnnnnnnnnnnnnnnnnnnnnnnnnnnnnngnnnnnnnnnnnnnnnnnnnnnnnnnnnnnnaatggaatgagtattcgnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnngtgattatattagtataaaaaatttatattagtaaaatatataggttataaaggatttcggcnnnnnnnnnnnnntgnnnnnnnnnnnnnnggtcnnnnnnnnnnnnnnnnnnnnnnnnnnnngcccactggatta

SEQ ID NO: 9542 - DNA, 888 bp, Diabrotica virgifera
  misc_feature (445)..(467): n is a, c, g, or t
  misc_feature (855)..(874): n is a, c, g, or t
  misc_feature (883)..(883): n is a, c, g, or t
tagaaaaaaaagcatgtgtcaaaaattaaatcttttaaaatctcacttccagtagaattcttctcatccggcgtacaatgtacgccaacgcgtgtagttaatgagttaaacaattaaaaaacatcaaaaacattttttttatcgattattcgtgtatcgttcccgcgaacgcatacgttcattcatttgcatcggagaaaaggcagtcaaattaacgtttagagatttgacgcaaactattgaactaaataaaagcgtttaaaaataatgtttcatatttttactcctaactgagtatgggggaccatttttcgttggaatttttccgcactggacaggcgagaagtgaaatgcaacatttgctcccgcatggcgttttgcttgcaaattttagaagcctcgaaggtgttaccagaaaattggtctaaataaagttttagtttgnnnnnnnnnnnnnnnnnnnnnnngtaaaactttcccttgtttcctataataatttcaaattaaacaatggttgtgagtgcaatcattcaattattcattattggttaatattatttctcgaatatttcattgtttcaacccctaagaatcagcctttcttacaaaatattgtagaaatagttatttatgtaccaagtcagttaagtgactctttatcgaacgagtctgatattacgaacagagggagcgaagcgagcgagacgagtaacagacgcattcgataaagggtttttactgacgtggtgtaggtatataaaattttatcgccaatcataaaaaacattaacacttacttgcatccttctaatgaaaaaagagtgtgtgtactttatacgcacagaagaagtatannnnnnnnnnnnnnnnnnnnacaaaatanatata

SEQ ID NO: 9543 - DNA, 1008 bp, Diabrotica virgifera
  misc_feature (725)..(747): n is a, c, g, or t
  misc_feature (975)..(993): n is a, c, g, or t
tcccccgggcgaagaaatggaaatcgtaaataccatctctgatcttttacacgtggagagagatataacttactccaattgattatgcagggaaaagatttaaggaaaaagaagcataaggagacgcagaatatcgtgactgcgcaacctgagagaatggtacggatatacatcaaatgaacttttcagagcagccgtttctaaaatccgaatagctatgatgattgccgacctccgtcacggagatgatacttgacgaacaatatggaatgttcataaatcccattttggattctacgattggcttatcctatatgtaagatcgaggaccgtctgcacaaggaatttcataaactctgtgctgttcatttgggaaattgtcttagactgatcggacaaatgataaaaaagtttttgttagggagtaaaaattgtctttattccttgtggtttgaggattttgtagattttgtcagtaaagctggatttatagtttggcgtgacgtagacgtagacgcactggaaaagttcaacaccgaattttgtgtacttttatttataaacgaacgtaaacgcatgacggaacgtaagagaaaacggaacggaagagttcgccaactttcatcttttctttctgtcacccaaagtgaacccgccctcatccatttagttgtttatcaacatattcgaattttgttaattatttgttacaatggatgttaagnnnnnnnnnnnnnnnnnnnnnnncatagagtaatttcaatatttcagataaatatgagttgtttattagcctaattcggggctatccacacatatataccataggtttataataaatccaataaacattttaaagaccaggaaatgaaacaaaatagttagaaatcccacggcaccgaggagcataccttcgtgtatttcctatgtcctaatcatgtacacacaaaacgataaattttataataatatagnnnnnnnnnnnnnnnnnnngcttgttacgggtcg

SEQ ID NO: 9544 - DNA, 866 bp, Diabrotica virgifera
  misc_feature (26)..(69): n is a, c, g, or t
  misc_feature (76)..(91): n is a, c, g, or t
  misc_feature (93)..(135): n is a, c, g, or t
  misc_feature (143)..(864): n is a, c, g, or t
cccacgcgtccgtttccaccactttnnnnnnnnnnnnnnnnnnnnnnnnnnnnnnnnnnnnnnnnnnnncttaacnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnta

SEQ ID NO: 9545 - DNA, 77 bp, Diabrotica virgifera
  misc_feature (5)..(30): n is a, c, g, or t
  misc_feature (37)..(59): n is a, c, g, or t
  misc_feature (61)..(76): n is a, c, g, or t
attcnnnnnnnnnnnnnnnnnnnnnnnnnncgtaaannnnnnnnnnnnnnnnnnnnnnngnnnnnnnnnnnnnnnnc

SEQ ID NO: 9546 - DNA, 865 bp, Diabrotica virgifera
  misc_feature (803)..(803): n is a, c, g, or t
  misc_feature (842)..(842): n is a, c, g, or t
ccttttcgggattttcggacgttttttcggttttaaatgtctataaagcactcacggacgaacgtgctcttccacgctcacaccccaacggtagaattcatcaaatatcgatacagtgagatcatcgctagacacgcaccggaaccaggggatcgtacgtgttcttttaagtataaaggggcaagcccaacccgaagcagtcagaagacatttgcaggaagtggttcgacgaagagataaaacgggaaacttggcatttttaagacttaggcattgtttggtaactaagtgtggatcttatcggttggcaaaactcggagttcaatttggatcagcatttgacagtcgttccatttacttataaaggaagagctgtgacagaatataacatacaagattatgtgaacgagatagtttcaaaatatatgcctggaaatatttctccctggcaaataacaataataccttcttcagaagatcaacattatattctattcagactacaccacatacttctttctgaaggccttaacataggagacttgctacctttaatacctccaactcggccgccagttgggtcgtatgtatcaagaagccctttggtagaagtatttaaaaaacctgaagtcatccttgtactaaaagatcgattaacagaagaattatccaaccgttggaatgagttcgtagcaaataatgatccactagaacgaccagagttactaaaaagtaccccaacttttttccagtttgtatcatactgcctactaagctttgtctctgttattagagactgcagnaaaggttttagagtaattaaaccagatgctttttctagnattcaatatgtagtacaatctgt

SEQ ID NO: 9547 - DNA, 908 bp, Diabrotica virgifera
  misc_feature (859)..(859): n is a, c, g, or t
cgagacgcgtcgggcgcaatttccgcacatcaccatcgtggatctttcgcacattagcgataaatctccggcggacggtgcgaaattctcgcgctataaaatcgcggaatttcgcacattagcgcggaattctcgctcgacgtgcgatattccgcactatatcattgcggagtttcgctcattttcatcacaagaatgaaaccatttcttttttatttgggccatgtcgtttttgaaccatcgcaatggattggaacaaaaaattcggaattccgcacattaccattcggaatttcacacattagctccaaattctgcggatatgcgaaattctgcggatgtgcgagattacgcgcaatactatcatggaatttcgcacatttccatgacaagaatcaaatcatgtccttttaatttggaccatatcgtttttgaaccatcgcaatggattgaaacgaaaaaaattcggaattccgcacattaccctggcgaaattacgcacattagcgagaaattctgcgtatgtgcaaaattccgcactatatcattgcggaatttcgcactttttcatggcaagaattgaacatttcttttttatttggacgatgtcctgtttgggccatcacaatggataggaacgaaaaaaattcggaattccgcattacaccatggcgtaatttttcacgttagcgcgacattccgcggatgtgcgaaatggcgcaattttatttttgtaattataaaagcaaattaatgtttttgaaataattcactgagtaatggtttttcttttccccttcatatttcatatgtgtagcattcctacttatgttaatagcaatttaaaagaatctattgngattttaaatcattatatagagcgtatagagcagtttctctgggactat

SEQ ID NO: 9548 - DNA, 930 bp, Diabrotica virgifera
  misc_feature (141)..(165): n is a, c, g, or t
  misc_feature (887)..(887): n is a, c, g, or t
taatcgtctatacgaatggtgcttttatactcttaagttgtttagttatcgataaacaattacttatctagaaaaccgaaatctcgaaaaacccgcattttccgcggaaaattttcgtcgaagtgggtcgggaaaaacacnnnnnnnnnnnnnnnnnnnnnnnnntgaatttttatttgtgtctttttggtgtaaaattaaaatatttggagttatggagcagaaattgaaaaaacacgattttggggcgccattttgtttgtgaaaaaagtagcacactatctgcggactttgcatgcctatattattggtatatacaatcatgggattcgattccagcagtgaaattgctggtaaataccttttcccaaaaatggcctattctccgataatctgcccagactataatccgtgtatattaatattatacacggattatacaacaagacagaagctcgaaacaaattactgttcttgaaaagccctattgaaacacccacaaataattgctatgcaatgcatagcatagcatcgcagtctgtgtgaacgtacactttaggctttaagccccaccctcttatctatggcctttaagggaacatactgatccctactcgaaaccctgagacagatatcagaaaactcgggctttttaataatgtcagatttcatcgtttcgttcgtagatgacgtcaccaaatgagtgactttatgaggtttgtaagtagtgtactatataaatcttgctcatatatttggcatcattagcatcaataaaaatagtaaataaagtattttttgtttttacctatttaagactaatgttttttattattttggctgcaaaatttgaggatccccttatttgatatatgagtactaattgngggctttcatttgacacacacctttaccttgagtgacgattat

SEQ ID NO: 9549 - DNA, 665 bp, Diabrotica virgifera
  misc_feature (639)..(657): n is a, c, g, or t
cggcccctttcttccgggttgtatctacccccgtcatatgatcatcgtgggtacggccttgcatgaggagaatgcggatgactactgaacggttgcgggtgactattgcgattgattcgatcttttatcgccgctgggatgctattgatcgcgaggttgctctcttgtatcgacatacccattgtgtattatcgtttacatctaaaggagatagttcgattagcgaccgacttctatattggtacgattctctttccgcggttgagcttatgtgattagaaagtgggctattgagacgtactaagttatataagcacgacaaatgtggcatttcctctgtatgaaactggtagtgaaaacggatagagtgtaatagctgcgtacgatctgtcgacgtttctgggttggttggatttggtagctaacgaagcaacctctctttcgtgtaactataatttctgacacatattatacatcttattacccttattttcaatcatttcttatccgtacactaattattaccattatctttggaatttgaataattttgaaattgacaacctttattatgcttgcaactatttgaacaactaattagtatattccgcttctctacgaacacaaaaaaccatcagnnnnnnnnnnnnnnnnnnntatgaaaa

SEQ ID NO: 9550 - DNA, 735 bp, Diabrotica virgifera
  misc_feature (20)..(20): n is a, c, g, or t
  misc_feature (292)..(292): n is a, c, g, or t
  misc_feature (516)..(543): n is a, c, g, or t
  misc_feature (551)..(551): n is a, c, g, or t
cgcctacaggcggacattangtaatgggatgaaccctgaaagtatggaagagttaaaagataaaaataataaaaagagagtaagtagggtcccaaatagaataatgtatgttaaatggttatggaaataatggtattggttaaggaagaggataaaaagtaattgaaaaaagtgtaataaaaaatgttggaggtaagaatggaaaatatattggtaaggttgaagaattagatttgaatagttatgaaaataatggagatggttatggaaggagttttataaagaataaaanaataaattaaaaaagtagtagttaaatttagggtggtaatatagaagaatgtatattaaatgggaatggagataatggtattggttagggaagagtgttgaaagtaattgaaataaatgtaataaaatatattggaggtaataagggaaaaaatgttggtaatttagaaaaagtagtattaggtggtgatgaaaataatggatatggatatggaagtagttatnnnnnnnnnnnnnnnnnnnnnnnnnnnngtaggagnttaaattagggtggtaaggtagaagaaattatgttaaatggttatggaaataatgtaaggggttaaaaagtagttgaaaaaagtgtaaataaaaattttgtaggtaataagggaaaaaatattggtaatatagaagaattagtattaaatggtaatgaaaataatggatatggatatggaagaa

SEQ ID NO: 9551 - DNA, 733 bp, Diabrotica virgifera
  misc_feature (9)..(52): n is a, c, g, or t
  misc_feature (58)..(99): n is a, c, g, or t
  misc_feature (111)..(222): n is a, c, g, or t
  misc_feature (230)..(392): n is a, c, g, or t
  misc_feature (417)..(417): n is a, c, g, or t
  misc_feature (422)..(502): n is a, c, g, or t
  misc_feature (504)..(518): n is a, c, g, or t
  misc_feature (520)..(538): n is a, c, g, or t
  misc_feature (540)..(555): n is a, c, g, or t
  misc_feature (677)..(723): n is a, c, g, or t
tctttttcnnnnnnnnnnnnnnnnnnnnnnnnnnnnnnnnnnnnnnnnnnnncggtgnnnnnnnnnnnnnnnnnnnnnnnnnnnnnnnnnnnnnnnnnngtaccttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattaaaattttcatatttttaaanatggnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnntnnnnnnnnnnnnnnnnnnnannnnnnnnnnnnnnnnggttaataaagaggaatctggaacatttttttctccacgtgtattttaaaacatgtctctttggatttaatatataggctcgccctgccactgagttaatttgatggcgcgggatattgagnnnnnnnnnnnnnnnnnnnnnnnnnnnnnnnnnnnnnnnnnnnnnnntaagggttgg

SEQ ID NO: 9552 - DNA, 437 bp, Diabrotica virgifera
  misc_feature (26)..(46): n is a, c, g, or t
gaggagaggggagaggagatctccgnnnnnnnnnnnnnnnnnnnnngatagtgaagaggaattttgttatggtagattttgttgatttgtataatttagatagtggtgagggagagtgtgatattaattgtgttagaagaatggtattacagtgttatgttatataaagagggtgattgtgatattgatattttagaagtgtgtgatggaccgaaatatggtaagggagtgaaaatagagaatgtagtggatttgtcttatggttataaaaaggatgttgttgtggaagaatgggaaatgaaaagattgagtagttttgagtttggtagatgagggaatgtgaggattaatgttgaatggtgaaaatggtgggatttattgaaggtaaatttggttatttattaaaatttgaggtttggataaatttgagaaataat

SEQ ID NO: 9553 - DNA, 673 bp, Diabrotica virgifera
  misc_feature (7)..(56): n is a, c, g, or t
  misc_feature (128)..(238): n is a, c, g, or t
  misc_feature (252)..(668): n is a, c, g, or t
atttatnnnnnnnnnnnnnnnnnnnnnnnnnnnnnnnnnnnnnnnnnnnnnnnnnncacgatagttaatccgtaccgcgagagaaatccttcacttttccaaaagaaaaatttacttttcgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatta

SEQ ID NO: 9554 - DNA, 961 bp, Diabrotica virgifera
  misc_feature (549)..(568): n is a, c, g, or t
  misc_feature (581)..(629): n is a, c, g, or t
ttcgcgtccgtatcgtcagagaggttaaggaacgtaaaattatatccagagaagaaacagaagaagtcaaagagacggaagatgtccaacattatggagatataactgacgaagattttatctcagcagtaagctccggtaaaacagacatccgaaaggtcctccgcacgcaggaaggaaaccaccaagtggtctccactggtccaagactagtcctcgacactaaaaagagcaagaaaaccaccgacacagaagatactcgagaattaagcgccgtccgtgaggatggtaaaatcgtgacagaaacgcagagaactaccgagcacgaagaagttaacgacgatgagcttccggatgatgaacccgatcagaatttccaaaaggagagctctcaaagatatgtaaaaacgaaagagcaggaagacgtcgattacatagccgatggtgtaaacattggacacgaaatgaggttcaaaaccgaaacgatggaagctgatcgtcgcggcgacgggatcgacgaacccgatttgttcgaatcgctttccgcgnnnnnnnnnnnnnnnnnnnntaatcgacagccnnnnnnnnnnnnnnnnnnnnnnnnnnnnnnnnnnnnnnnnnnnnnnnnntacaccgaacaacgccattcacccccttaccaatccccatcgccatattcaggtgatcgtacccgccgatcacctagtcccgactaccgtccctcccattcgcctgtacccgattataggaagcaacattcccctcattctccaactcccgattacatacgaaatcagcattcgcctgttccggactattcccgaaacgcacgaatgtcgcccaagaggggagtggtcaccatcactcctaccccgccgaggagaacgaagaacgagagacagcgtccacgagtaggtgatgataggagcaggtacgataacgaatatcgaaatacgagacg

SEQ ID NO: 9555 - DNA, 578 bp, Diabrotica virgifera
  misc_feature (17)..(17): n is a, c, g, or t
  misc_feature (20)..(42): n is a, c, g, or t
  misc_feature (224)..(243): n is a, c, g, or t
tttttcaaaaggccggncgnnnnnnnnnnnnnnnnnnnnnnnttatctttaaaaggtatgaagataggaaaaattaagagggaaaaaaaagggtgaggagaaaaatataagttaataaatctttgggggggggcaataaaggattggaggggtgaaaaataaaggttgtggaattgtttttttgatagggagatgaaaattggtttggagatgaaattttgaannnnnnnnnnnnnnnnnnnntatattgaaataatgatgaaaaagggaaatgtcttttttattttgaatatatatggttgattttgagttgaaaagttttgaggaatgggtagtgtggtttttttaaaaaattgggtgaatattaaaaagttggataaaaatggtgccgaaagatgggggaattgtgtataatggaggtgtttaaaatgaagaaagtatggatttttttttgtaggatttgtaagaaatttgtaggttgggtgtagaatttgagaaggatgttgaagaaggatggaaaaaatttgtttttgttgaagacgaaattgtagtatgtgatgacagagtatatgttggaa

SEQ ID NO: 9556 - DNA, 618 bp, Diabrotica virgifera
  misc_feature (2)..(50): n is a, c, g, or t
  misc_feature (52)..(162): n is a, c, g, or t
  misc_feature (171)..(603): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaattttgaccgg

SEQ ID NO: 9557 - DNA, 571 bp, Diabrotica virgifera
  misc_feature (320)..(337): n is a, c, g, or t
  misc_feature (419)..(440): n is a, c, g, or t
gccggacagaggattaggaggtaggaagatgtctttaagggagaaagaaagtggattggaaggaggtaagaggggggagggaatgaaaggagaaggggatagatccggtttatatgtaaaaattatgagatggggagaaggttgtatgggggttgggagatgtagttatatatatatgtttttttgggggtagagtagatgtatagggaaattttatttttgttgaaatatgaaaatgattttaatagtttaaatattataaggaaattagagtttatatgaaattttttatgttttgatatatatgagaatatagatgnnnnnnnnnnnnnnnnnnaagagatgaaaaacatagatatgggagataatattttaagtggatattacaatgaatttagaatgttaattgtaatatttgnnnnnnnnnnnnnnnnnnnnnngatatggtgataggtatgttaatatagggtagttatttgtaaaaaaggattgtggtatggaaaaagaaaattaaatggagtgagatatagaagatgatagtttaaataggagtgtatgagatggtattttt

SEQ ID NO: 9558 - DNA, 169 bp, Diabrotica virgifera
  misc_feature (2)..(133): n is a, c, g, or t
  misc_feature (157)..(157): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagangtcaaatcgata

SEQ ID NO: 9559 - DNA, 79 bp, Diabrotica virgifera
gaactggtcactgccagaagaccaggaacgcttaaacgttttaagtgaaaatcatcaaaagaatctatctatcgatcta

SEQ ID NO: 9560 - DNA, 587 bp, Diabrotica virgifera
  misc_feature (21)..(38): n is a, c, g, or t
  misc_feature (45)..(88): n is a, c, g, or t
  misc_feature (91)..(145): n is a, c, g, or t
  misc_feature (155)..(211): n is a, c, g, or t
  misc_feature (268)..(294): n is a, c, g, or t
  misc_feature (300)..(357): n is a, c, g, or t
  misc_feature (371)..(407): n is a, c, g, or t
  misc_feature (419)..(501): n is a, c, g, or t
  misc_feature (533)..(586): n is a, c, g, or t
cacaaccaaaccaccaccacnnnnnnnnnnnnnnnnnnccccccnnnnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnctccccccannnnnnnnnnnnnnnnnnnnnnnnnnnnnnnnnnnnnnnnnnnnnnnnnnnnnnnnngggggggggagaggggaggagaaagggcagcgcctcccccccccctcgcccccgccnnnnnnnnnnnnnnnnnnnnnnnnnnncgggcnnnnnnnnnnnnnnnnnnnnnnnnnnnnnnnnnnnnnnnnnnnnnnnnnnnnnnnnnntctccccctctccnnnnnnnnnnnnnnnnnnnnnnnnnnnnnnnnnnnnngtggagggggannnnnnnnnnnnnnnnnnnnnnnnnnnnnnnnnnnnnnnnnnnnnnnnnnnnnnnnnnnnnnnnnnnnnnnnnnnnnnnnnnntctttttcttttaaatcacacacaacaaggannnnnnnnnnnnnnnnnnnnnnnnnnnnnnnnnnnnnnnnnnnnnnnnnnnnnng

SEQ ID NO: 9561 - DNA, 1096 bp, Diabrotica virgifera
  misc_feature (12)..(70): n is a, c, g, or t
  misc_feature (74)..(149): n is a, c, g, or t
  misc_feature (153)..(180): n is a, c, g, or t
  misc_feature (221)..(241): n is a, c, g, or t
  misc_feature (267)..(303): n is a, c, g, or t
  misc_feature (316)..(383): n is a, c, g, or t
  misc_feature (385)..(440): n is a, c, g, or t
  misc_feature (454)..(471): n is a, c, g, or t
  misc_feature (480)..(497): n is a, c, g, or t
  misc_feature (499)..(572): n is a, c, g, or t
  misc_feature (617)..(641): n is a, c, g, or t
  misc_feature (673)..(713): n is a, c, g, or t
  misc_feature (781)..(821): n is a, c, g, or t
  misc_feature (978)..(991): n is a, c, g, or t
  misc_feature (993)..(1082): n is a, c, g, or t
gggggggggagnnnnnnnnnnnnnnnnnnnnnnnnnnnnnnnnnnnnnnnnnnnnnnnnnnnnnnnnnnnctcnnnnnnnnnnnnnnnnnnnnnnnnnnnnnnnnnnnnnnnnnnnnnnnnnnnnnnnnnnnnnnnnnnnnnnnnnnnnttannnnnnnnnnnnnnnnnnnnnnnnnnnncttttttttggtggggggggagagggagaaaaaaatataannnnnnnnnnnnnnnnnnnnnggcggtgcgctgcttcccccccccgnnnnnnnnnnnnnnnnnnnnnnnnnnnnnnnnnnnnncttccttcccccnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnngcctcgggctcgtnnnnnnnnnnnnnnnnnncggggggtnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnntgtgtgtaaggagaaaaagagagagaaaaaaagaaagtgggggannnnnnnnnnnnnnnnnnnnnnnnnagggcggggggagggggagggagagaagagannnnnnnnnnnnnnnnnnnnnnnnnnnnnnnnnnnnnnnnncccccacacaccccaccccaccaccaacgcagcgcgagaggggaagctaagtgggagaggggagtgtnnnnnnnnnnnnnnnnnnnnnnnnnnnnnnnnnnnnnnnnngtttttgtttggtggtggtgggggtgggggggtggggagggaggaggataagagagagtgattctgttcccctgccccctcccaccatcacaccacccaaaccaccaacaaacaccaaagtcctctcttctttcctttttctttttatctctaacannnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaccacacccc

SEQ ID NO: 9562 - DNA, 560 bp, Diabrotica virgifera
tccgggaatttttctcgcaaactaatgattttttttcgttgcttgaaaccaggttgagatgtgcaaatgaactttggtgggtgttaagacgtaattattgcacgttttttgacatacaatttatattttaataggcgcgagtgatagggcatactttatacagaagtccatcttttactaaagatagatatcataatcgacgttagagtctagtttcatgtggcactgacacgcacgtaagttctttacattatctttcgaaccttgcctgatgaacgtctgattttatttctggaaaggatgttattatgaatcggatgtgaggattgtgatacaaaaatcgtcaacatcataattttgtggtgctgtgagttatcaaaatacaaatattgtcggtaatatctgaccgctgcgttgttaactgtgtgataggatatattattgcttatataggtgatcggtacgttataatattgcatgattatcgcgtgtgtgtgcttttgtaccgttttataataatatcgggcgattatttattgaacactcgtcatattgtccag

SEQ ID NO: 9563 - DNA, 553 bp, Diabrotica virgifera
gccccccttttcgccgagtagctagacgatcacgggctaacgaatttgcaaaattattgtatatagtagagtaaatgttgactctcattgcaataggacatttatgcatttaacttctgtctacaaacctatgacacactaatgttatacactggagcactatatgcggccgactctgaaagatccggattgtcgattttgcgctatattacctcctcgaggttctgcgtctgcacatcatacagggatcgttcaaagtaatagatagccatcgggatgctcgttttgatagtcaatatagagtaggtgtcgtaaagcaaaaatacccaaaagacctttgcaaattgactatcaggaatcacatgagaattacttcgtatcttacattatgagatcaatacatagaatacacgctacaataccctggtctaacaagggaaaggtgtcggaggcgcgagagcacgagacagggaagctcaaagcgacggattactgagtcctccgctccggccgtggattgtggcaggtgcagcgttgtgtattaggatgtatg

SEQ ID NO: 9564 - DNA, 885 bp, Diabrotica virgifera
  misc_feature (14)..(38): n is a, c, g, or t
  misc_feature (56)..(78): n is a, c, g, or t
  misc_feature (269)..(342): n is a, c, g, or t
  misc_feature (347)..(412): n is a, c, g, or t
  misc_feature (430)..(448): n is a, c, g, or t
  misc_feature (457)..(471): n is a, c, g, or t
  misc_feature (473)..(804): n is a, c, g, or t
  misc_feature (806)..(832): n is a, c, g, or t
  misc_feature (834)..(846): n is a, c, g, or t
  misc_feature (848)..(863): n is a, c, g, or t
taatctcttatccnnnnnnnnnnnnnnnnnnnnnnnnntctcgagtcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnncnnnnnnnnnnnnnannnnnnnnnnnnnnnnatgaatgaccgcggaattttga

SEQ ID NO: 9565 - DNA, 255 bp, Diabrotica virgifera
  misc_feature (2)..(61): n is a, c, g, or t
  misc_feature (87)..(134): n is a, c, g, or t
  misc_feature (136)..(214): n is a, c, g, or t
  misc_feature (218)..(247): n is a, c, g, or t
gnnnnnnnnnnnnnnnnnnnnnnnnnnnnnnnnnnnnnnnnnnnnnnnnnnnnnnnnnnnngatagttaattcagtattcgtggagnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnngtannnnnnnnnnnnnnnnnnnnnnnnnnnnnnggaaatgg

SEQ ID NO: 9566 - DNA, 722 bp, Diabrotica virgifera
  misc_feature (28)..(298): n is a, c, g, or t
  misc_feature (300)..(449): n is a, c, g, or t
  misc_feature (454)..(530): n is a, c, g, or t
  misc_feature (544)..(564): n is a, c, g, or t
  misc_feature (575)..(616): n is a, c, g, or t
  misc_feature (618)..(635): n is a, c, g, or t
  misc_feature (643)..(661): n is a, c, g, or t
gtaatgaaatgttattctgtttttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgnnnnnnnnnnnnnnnnnnnnnnnnnnnnnnnnnnnnnnnnnnnnnnnnnnnnnnnnnnnnnnnnnnnnnnnnnnnnnactgtatttaattnnnnnnnnnnnnnnnnnnnnngttggaaagcnnnnnnnnnnnnnnnnnnnnnnnnnnnnnnnnnnnnnnnnnngnnnnnnnnnnnnnnnnnnatatagcnnnnnnnnnnnnnnnnnnngcaaatatagttaatgggggtgggtcaggaatcaaggtaacgtattttataggattatatg

SEQ ID NO: 9567 - DNA, 143 bp, Diabrotica virgifera
  misc_feature (115)..(115): n is a, c, g, or t
gggttttgtggaggtgtagaaaagcaagcgtttttcagtggtttgttgtgagataaaatggtatatgcctacaaattgaatttgagagtaatacgatatttttatcgatcacggntttaagtaacatgaatatttttctatat

SEQ ID NO: 9568 - DNA, 627 bp, Diabrotica virgifera
  misc_feature (421)..(442): n is a, c, g, or t
  misc_feature (507)..(524): n is a, c, g, or t
gttaacatgtctctggttaacaatagaccaggctagggatatgccactcaatgcatcgggatgtaacgccaatatcaagtacggtggtctagctatctttatctgtcgtacgagtgtgagcttatctaccaagaggtgggagtaatggaacgacacagacacagcgaccatcatatgctagagagagaaagctaagcgccggtagagagagatagataggccactgacccgaacggctccgcattacgctatttttcgaaccttgcctaatctacgtattattatatttatggaatggaggcttttaagaagcggctgtgtggctaaagataggaaaatctagaagaagaaacaaattgtgttgatgaattttatcaatttacaaaaattatcgtttagatctgaccgctgccttgatagnnnnnnnnnnnnnnnnnnnnnngcttttttatatgatttttacgtaattttattataggattttagcgtgtgttttcaatttatacnnnnnnnnnnnnnnnnnngtgtgattatttattaaacacttgttatattgtcaattttttaaaagattattgttgtttcagttgtacaccaagaattttagaatatatcaattatataacg

SEQ ID NO: 9569 - DNA, 898 bp, Diabrotica virgifera
  misc_feature (290)..(290): n is a, c, g, or t
  misc_feature (580)..(595): n is a, c, g, or t
  misc_feature (808)..(808): n is a, c, g, or t
agataacatacgccagtgaaagtatataaacgtagcaaacggaaaactaataaactatagtggttcaaattagcttgcaagttttttcaacgtttttcgttcacccaattggttttattagttattttgctgggccccctaatcctaatgttaaaaaatattattggggtatgtttggcgtttttccacagctcaggtatgaaatacaacgagaacactaatagatgggaaggtaattggtttccacattcacccaatgagttggaccaaaatccagtgggccaacttanaggatccaacaatggggataacaaacacggagttattatgggtatacgaaaccctgaatgtgacgatgcaaaaacgaatttaacattagattgggacatgaatccgacgaattatacatgttttggtgggaaagacttatacgagccccacaggtatattcatcccgttcataggtatgaatatatacctgcatcatatcaagcaccacaccaatgtatggatggattcatagaataccgcgaaattggttctcctttggaacacaacggtctccttgggcgaaatattnnnnnnnnnnnnnnnnttctagacagcgttggattcatattttagacatggcgcagtcgtgatgctttatcatccatgcgcgaataaaacgaagttaatttacttaaggagatagttagggggatggtttgtttaaacatgttataacgccatataatctcttaagtcctaataggcctttagcgttattaacgtggggacatcgtttagaaatgtccaaaatttccanaagcctagtcgtaagatttatacgagaccatgcccatcgaggacccgaagatactttttaagatgggccatacgatttttatcttactcg

SEQ ID NO: 9570 - DNA, 375 bp, Diabrotica virgifera
actagttctagatgcgatgtcttctgatattctttaattgcggatatgttctaatccattagctagacgaaccctgactgaatcatttatctttgttaggctttgctccgtacattcgatctttcacatacattatgaacatgttacatttggctctggaggagggagcatgacagaacatcggcttagtttgctacacggtgcccgagcttctaccacgcagatcaggcccgctatcggaagtgggttaacatcaccgctctcgaaggtgtttcggctggccctcttgacccggacttgcatggacgctggcgcccattgtgctcccttaaattgctcatccttaaaatcctccgacgtgccccatctctcttt

SEQ ID NO: 9571 - DNA, 53 bp, Diabrotica virgifera
  misc_feature (6)..(39): n is a, c, g, or t
gtccgnnnnnnnnnnnnnnnnnnnnnnnnnnnnnnnnnnttacgaaaaggaaa

SEQ ID NO: 9572 - DNA, 872 bp, Diabrotica virgifera
  misc_feature (262)..(296): n is a, c, g, or t
  misc_feature (596)..(596): n is a, c, g, or t
  misc_feature (853)..(853): n is a, c, g, or t
cacgaagggtcacgttcagcaccgcacgttccacggctcggtggtgtgactctagaggtttatttgcgagattttcgcatcaatattaaagtctccgctccataagtttgtacgggcaaaacacattagttataaacctttcgcttgagacacatgagaagtgagttttttagaatatggcttagtttgccaaatgctgccctttcttcttcttgcagtaccgtctcctatcggagggtggctaccatcacagcaatcttannnnnnnnnnnnnnnnnnnnnnnnnnnnnnnnnnnattgaactggcacccataccactcccttaaatttcgcaaccaggaaatcctcctacgtcccatatttctctttcccgagatttttccttggattatgagtcttagcagagagtacttttctcctctcattatgtggcctagatactccagttttttcgtttggatggtttttatgacttcgcattccttccccatctttagcaaaacatcttgatttgttactctttctggccatggtattttccacattctcctggtacaccacatctcgaatgcctcaatggtttttgagtttatcanaaacatttgaaaactcaaaggctgcccatggtcaagcctattcgcctctggattttatgtgtttgattgtctctgcttattttaatctcgtgtcccagatatttgtacgtgtctgtttgttgtatggtattaatgtcaatagttatatttccactcgagatttgtcataagtttagttttctcaaagtttatttttaatcctactctatcagacagagtttcaagcgaatgacaaactgggtcatcgatttccattntagtggttatgaaatggta

SEQ ID NO: 9573 - DNA, 917 bp, Diabrotica virgifera
acagaatctagtagcgagtgcgtaacatttagacatttcgtttttcttatttcttactgacagaaatcaggtggcttaaaaatagatgttttaaaagatttttaggttatggaactttagaatggagttttgtgattagaactattgaaaatattgcaggatgcaattaaaaatttctaggaaagtattaataccatgtatttaggaatagttaagaaataaagagtcatggatttcgtgatcgggggtttggctgcaagcggggcagctatattcagcaaccccttcgatgtggtcaagacacgtatgcaattgcaaggagaactacaagcgagagggaaacaccaagttttttacaaaaacgtcttccacgctggttgggtcatagcgaaaaatgaaggcattcgagggcttcagaaaggactcggaactgctatactcatgcattctgtcagaaacagtaccagactaggtatctatcaatggctacataagaaggaatacttgactaacgaacacggcaaaactatttttcaccgcagtgccttagccagcgccttttccggagcagctggagcatttttgggtagtcctctcttcctagttaagacgcaacttcaagcacaggctgctgataatatatcggtaggcacacagcacggtcacaagggagcctttgcagcgtttagaactatttatcatcaagatgggatatctggattgtggagaggtggcaatgcagtggtcctaagagcagttgtaggctcctcagcgcaactaacttcctttgctataaccaaagatatgttaagagattatgaagtatttgtcaggtatcccatagtgacttcgttcgttgccagtattataggaggggtgttccagtgtatattgatgaatccattcgatttggtctc

SEQ ID NO: 9574 - DNA, 558 bp, Diabrotica virgifera
  misc_feature (2)..(20): n is a, c, g, or t
  misc_feature (29)..(43): n is a, c, g, or t
  misc_feature (45)..(61): n is a, c, g, or t
  misc_feature (64)..(82): n is a, c, g, or t
  misc_feature (97)..(117): n is a, c, g, or t
gnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccggggccattcaaatcaatcagctggccaggcgagactttatatttaatacaaaaagacatgtttttaatatacaggtgaaaaagatggtgccgaattcctttattaaacctatatatttttactaactacacaattttttagtactaatattatcatcattactaaatttaaatactttaacttgagtattttaatagaaaatttatacaaaataaaaagaacaatatatctacttaaataagaacatatttcaacaaatgagacgttttaatcctatttattattgaaaaatcagactctattaatatcttatcatttaggatcgtctctactactattcaagattagtaccacaaacatatgtaatcatacgtctatagtgtattcaatgagtttaatttattgctaaac

SEQ ID NO: 9575 - DNA, 930 bp, Diabrotica virgifera
  misc_feature (258)..(282): n is a, c, g, or t
caaattcggaaatctctcaatcaagtggcatccggcttcgattcttcactttttcatcatcagccgaaaaacacgaaaccgcgttcatctttcacattcgtttcgttatcatttatcatcatcactctaatctcgcatcgatctcatccatcattttattctcgtttaattcgacgaataattttatcggaaatttcgagcaactaagtccagtgttttaaactcactatttttctacagtatagttcttagttcagnnnnnnnnnnnnnnnnnnnnnnnnnctcgagtttggacgagaattacctaatttgtttatagctattaaaactacaatttcccggtaatatatattataagcccagtctcagtaacttatttcaagaacctatattgcaaaattttctactttacctcacactaaactattttttgacatactcttttgtgtttctccgcatacttgtggaatgtttttaaatatctgcaattgtacttacaaggctttttcaacaaacaaaatacaatctcaaaatgtattttgttaagcatgacctaacgttttttgaattcagggtggaatgatccattctcgtgcagtaccttcagaggactcttgctcacagatacacctatagcacagtaaggtccataccctcatccggactaagcatgcggtaggtcatctccagaccggtgcatcgcatagataccccttcatctcactctgctgcagattcctccctaatatttctttctgacaattcgagttactgcctccagtattgtcgtttattcagtctttcccctcattgtaaccccaaccaacatttgcacttaccataccaacctttctgtgtaattcgtttctgtcatcatcatactttctgcactcgaatgcacagtgcttggctgtgtcagcaactccacag

SEQ ID NO: 9576 - DNA, 924 bp, Diabrotica virgifera
  misc_feature (92)..(118): n is a, c, g, or t
  misc_feature (271)..(296): n is a, c, g, or t
  misc_feature (454)..(472): n is a, c, g, or t
atttaccagaacacaatacagtggaaccccgttaactcggattaatcgggaccgcggccgatccgggttatcgaaaattcgggttagccggnnnnnnnnnnnnnnnnnnnnnnnnnnnggtatgcttacagataaactccgttataattggcacacagacacttgtaaaccacgttcgcgttccacacatacaaagcgtcgtcgagagtctcatttttagctttcttagctttgcaccgattgtccaaactgtcttttgttatcattttgnnnnnnnnnnnnnnnnnnnnnnnnnnttgccattacgtagacaaaaaatcacgcaaacacaacaaaatctgaatatatttacgcggaacgaacaatgagactttactacacacacacaataccgtctcgcaacgagaacgaacttagggtatttaataagagtgaagactaagaacattggttnnnnnnnnnnnnnnnnnnngtcttttcttaaccatgctagacaggttccagtaaataaaggatacagggaccggtgctaaggtatcaagtggccggctgcgaaacatacacaagcggcctttggttttctaaaattaacattttgtgtgacacccagcagaaaaaaaagctcattatggcgcccccctcaacaacggcggccgggctgcagtggattcctttcaaggccggtatcgccggttctgactaccgatggctatatggttccataaccacaagatggagggttgcctgccataccagttatttttactaaggtatattatgtatcaaattacacaaatacgcattatctctcattgtataatgtgtttgacattgaaaatgaaacgaatgaactacataggaattcgctaaaacgacaaatttttacgaagaaaggttattatgataaataaaattagcctgaaa

SEQ ID NO: 9577 - DNA, 923 bp, Diabrotica virgifera
  misc_feature (5)..(24): n is a, c, g, or t
  misc_feature (99)..(116): n is a, c, g, or t
  misc_feature (853)..(853): n is a, c, g, or t
  misc_feature (867)..(867): n is a, c, g, or t
gttgnnnnnnnnnnnnnnnnnnnnattattaagaaaagttaaccatgaacgacaaaagtaatggtacagttaaagaagaaacggataacaaaaagaaannnnnnnnnnnnnnnnnngaggataatggatttaaagagtggggtggttatatggcagctaaaagggccaaactgctaaaccagtttgaggaatccaacattacaaaactatccaatatatttgaaggagtatctatccatgtgaatggtttaacaagacctccaattgatgaattaaagaacttaatggcagcacatggtggagttttccacatgtaccaagtttccagcaccacccatattatagcttctaatttaccaaatgtcaaaattaaacatcttggtactactcccatagtgaaaccagcatggataacagatagtatagactttggaaaattgttagattaccgtagatatcttttgtataacaatcaaagcaaatcacagccgaaaatatcttttgtataacaatcaaagcaaatcacagccgaaaataggttttcctgtcatagaaaaagtgtcagcatctgcatcaatatctgaaaacaattctgcaaatgttgaaagtgatacagtagttgcagaaacttctgaattaatacagaattcaatagctcagattaaatctgacaaattatcttcaaccaatcagattaatagattcccaacaaaaacagcatcagatcctaactttcttgaggagttttataacaattccaggctacatttgatatcaactttaggtgcagaattcaaacatttggttggtcaaatgaggggattgtcagatggaaagtttcctggtttagaanactaatctcatgtnaagtccagaggggcgcatatttagtccctccacagtaatatgcatattgacatgga

SEQ ID NO: 9578 - DNA, 981 bp, Diabrotica virgifera
  misc_feature (947)..(947): n is a, c, g, or t
cggtccagccattcatacgggcaacaaacttcaatcctctcggaccaaaataggaaaaataggtcgaacgcttcaaaactctcacgaagtggcaggctcacaaacgaaaaataaattcctcgtttcacaaataggttctcaaaacaggaaatcgtcggaggtcgataatcataattttcaatgcggacttctttctcacttcaaggcgggcttcatatagattcccagaggtcactagagtggacttcaaattctaataaattcgatccggaacaaaggaacgcagtgttgactttcatttttagagcaggagaaaaattcaatcacagcaacaacagcttcaaataaatgaactgcaagcaagaaacttaacactttaaaatcggaacgaatacacaaagaaaccaacaatcatgatcagaacaaagttctagaaaatacattgaaggattttaatgagttacgtgattcaaaagaagaacttgaacaggatattcctcgaagttcgggaaaaactaaaaagtgctacacaagaagtcttgacccttcaaaagcaaaattcagagctttctggaaaattatctttggcagatattaagattcaacaacttgttggtggtgatcatcagacatcagcagctcaaattgagtcgctggtgcaagaaaatcgtggtttggatggcggaaatggtttcccttaacaatacaataaaaagtatgagtaaagtccgtaggctgaagagtcccctttttagcagtgatctttcctatcaaaaattcgtggcatctggtcatggtggttaacattgacagttatgaagagatgatccggaactggtgtaaaccaatttttttgtacttcaatgattacattgaatgtagatacagtagaatctcgattatccgtcactttacgatacgtccaagggtatgacggataatcgaanagatggttgagagaacattaaaaaaaagacatga

SEQ ID NO: 9579 - DNA, 688 bp, Diabrotica virgifera
  misc_feature (5)..(85): n is a, c, g, or t
  misc_feature (87)..(100): n is a, c, g, or t
  misc_feature (102)..(132): n is a, c, g, or t
  misc_feature (142)..(489): n is a, c, g, or t
  misc_feature (496)..(533): n is a, c, g, or t
  misc_feature (553)..(566): n is a, c, g, or t
  misc_feature (569)..(591): n is a, c, g, or t
  misc_feature (599)..(621): n is a, c, g, or t
  misc_feature (651)..(682): n is a, c, g, or t
cgacnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnncgcccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9580 - DNA, 677 bp, Diabrotica virgifera
  misc_feature (170)..(676): n is a, c, g, or t
ttttaatcgtaaaatcaaataactttaaatcaattttttcgtaatcgaaatcgttactcgtttttcaaataatcattctcaatttttctcaagaaaataaatctaaatcttatcttatctaacaatatcatcttatcaattaaatacttttcatcatctatctaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9581 - DNA, 124 bp, Diabrotica virgifera
  misc_feature (23)..(45): n is a, c, g, or t
  misc_feature (82)..(117): n is a, c, g, or t
aaaataataaaatatctttttcnnnnnnnnnnnnnnnnnnnnnnnctctaacggatagttaattagtatccgtgagagaaannnnnnnnnnnnnnnnnnnnnnnnnnnnnnnnnnnngtacctc

SEQ ID NO: 9582 - DNA, 852 bp, Diabrotica virgifera
  misc_feature (242)..(260): n is a, c, g, or t
  misc_feature (801)..(821): n is a, c, g, or t
tttcgtccggatatatgtatgtttgttctaaatttattgtttcgaaaatgtcttctgtagaagcagaaactattggtcttgttgctaaagcgttttccgaggagccaaacaacattgaaataatcgacgtcaaaggaaatgatataggacgcgggtactccagtgaagtgttgtttatattcgccaaaaacaaaagaacaggttcacagcgacgatttataataaaacaagcattaccagannnnnnnnnnnnnnnnnnncagataacagcttttagttttcataacgaaaaaatgttttacttaaccgtttttccagcactaatcaattttcaaaagttacataacagtaataatgtattcaacaatatggctgaatgttatggtggtattacagaaccttctaaagagaagctgatatttgaagacctaacctttcagggttatgaaatatttccttctacagaaaagttgttagatacctcgatgtacgaagttttatttaaagtgtatggaaggttgcatggtattagttatgcttttaaacattatcaaaaagaaaagttttttgaaatgaaagaacaggtccgaggtccatttcaattatttatcgaacaagataaattcataagtgatcttgaaaacgtaattgaaagagttgagcgatacttgaaagaagaaaatgagattaacgccagtaaaaaactcaaaattcataaggataactgtaaagagatactaatggaagccttataagatagaggtcccaacatagtatttattcatggtgatgcttggagcnnnnnnnnnnnnnnnnnnnnncgatgacaaacggaaaactggaagacataaa

SEQ ID NO: 9583 - DNA, 606 bp, Diabrotica virgifera
  misc_feature (32)..(514): n is a, c, g, or t
  misc_feature (528)..(600): n is a, c, g, or t
tcataatcttctctctttttcgaatcttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactggattannnnnnnnnnnnnnnnnnnnnnnnnnnnnnnnnnnnnnnnnnnnnnnnnnnnnnnnnnnnnnnnnnnnnnnnngaaggg

SEQ ID NO: 9584 - DNA, 823 bp, Diabrotica virgifera
  misc_feature (2)..(44): n is a, c, g, or t
  misc_feature (52)..(817): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatat

SEQ ID NO: 9585 - DNA, 738 bp, Diabrotica virgifera
  misc_feature (2)..(15): n is a, c, g, or t
  misc_feature (17)..(46): n is a, c, g, or t
  misc_feature (68)..(402): n is a, c, g, or t
  misc_feature (409)..(446): n is a, c, g, or t
  misc_feature (466)..(479): n is a, c, g, or t
  misc_feature (482)..(504): n is a, c, g, or t
  misc_feature (512)..(534): n is a, c, g, or t
  misc_feature (564)..(595): n is a, c, g, or t
  misc_feature (602)..(737): n is a, c, g, or t
cnnnnnnnnnnnnnncnnnnnnnnnnnnnnnnnnnnnnnnnnnnnncgcccaccgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9586 - DNA, 116 bp, Diabrotica virgifera
  misc_feature (32)..(56): n is a, c, g, or t
  misc_feature (75)..(75): n is a, c, g, or t
tttttgtcaagcatgtaacttttaatattacnnnnnnnnnnnnnnnnnnnnnnnnnctcatttattttaacctanaccctgtttgaagtctagtaacgagacgccaaaaaatcgta

SEQ ID NO: 9587 - DNA, 864 bp, Diabrotica virgifera
gaaatatactgtaaaaagagaattcagtattataattgtcctgtccaaaattgccaaattcaaaattctgccttaccactatcagatcatttgttaatagatcatgattgtaatagtgttacagatcatttgttaatagaagcttctttctttccaatctttgagctaccagaagaatgtttcgtcttcgtagaagatcagattatatactttcagctaacggctcaagatgagtataacatggaatgcaaaatagtaacaaacgatgataaaatacaattacaatggaaaccacatgtgctcttttttaataataacacactttcaacactagcaaatctctgtattaatgataaaaacattgattgtatagcaaagattgttttagtaaaaaatgaataacgaaataggtaatcattgtatgtgcctatatcatatttagtgcagtcactgaaggtgaatatgagctattacctccgaatttcgttgaacctccatcgatttgcacgaggattggtgagtggttggaggatatctcagggaacaaaggtgacatggtgccggcttgcgcttttgccctgggggtggatgccacccctcctggggggagaaaattgttttataaaaaataaccccacaattcgatagagcgacaggttataggcaaaatttgttatatatagttattaaaataaatcaggactttttgagttattagagatcaaagattttgatttttcgtaagaaaaatgcatgtgtttaaccgagttttcataaataactcaaaaactatgagtattttacattagagttattgtcaaattgacgctaatactggatcaaataaaatccttactagaaaac

SEQ ID NO: 9588 - DNA, 79 bp, Diabrotica virgifera
  misc_feature (9)..(9): n is a, c, g, or t
  misc_feature (11)..(11): n is a, c, g, or t
  misc_feature (19)..(78): n is a, c, g, or t
tatttattngnggtgattnnnnnnnnnnnnnnnnnnnnnnnnnnnnnnnnnnnnnnnnnnnnnnnnnnnnnnnnnnnna

SEQ ID NO: 9589 - DNA, 744 bp, Diabrotica virgifera
  misc_feature (701)..(718): n is a, c, g, or t
ggatttttgattatccggatcgggtccggtcccaattaatccggataattggagttctaccgtaataatactctgtcaagtgtattgtgtttttgcagaattttggagtgtgtttaattcgtagaacaagtctaacatgtgcttttaatagatatttcaattctctacaagtagtttcttacgacttttgatgtaaaataattggagaagcaggaattcaacaatttggaatttcccattgagttttctatggcccgtttgacgatgcaccaccctgtatatttcaaagctgattctctttattctaagttaaccaaaaatactacggtatcaccacagcagtttattgtaaactcttgtaaattttttaggagtcttgattccgaagatgaagatgttttcagtagttaggtagtaaaagttatttggaagatatttgtgatatattttgcagccttgaatattgataaacatgtatgaaacgtatagagtttaaaatgaactgttctggaaaaacgataaaaatcaaatcaatcggaatcaaggtagacctaatcaaacctagattttatgtagtctacctatatattacatatctttatatcatctttatataactgttatattttattgtttttgcataaatattgtacataataaaagttcacgttggttttatatttaattgccaaatatttgtnnnnnnnnnnnnnnnnnngatcttagtttaggtaattttgtacc

SEQ ID NO: 9590 - DNA, 608 bp, Diabrotica virgifera
  misc_feature (46)..(63): n is a, c, g, or t
  misc_feature (228)..(250): n is a, c, g, or t
agactcatattacatatcaaatcaatctaaactaaaattattaccnnnnnnnnnnnnnnnnnncattttatttacaaaaaccactaaataatacataaatatcattcttaacgtaaaattgataaccaaatattccggaactatgactgaatggtgttttttgtgatacttgacttgaaaaaataatgccagaagcttactagaaacacatttacaagtttattgacnnnnnnnnnnnnnnnnnnnnnnnaattcatttgttttaagggatattcactcatttttaatgatttagatacactcgggagtttagttaccagtgtgtattgtactctgttagcaaaagcatagaacgaaggaaaaaacactaattgcaaaatttttctgtctgccatttatccaagatctcaagaattaatatacaatttgacaacatcgctagaatattagcttagcttccagtgtatattgcacatattgctatctgtagatttctgctaaacttttagaggaaatagaggtaagtatgtgcagagttgccacttcacctataatttcctagagtttgagaaaaagaaaagaggctgccgaagtgattaaattattta

SEQ ID NO: 9591 - DNA, 846 bp, Diabrotica virgifera
  misc_feature (60)..(87): n is a, c, g, or t
  misc_feature (634)..(656): n is a, c, g, or t
  misc_feature (794)..(794): n is a, c, g, or t
gggtaaaaaacgtttattcgtcattcattttaaaaccaataaaatttactcaaaagatcnnnnnnnnnnnnnnnnnnnnnnnnnnnncttagataggtacttaagataatacaaacaatcacaatttacgtttatatcgatgtacgtaattcttttaataacccaaatttaattccggtaatttctatctcccggtgattttatatttggaccaaatttatcgcactggaatttttgcatttccaattgatttattaactatcgtcaaaagggtctggggactaaaacaacacttatcaattttttgaggaaataatgtatttcctggtttatgagctgtaaatattcgaatcatcgaatcaataaaactaatccaattatgattccattcaaatgtgtattttctgttttcattcaaattgtccacatcctcattattgcaatcgatcagttcatatttagagtttaacaagtggctattaaattttgaagaaggggacaatctggtattttctttgtttcttgaatgatctaatgatttatccgaaatattttgatttgaatcttgcatcattaatacttttcctgtcaagataagtagatctcctttcaaaatttttaaatcgccggtttnnnnnnnnnnnnnnnnnnnnnnnggaaaggtgttttcttgcaattggagctgagttaaatttaatgttttccataagtatatccgtgtgttcaaattcgtcatggtttaagttcagccaatattttccaaattaaaaccaagtatgcagcagctgagtacnattattcatcattagttgcatctttttgctgaaacattttgacaaaattaat

SEQ ID NO: 9592 - DNA, 881 bp, Diabrotica virgifera
  misc_feature (77)..(97): n is a, c, g, or t
  misc_feature (417)..(438): n is a, c, g, or t
  misc_feature (557)..(574): n is a, c, g, or t
  misc_feature (630)..(649): n is a, c, g, or t
agttgtaacccccccccccttacggatcatcatcggttacgccatccgggaaggagtagccgtctactagtagacgnnnnnnnnnnnnnnnnnnnnnaatttcgctattccgtcgttgacgtggcgctatttatctcgtggaggctccttcatcgacattctagttctttatcatcgtttacatctagagggtatatttcgcttagtaaccgccttttatattggttggtttctctttccgcactttctattatgttattaataattaggttattgagtgtataagttataagccagagtaatgaggtattttcttggcatgtagtgcctgtgagagcgggttgtggctatttcctgcgtaggatctggcggccattttggtttgtaagcaatttggtgtcaaaaagcggcctttcnnnnnnnnnnnnnnnnnnnnnncacatattaaacaacaaataaccctcatttaaaaaaatttcaaatctgtacactaatttttacgatagttattgcaaaattaatttttttgcaatttcgaccttttttcgcatgtaacnnnnnnnnnnnnnnnnnngtatatcaacctttataaagtactaaaaaaaccataagtttcactgttttccagtnnnnnnnnnnnnnnnnnnnnggggccgtttttgacactgaattgtttgtgaacggaattggccgccggatcctacgcaggagatagttgcagtttgttcttgtaggtactatctgtcaaaaaaacgcttcagtatcctggctgttgaagtgtcatgaaaaaaaaaaccttattaccctggactaaatattttaaactcaatgatcttatgttgtactgatggtctctcccccgcatagcaataaatattttt

SEQ ID NO: 9593 - DNA, 904 bp, Diabrotica virgifera
  misc_feature (327)..(347): n is a, c, g, or t
  misc_feature (593)..(611): n is a, c, g, or t
cttttgatatctcataaaaaacaatcattaccagcattcggaattttataatcgtatataaacaaccgtacgtacccctaaggtttatcgtatataatagtgcatagcaccatagaaaaattaatttgtacatatctttactcttatttttgtgatttaaatggttaggtgttgacgtaaggaacgtggaggggatcattttagttaatagacgtagaaaatatattaagcatttaataatacctatataactcaatatttgtttgccatgaacttgtttggattgagtggcaatgtaataaaaacaagtttaatttggttcaaatnnnnnnnnnnnnnnnnnnnnngctaagtagcacttggtacagttgaccatttaaggacggcgcctattttcccttgcaatgccacacagacggcagttttatagcttgccttctaaatggatggcacatattattttagtcagaataaaattaataagaacatgttcactaaaaaactgtgcattgtgtaaagacaaagatattttttaacttggagatgaattgagtttttgtcactgtaatcacattattgatttgtatggcacnnnnnnnnnnnnnnnnnnngttttgatttaaaatcaatgggaaaatcccaattattttgattgttttcgtcaaaatttaatctccctatttggcaaatattcactcccaatattggtaaattgccaatctgtgtgctttttttcatcactgggtggggaatctgcatgtagacgacggaagtaaacattttcgacagtgctgggttgctaagctaaaacctcatcagagtcaagtccaccagctaagtcggacctctctgcccctcttagctccgatgtgggtcaggacagctaaatcccacccctctcata

SEQ ID NO: 9594 - DNA, 943 bp, Diabrotica virgifera
  misc_feature (8)..(37): n is a, c, g, or t
  misc_feature (353)..(367): n is a, c, g, or t
  misc_feature (768)..(796): n is a, c, g, or t
  misc_feature (842)..(842): n is a, c, g, or t
  misc_feature (846)..(846): n is a, c, g, or t
aaacgtcnnnnnnnnnnnnnnnnnnnnnnnnnnnnnncagtttgctttgaagcttgaagtttttggaaaaagtataatttgttgggaattttagaatattttggatctaaagggtatggatatcccagataccagattattgcaagtagatgatataaatttaaaccaatcacgaaatgaagaggaacaagaggatttagaagatcagaaacgtagaaaagaagagttacatgcactattaggggacaaattaaacgactatgatgaaagtacagatgattctatagtttctggaatgtcttgcaatgatacagaaagtaataagtatctccaatctaataatcaacatgaannnnnnnnnnnnnnntatgaagttagactgcgagaattacaagctcttagagaagagcacaaaggaaagactgaagggttaacgaaagagatcaagacatataaaagacaattgctattaacgaaagcagaattagaacaaataaaggtgtcatataaaaatagtgaagatttattagttgagaagacaagtaaccttaaggatttagaaactatgttagaaagtaaagaacaacagattcaaaattatgagaaaaatattcagaatatgcaactggaaatagcaacctataaaactacaataaacgacttatatttacaaatgcaagatgaaagaaatccttttaacaaatataataaacagtttatttctgaggaatataaaaatgccactaaagaacaaattaatagactggnnnnnnnnnnnnnnnnnnnnnnnnnnnnngttaaaacattggagaaagcaaacctaattattgaagaagaactanatanattgagaataagggacatcgatagtaggaatacgatagaggtcccttcaagaaatttcgacagtgcaaacgcaatgtgttcagctaattgctgaatt

SEQ ID NO: 9595 - DNA, 917 bp, Diabrotica virgifera
  misc_feature (725)..(742): n is a, c, g, or t
  misc_feature (820)..(837): n is a, c, g, or t
  misc_feature (898)..(898): n is a, c, g, or t
cgccttgcagggaaccgggtccgggaattcccgagagtcgaacccactgcagtccgaaatttaactacagaaaaacacatagtaaaaatcttcttcgcgccatagaagaatctcacttcgggtcgaacgaaatttactcagaaaacaatttttattcgtgatttatctttaatcataaccgagcttagattttttcgtaaaaataatcaaaacgttaaatggacttttaatcttaaagtgtgcaaaaaatatctcgtggacggatcgtgtgggttatttttctagtacagggtaccagaaagatgttaataagtctagctatgtgtaataactattagcaatatcttttgatactttgtaagacgaaaattattttttctaactttttatcctatgttgcggataatctttgtattaatataatttaaaagtaatatgttctattaataatttcgttcggtctagacggttcagttagctgaggcgcagtcgatcgacaagtttagttgatttgcgatcgctggttcgagcctcagctaggtcatgaaattaataaaaggccaacgccgtagtataaaactcaatagagtctaccacttggtctggaatacactggcgtctgatcggcctatggaggagcggtacggcaagggataagggcttgcggcttggtgatactcctccatagatccctaccgaagggcgttgacgcctaagaacggtgnnnnnnnnnnnnnnnnnnttcgttttaacgtctcaatatgttctgtgaactagtacttcaaattttatgatatattcgtctattcttctttttacnnnnnnnnnnnnnnnnnnctaccgatatctatgtatctttaggtgttatcgaagaatgtggaaaatatcattggagaanacacggaaacattaagata

SEQ ID NO: 9596 - DNA, 119 bp, Diabrotica virgifera
  misc_feature (80)..(80): n is a, c, g, or t
  misc_feature (88)..(88): n is a, c, g, or t
cacattctctgaacacttttcgagcttcagctagaaaccccgtccgctgcccccacggagccgcaccccggaactcgccncaatcatncaatttccgtcgccgcaaacacaacactctc

SEQ ID NO: 9597 - DNA, 500 bp, Diabrotica virgifera
  misc_feature (360)..(388): n is a, c, g, or t
attgcatctttgaattattgttcgaatatttcatagcagataaccaagatgggagtagttcaagtagctttacttgtattgctggcgctcgtaatagtacaagctttaccgaatccaaaatcggtagaagagatcgaaaaacccgccaccattattaaaccacaagcagaccaacccgacagtacaagcagtaccgacgaaaatgttaaagttgaaaatgtaccacgcagagttgctagagaggcaaatccacaaaatggccatttcgttaattatattagagcagatgacagattcccaacacttgcttagataaaatatttacctctaatttcacattgcttgcatttatttctaatnnnnnnnnnnnnnnnnnnnnnnnnnnnnnagatgtatgaccaaaaattaagtttataagaagtatattttagttttagagaagtcattttgtacagtatgtacgtagttgttaaattgttaaataaatgtatatatctccg

SEQ ID NO: 9598 - DNA, 215 bp, Diabrotica virgifera
gtcgctctacgacgcccgagttttactctttaatatgtgttttaacagacgctctcgcgatacgtgaggaggttatgtcttatcatacactaagatgaaattattttctatatatagtgcgaaaggaacaaagtgttcaaataaagaaaatctgtgcaatgtacctctcgctatttaagagcctccacgtagacaccaaaatccgtactcactct

SEQ ID NO: 9599 - DNA, 268 bp, Diabrotica virgifera
  misc_feature (237)..(237): n is a, c, g, or t
cattcttattgggacacccggtacatctgtgtatcagaaagggaatgagtgttgaattttaagaatgttaatttttagcgataagaacatttttgtattaaatagctcgttgggaaggagctgcacattatgaaataaataatgaatttgacagtttgtggctaatttcaaaaagaaatatttgataacgctggcaagtcacaatgaaacaattttggaatattttgttacattagntcatttattttctatttatggtattttttta

SEQ ID NO: 9600 - DNA, 931 bp, Diabrotica virgifera
  misc_feature (348)..(363): n is a, c, g, or t
  misc_feature (854)..(855): n is a, c, g, or t
  misc_feature (902)..(902): n is a, c, g, or t
cgtgaaggtattcaatcacaaatcaattttttcgaaaatcgaatcacacgttaatctcggaacgatccttaatttattagtatcggatcgagataccaaggtgcctacgtcgttaagatcgttggtgcataaaatattaatgaaaacaagccatattctgcctagttggctatcggctttgactctaaacttgattaaacattagacatcgtattatttttatagttccagttgctttgttaccattgctaatatgaatttttgtagtggggaactgattagtagtaaactttttgttctaggagagtataataaaaatgtactactcggcaataagagtttgtcatnnnnnnnnnnnnnnnngacgacagccgggaagagaaacttttcaaagtttactagaatagtttcgacgtactggacacttagattacaagaacgttcttacatcgcagattctcagtgacttcttctttacgtggcatctccgcgacggaggttggcaatcatcatggctattctgatcctagatgctgctgttctgaatagttcggttgatgtgcatccgtaccattccctcaagttacgcaaccatgagattcatcttcttcgtacacctctcattacgcataacatgctccaggtatttgcagctttcgtgtcttgatggtttccaatatttccagtcttttgttgactcttctcatgacttcgttgtctgtcacattgctcagtccatgatatcttcaggattcttatatacagtcacagttcaagtgttcagtgacactaacatttaatttattttaatcatttacaatagtttttgttcgatcagatttctcgtaatctannatgtcagttcgttgaaaccgctctagtttgaaagtttctctttttgnttgtcgtctatcatggagttgctgatgat

SEQ ID NO: 9601 - DNA, 233 bp, Diabrotica virgifera
ccaatattccttcaactcccacagatgtcgtcgacggtagattgctctacgccagcaccagcatagacgagtggtcgttgctctcgaggttagccattatgggagcctcctcgcagggcacaatgggcggcctactggtagcaggatttttgtttaagactataggctggagaattcttgctataactggtgcaatgtacggttgacgctacctggacgaggattacactgga

SEQ ID NO: 9602 - DNA, 938 bp, Diabrotica virgifera
  misc_feature (78)..(94): n is a, c, g, or t
  misc_feature (580)..(598): n is a, c, g, or t
  misc_feature (603)..(620): n is a, c, g, or t
  misc_feature (736)..(756): n is a, c, g, or t
  misc_feature (903)..(903): n is a, c, g, or t
gatttttgaattaaactttttaaaatacgtaaaacatggttcggcaacgtgaacgtagatctcaggcaaattcagatnnnnnnnnnnnnnnnnnaggcaccaacagcagtagtagtaatggaagcagtacctcaacatcaaaatcttcagaatcggttaatctgtttcattattggaaacaatttgtagtcgttgtagttcttagtgtagcagtttgttttggttatatgggttatttagaaacgaggataaatacacccttcgatgatagaaaggtagtttctcaaagtggtttagatgttcctgagttattttggggtagttacagaccaggtgcttattttggtttaaaaactagggatccaacatctttggttactggtcttatgtggtattttcctctgcgtctaaaacctggaggagatggtataaggcattggtgtgaacaaggtgacaacctggaaaaatatggttggttgcagcatgatggatacaattttggtattcaagaaattatcgatggaccttttaatatcacaacctcatttgtaaagaaaccaggaggccttcatggtggagnnnnnnnnnnnnnnnnnnnagtcnnnnnnnnnnnnnnnnnncctaatgtaagtaaagaagaagtttctttgttatggtatgttgccttggatgaagaaacaaaggggtccatacaacccacaaaccttgctactaagatcactggtattagagggannnnnnnnnnnnnnnnnnnnnttagaataaaattagtgaatacatcaggtgtgctaagtcatgaatcgtttttaagtacaacagcacctggattacatttacttaaagaaactgtgatatcgtcgttaagactttgctcagacaatccaaaatcaccaagaaaaattngtgtaggtggacagttacaagcatttaatggagat

SEQ ID NO: 9603 - DNA, 429 bp, Diabrotica virgifera
  misc_feature (160)..(176): n is a, c, g, or t
  misc_feature (229)..(229): n is a, c, g, or t
  misc_feature (314)..(314): n is a, c, g, or t
agcggtccgaatgtgaatggaaaaaaagaagtcagtcaatttaagtttatacatcttttcggtagttaaatatcaacatactttcaataatagggtatctcaatcttccgcccaagaaagaaaaattcagattcttctcagcgaaagcagatagggacannnnnnnnnnnnnnnnnaagatggtaaaaggcttcccgaaaaatgggatttttctggcattttctttcangaatagggaaattctctaagatgggaaataaccagggcacagaattggaagaaagaagcaacactcggataaggtatctaaaaanatttcaaccttcttaggtggattccattctaaccttggacatggggggaacctcgtggttttgggtataaagagttgggcgtggaggaaatacaactttaaggcgctatgggata

SEQ ID NO: 9604 - DNA, 165 bp, Diabrotica virgifera
  misc_feature (132)..(132): n is a, c, g, or t
gctcagagcgaacacgctgtgtttttttttcctaagtggcggatttggacgagattttggatgaaatggagcagatatatcactaaaatgaaggaacattaagaccatcttttttggaatagcgataatatncaaactcaatttatctttggttttttttttaca

SEQ ID NO: 9605 - DNA, 866 bp, Diabrotica virgifera
  misc_feature (9)..(45): n is a, c, g, or t
cccttttcnnnnnnnnnnnnnnnnnnnnnnnnnnnnnnnnnnnnngcccaatataattaaacctgatgattaactaaaatgatagcaacaatactaccaaacataaatattttatgtgacaaacaatgacgagtagttcagtacagacatataatacataacaacaacctgaaccacttaactcgccatctcgctcgaccgcctagaattcagataacgataagtactcattttcttctacacttactattcaattgttcctgacttccttattatattatttgactaagcttgagtgaaatagactctactatattgctatttttacattcttaactgaatggaacaatagatcggtgccaaacctcaattatttttaattcacattgtaataattactaccttaacttgctgcttgcattttttattatctacttaaagtacttgtaaccatagccatcatctatgacagactacaatcaattctcttaccacaaattccccaagaacaatgcgaaattgtcccaggtagcggaacacgagaatacattcttaatattcatcaaattatagaaaaaccgatccctgcatattgatgtattgcctatacacttgcgtgtataccacatcatgacaattgctgccaaatgattataggacattataatgccacatcctagaacaacagaattatcctatacatgagttcttcaaccctaccctacatataacacctagatcagtaccgttagttctgaaactttcttggtatttaccttaagcaaccttacgtggccccttcgtatctatttgataagtaataaactattctcaactttctatacacaaagatctgtttcaacatc

SEQ ID NO: 9606 - DNA, 579 bp, Diabrotica virgifera
  misc_feature (207)..(219): n is a, c, g, or t
  misc_feature (221)..(235): n is a, c, g, or t
  misc_feature (247)..(284): n is a, c, g, or t
  misc_feature (305)..(330): n is a, c, g, or t
  misc_feature (500)..(517): n is a, c, g, or t
ccttctggggcgaattttaatatgatttctagtttaattttcctttcccctgaattggttagtattgcttttttaactttacttgaacgtccagaattaggttatattcaaattcttccagggcctaataaagttggatttttgggtttaattcaatcttttattgatgctattaaattatttactaaaaaacatatttatcctttnnnnnnnnnnnnncnnnnnnnnnnnnnnnctccaattctcnnnnnnnnnnnnnnnnnnnnnnnnnnnnnnnnnnnnnnttatattaccataaatgtctnnnnnnnnnnnnnnnnnnnnnnnnnnttatcaggttatatgttaagggcttatgcaattatactggccggttgatctatataattctaaggatgattatattaagaatctagctattctataactccaatcatttgtgattaagtcggactatacttgcaattaattatcttatttaagtatgtttgatactacgnnnnnnnnnnnnnnnnnnccttatcccccccattgttggctgctttcatttatactcccaatactgtttaatgagattta

SEQ ID NO: 9607 - DNA, 719 bp, Diabrotica virgifera
  misc_feature (2)..(520): n is a, c, g, or t
  misc_feature (527)..(564): n is a, c, g, or t
  misc_feature (584)..(597): n is a, c, g, or t
  misc_feature (600)..(622): n is a, c, g, or t
  misc_feature (630)..(652): n is a, c, g, or t
  misc_feature (682)..(713): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9608 - DNA, 938 bp, Diabrotica virgifera
  misc_feature (315)..(335): n is a, c, g, or t
  misc_feature (477)..(506): n is a, c, g, or t
  misc_feature (898)..(898): n is a, c, g, or t
aggattttagagttacccccctcccgcctctaggggtttggtggggggtcgtgtttggtgttgttcgatgggtgtttgaaaaatgatacaacgtctatttaggattttagagttacccccccactccacctccagagtgtggaggtggaatggaaatattaaaacacgtattttttgctgtttaatttggaagtggttgttcacttgtataaggtatataatttacctaggccatctatccacaattcgagggggtgtctcgagtaaaagttttacgagggaaatccaaatctgcaataaaaaatgtgggtttcnnnnnnnnnnnnnnnnnnnnncacccactcttagtgagggggggtgcagtgggggatcgtgtttggtgtcattatgtatatagatttttgaaaaatattgaacaggtatttttcagttttttgatccgatgttcatttcgcgaaatattcacaactaagcacnnnnnnnnnnnnnnnnnnnnnnnnnnnnnnctcaagagcgaatgaactgttactgaacaaaatattaactctgagtgttacaacctactatttcaacctgaaagtaaataacgctattagaactacataagccgcatgttaaaatctggaaacatgaataaacaaccgttttataacttttctccgcaggaggtaacatatagcataacagggtgatgcgttatctccactactttttaaccttgtattagagaaagccatgaggtcggccgaaataaggacagaactgctatcggttcaaaatcccaagttattactagcttacgcagatgacattgatctcgttggagactccatcctattcacaaaagccattttcaaccaggtggaaggagcaacaagtgaagtagggcttgagattnatgaagagaaagacgaatatatgtgtataatagaacgaca

SEQ ID NO: 9609 - DNA, 259 bp, Diabrotica virgifera
aaagaatgtaacggtttagtaataaataactttctgggtttcacaacttttggaaaactggaagtaaaacaactagttcttaaagaatacgctcaaattttatttgaagatgacactgagataattctggatcctgattctgaaaacaaaattaattgtgttgccacaaacggcacggagatgaatttgcacaaatggcataatccagtcaattggttattacaaggtagacttaacggcaacgaagctattcctcaca

SEQ ID NO: 9610 - DNA, 854 bp, Diabrotica virgifera
  misc_feature (3)..(22): n is a, c, g, or t
  misc_feature (28)..(49): n is a, c, g, or t
  misc_feature (65)..(116): n is a, c, g, or t
  misc_feature (125)..(181): n is a, c, g, or t
  misc_feature (211)..(253): n is a, c, g, or t
  misc_feature (264)..(335): n is a, c, g, or t
  misc_feature (355)..(461): n is a, c, g, or t
  misc_feature (465)..(516): n is a, c, g, or t
  misc_feature (581)..(601): n is a, c, g, or t
  misc_feature (635)..(716): n is a, c, g, or t
  misc_feature (718)..(764): n is a, c, g, or t
  misc_feature (771)..(841): n is a, c, g, or t
tcnnnnnnnnnnnnnnnnnnnnttcgtnnnnnnnnnnnnnnnnnnnnnnaaaaaaagggccctcnnnnnnnnnnnnnnnnnnnnnnnnnnnnnnnnnnnnnnnnnnnnnnnnnnnntccccgccnnnnnnnnnnnnnnnnnnnnnnnnnnnnnnnnnnnnnnnnnnnnnnnnnnnnnnnnntctttctttttgggggggaatatttttgtnnnnnnnnnnnnnnnnnnnnnnnnnnnnnnnnnnnnnnnnnnngcgggaggtgnnnnnnnnnnnnnnnnnnnnnnnnnnnnnnnnnnnnnnnnnnnnnnnnnnnnnnnnnnnnnnnnnnnnnnnnggctcccttttcctcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnnnnnnnnnnnnnnnnnnnnnnnnnnnnnnnnnnnnnnnnnnnnnnnnnnnncgcccccccacccctttctgtgggtgggtggtgggggggggcccacaccccaccggggggtgggnnnnnnnnnnnnnnnnnnnnncttttctcctcctcccccgccccccgacgcccgnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnngcgcggnnnnnnnnnnnnnnnnnnnnnnnnnnnnnnnnnnnnnnnnnnnnnnnnnnnnnnnnnnnnnnnnnnnnnnncggaggggggaag

SEQ ID NO: 9611 - DNA, 728 bp, Diabrotica virgifera
  misc_feature (8)..(25): n is a, c, g, or t
  misc_feature (74)..(93): n is a, c, g, or t
  misc_feature (116)..(148): n is a, c, g, or t
  misc_feature (152)..(221): n is a, c, g, or t
  misc_feature (234)..(599): n is a, c, g, or t
  misc_feature (614)..(643): n is a, c, g, or t
  misc_feature (657)..(727): n is a, c, g, or t
ctttttcnnnnnnnnnnnnnnnnnnctttcactaacgatagttaattcgtaccgtgagagaaatcctttatctnnnnnnnnnnnnnnnnnnnncttttccgtacctccgtgtatcnnnnnnnnnnnnnnnnnnnnnnnnnnnnnnnnnctcnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacacnnnnnnnnnnnnnnnnnnnnnnnnnnnnnncgcccaccgattannnnnnnnnnnnnnnnnnnnnnnnnnnnnnnnnnnnnnnnnnnnnnnnnnnnnnnnnnnnnnnnnnnnnnng

SEQ ID NO: 9612 - DNA, 300 bp, Diabrotica virgifera
  misc_feature (2)..(36): n is a, c, g, or t
  misc_feature (44)..(94): n is a, c, g, or t
  misc_feature (98)..(122): n is a, c, g, or t
  misc_feature (169)..(214): n is a, c, g, or t
  misc_feature (216)..(232): n is a, c, g, or t
  misc_feature (237)..(295): n is a, c, g, or t
gnnnnnnnnnnnnnnnnnnnnnnnnnnnnnnnnnnngtttattnnnnnnnnnnnnnnnnnnnnnnnnnnnnnnnnnnnnnnnnnnnnnnnnnnnttgnnnnnnnnnnnnnnnnnnnnnnnnnggtagcatatcattattttttattgaagctggaatgagggtggatgnnnnnnnnnnnnnnnnnnnnnnnnnnnnnnnnnnnnnnnnnnnnnngnnnnnnnnnnnnnnnnncgagnnnnnnnnnnnnnnnnnnnnnnnnnnnnnnnnnnnnnnnnnnnnnnnnnnnnnnnnnnnattta

SEQ ID NO: 9613 - DNA, 99 bp, Diabrotica virgifera
  misc_feature (39)..(39): n is a, c, g, or t
  misc_feature (58)..(58): n is a, c, g, or t
cggacgcgtggggtgtaccctttgagtcgaaggttctanatctcaggatcctaagaanagccaccatggttgacgctgcagttttggacaaacttgaag

SEQ ID NO: 9614 - DNA, 70 bp, Diabrotica virgifera
  misc_feature (3)..(4): n is a, c, g, or t
  misc_feature (6)..(28): n is a, c, g, or t
  misc_feature (68)..(68): n is a, c, g, or t
aannannnnnnnnnnnnnnnnnnnnnnntatggaatgttatttcgtttttaatatatctaattttttnag

SEQ ID NO: 9615 - DNA, 709 bp, Diabrotica virgifera
  misc_feature (110)..(133): n is a, c, g, or t
catctatttttcaacagatcatacaaaaaagtactcattacaaaactaataagtacttttttaatcacaatatattacaatcatcaattttcattgatatataatgtacnnnnnnnnnnnnnnnnnnnnnnnncaaatttgatgttattcttgtggcaccatgggaatcggtttgggctttttgggtttctttattatctccagctccggattccgtatcctacgaggaataagctttagtgagtactgtatactttgtagaacaataggatctgccgaattatcttccaagagtccttcgaaccacaacttcatctcttcaagacattttttgtcaaattccacaccactgttgaaatatttcaataatttgccaactaatataatgttggtcgccttaaaatttgaattttctggcggtatcttgtaaatcaatggtttgaacaattcattcaacttcttatatgcccaaggtctatccttgtgctttaggtacattcttatagcatactcggtagaatcggaggggttttctaaatagtgctgataaatttcttggaagaattcgtcacagcacgcttcttgggatagcgagtattatcagtagtctctatgctactgtgcataagttttgattctctctatctactgactagacttgcatggattctcactctgatatcgtaacgcgccatgagtaaacgaaaaa

SEQ ID NO: 9616 - DNA, 580 bp, Diabrotica virgifera
  misc_feature (228)..(242): n is a, c, g, or t
ccctattctctcttcagtatctgatccttcggctttgcaatcatcatcatctgatatcctagaatttttctgtacggcagttttggtagttgaggttgatggaagatctatcaattcactaaaccctttcatgaattattatcaggagtcacattggttattagtggaattcagaatccagatcgtggtgttcttagaactatggcactttctatgggggctaagtannnnnnnnnnnnnnnttcaacttgtacacacttgatccccaggtttaatctagaactcgtctgcagttccggaagagtcgcgtaaccctattgattttgttgttaatgtgagagctccaattgagtttggaatccagggttatccgtagatacttaaccgcattggtgctttctaatcacttcccaaataattccagtgcaaccactcagtccaatgtgccttttctaacactccaaagattaaccaaaataaaggtatagggaaaattgtgataagatcatgggtggaagcgtggtattcggtcataaaacgattatcttgtaggcggaaagctttggataaagctgatctt

SEQ ID NO: 9617 - DNA, 994 bp, Diabrotica virgifera
  misc_feature (939)..(939): n is a, c, g, or t
aaacattataaatttgtaaataatagattattgcaaatattttgtgtaaaatgagtaatactcctgaaaattcacctggaagaaaggcaatagaaaccatggaaaaccttcacaaagacctcgtttttaaaaaaccattcgggattattaaaaagagaacaaagaaaaaaattctggaggaagataactatgtggaagaaataggtaaaattattcagagggatttcttcccagacctagaaaaactaaaagcacagaatgcctatttacaagcattggagacgaatgacacattgaaattaaaggaattatatgcaaaatatagtggcagtcaacatccaccagaaagaatacctagtccagccacatttgaaactcctgctaatattcatggatcccagcatgaaaaccaagcaagtacaaaaaacacagacaacatagaaaaaccaattgaaaataaactgagcctggatcaatacttaaattctcatacttctcaagataatgaaagttttgaagagcttctccaagaatctgaacagaaacgtagagaaaagtattcatatttatttaatgaagaggacaagagtgaagagcaccagaaaaaaatattagctttaccatccatagaggaacaagctgcaataccagagaaaaagtttggtttggatatgtggggctacaagaacagaaattatattatgtatgtacctgatggtgtggatttaagtgaagaagaaattatagaagttaataaaagaaggcaagaaatagttcattccaataccagattagccattaatccttttaatgaagtccaaagtgcagaaactattaatgagttggcaaaaagtcaagctaaggtccttgatggaaaaaatggtgttgatggtaaagaacttctcaagacagacacacctaaagtaggagggatatagnttttgtaaagaagtccatctcccttcaccaagtttggttgggaaacccctttgat

SEQ ID NO: 9618 - DNA, 935 bp, Diabrotica virgifera
  misc_feature (209)..(223): n is a, c, g, or t
taaacatttatttataagccgactaaaagacactaattaatgccgatcctaaagaaacttgatatataccaaaaagagataagatgcattgaaaactggtatcaaacgacacaattaaaaatagacaattctatttccaaacccctacatataagaaggggtgttcaacatggttgtgtgctttcccctcttttatttaacatttattnnnnnnnnnnnnnnnaagagtctttggaagatgcctctaaagtgaatggagtattgatcaacaacttgtcactataatcggagaatacaataagcgaatgggattagagattaataccaaaaagatcaaattcatgatcatctccagaaacttggatgcacttgaaaactccaccataacaccaaataacaggtccattgaaagagtgagcaactccaatttccaatagttggagattatgtgtcttgtcatgtctgagcctcttttaaattaagcttagaagaaggagaagacatggaacgaatgatagtttaaggaaacgtagcgcgtaaaagatccagaggaagatctccagtacaatggtcggaccacacaaaggacatgactggttactcattctccgaagcaaaacaacacgcactgaagagggataattggacagaaatagtcaaacaaattacatgacgcctctgcatccttacgatgcagaggagggagatattccttagcagaacattagttctgtaccagatctatatttaaggtgcatttattgtatctttgactactattttgtttttgatggaactaaacataacacttccttatttcagtacacaatgatcttcacaagtgtctaccaatttttacgttttgggtaaacaatctagttgaatgacgtgaaaatatttattttggagctttggtacatagaaactttttttgt

SEQ ID NO: 9619 - DNA, 632 bp, Diabrotica virgifera
gcccggggcgacccttgcggaccgggttctttctccttgtatactattatgtacggagtattggagatcgatactgtatgacggacacctgctgattggattcgcaaaggataggcaaactctactatcgatcgagaggtctacctgtgatacgagaccacatggtctatttttgaagttgtttgttgtcattggagaggacttagatagacaaagactggtttaccattattgatctctaggagggaggacgtcctgccgactgactactagcacaatcggttcagatatatggggaaaaaggagagagttggtacaaattcaacttgctcgtgtaattgaagagatacgctttcctggtgatgatctcgtatcgcctgccatctgtctcattttggatgaggcgcggatgcaaaccgcgttattggtaccttgcattaacgttctggatgataggtctaatgcagtgccccaattggaaaaggagtgcctcaagcttgttgataaaaaatcgtttgattcagtaaactagcgtagcttatgttgatctcctataacacctcatagactattctgacagtgttagtaagagtgactgatactagaggtatttatatgtatcccatagatgc

SEQ ID NO: 9620 - DNA, 58 bp, Diabrotica virgifera
  misc_feature (3)..(3): n is a, c, g, or t
  misc_feature (5)..(5): n is a, c, g, or t
  misc_feature (45)..(45): n is a, c, g, or t
ccnanagatatatgtgatctagtggaagagtctttaatgatgaanagatagaaaactt

SEQ ID NO: 9621 - DNA, 973 bp, Diabrotica virgifera
  misc_feature (793)..(811): n is a, c, g, or t
  misc_feature (891)..(891): n is a, c, g, or t
gaattgtaactcagtttcaactccattagaatcaggtattaaacttcaaaaacctgaaaataacgaaatgaacccagattatcaaaagctcataggagcattaatgtatttggcagttgggactagacctgatatatgtttcgctgttagttatctcagccaatttaacaattcgaatagcaaggagcatttcagtgcagctaaacgggttgttaggtaccttaaaggtacagccagtttaggtatcacatattcaaagaaagacaaaaatttggttggttatgccgatgcagattatggtagttgtgttgtagataggcgatcatttactggttatgttttcatgctaggtggaggagccattagttggaaagctagaaagcaaacatctgtaacaatagcagatagtacgacgtttgcagagtatgtggcaataagcgaatgtggaaaggaatgcatgtttcttaaacagctgatgaaagaactgaagtcacctacaggaactgtcactatttataatgacaatagtagtgcaaatcaactttgcaacagtcatacgtcacatgccaggagtaaacacatagatgttaaatatcaccagataaaggagtgggttaaaaggggtgagatcgaagttagttacttaccaggtgaagaaatgatagctgatttcttgactaaagtgctgtcaaagaagaaacattgggcatgcgcagtaggattgggtttaaaaaattaatgaattaagtgagggtgttaaagttggtacatttaaatacaagcggtacaatannnnnnnnnnnnnnnnnnncttctgtcaccttggtaacactgttttgacacatgatccaatatgtctgacttgactgatctttttaatgtaataatggntgtcatttttgttaagctttgtttattttaatgtataataaatatctttcatactaaataaaagtgtacgctaaaatatact

SEQ ID NO: 9622 - DNA, 226 bp, Diabrotica virgifera
gcttcgtccacatgggaaaacgaaaccgacggacgcgaggccatcaataatttaaacggacacatggttgaacggtcagccgatgaagtgcgaagcggccaagagccggaaggccccccaaacacctaccaccaagatcttcgttggaaatttgacggacaacacgaaggctcctcaaatacgcgaattggttcaaaagtacggcaccgtggtggagtgcgacatc

SEQ ID NO: 9623 - DNA, 796 bp, Diabrotica virgifera
  misc_feature (253)..(293): n is a, c, g, or t
  misc_feature (308)..(320): n is a, c, g, or t
  misc_feature (322)..(337): n is a, c, g, or t
  misc_feature (361)..(381): n is a, c, g, or t
  misc_feature (721)..(721): n is a, c, g, or t
  misc_feature (747)..(747): n is a, c, g, or t
  misc_feature (770)..(770): n is a, c, g, or t
ctccaagttgtttaattattgataaataattacttacttacctaaaattttagttgaaaattaaagattttgttgggaaaacccgcatttttcgaggaaagttttcgtcgaagcaaatcgggaaaaacatttctttatgcagaatttaattacggtgaatttttatttgggtgttatagaattcacaaacatactatttgacctatttctgtatcaagccacgtaattatcgaaaaactctcgtacaggtacnnnnnnnnnnnnnnnnnnnnnnnnnnnnnnnnnnnnnnnnnagaacctattgttgnnnnnnnnnnnnngnnnnnnnnnnnnnnnncgcttaatctggtataaatttacnnnnnnnnnnnnnnnnnnnnnggcttaaggccgtatggcactatgcgtttttcttgtatcatttcttatatcgttgtgtagcttcatacacgggtacaagttcttatatcagaaacgatacaagaatttgtgtctgacacagtttcttgtacaagaaatacgccaatttgtgcgcaaaaagcaaaaacgtaaaacctggtggtaaaacacctactaatccactgccataatggcggctgaaaatgggatcatatggatttgtcttgatgattatatttgtgtttttgtaggtattatttgtaaaaattttattgatacttttaatatggactactgttctactaataaccatatttagttncaactataactttggtttgcattgtngtgcataattttttaatagacgnaaatacaatagttcctaattttgatc

SEQ ID NO: 9624 - DNA, 574 bp, Diabrotica virgifera
  misc_feature (206)..(239): n is a, c, g, or t
aaagctgtcaacaatgactcgaataataatatctgttactattatctcagtggtggccaattcggtttccggatttggtccttttgatttcgattcacacagcaactaccatcccaagtatctaaacgattatcagtttaaaggcctcttcaaaccacattttggcggttcatctgttggtgaagacagcttcagtaagggaagtnnnnnnnnnnnnnnnnnnnnnnnnnnnnnnnnnnatggtgtagctggagaagatattaaacacggagattccggtgtttacaaaggagaaggtgcttttaagggtttgaaaggtgaatctgagtattattttgacagcgatggcgtaaagaaggaacacaacgatgggaaagagtactatggaggacatcattttggaaatgaagctaaatcagaagacgaaaaggctattaaacaaggtcaccgaaagggccataaagttacaggattctcgacctctcaccataacgacgaacgggaaaaactgaagaatattacgacgaagcccatgatgaagcaggcagtgaagctttcgaaggaaaatctgggg

SEQ ID NO: 9625 - DNA, 94 bp, Diabrotica virgifera
  misc_feature (9)..(46): n is a, c, g, or t
  misc_feature (57)..(76): n is a, c, g, or t
gttgttctnnnnnnnnnnnnnnnnnnnnnnnnnnnnnnnnnnnnnncgctgcccttnnnnnnnnnnnnnnnnnnnntctaggtgccttcgaaaa

SEQ ID NO: 9626 - DNA, 367 bp, Diabrotica virgifera
  misc_feature (34)..(54): n is a, c, g, or t
caacattaccgcaccgaacagatattgattttcnnnnnnnnnnnnnnnnnnnnncgtgtaatagaactataataaattaattagaaaatcaacattaccgcaccgaacagatattgatacaaataacagaacagataagagaatcgtgctattacacttataaatctgacgcaggtttgtcaatatgtcaaatcatatgttcgatttcttgttagagataaaaaaatttagtacatagttccaatatgacaaaatctaggcatgggataaaaatgtttatttgaagaaagtatttttttgttcttaatggcggtacaggtagtgcgtgcgtactgtgggtgccgcggcactcacagttgtgacggaa

SEQ ID NO: 9627 - DNA, 499 bp, Diabrotica virgifera
  misc_feature (2)..(55): n is a, c, g, or t
  misc_feature (77)..(248): n is a, c, g, or t
  misc_feature (256)..(277): n is a, c, g, or t
  misc_feature (307)..(416): n is a, c, g, or t
  misc_feature (421)..(449): n is a, c, g, or t
  misc_feature (452)..(492): n is a, c, g, or t
cnnnnnnnnnnnnnnnnnnnnnnnnnnnnnnnnnnnnnnnnnnnnnnnnnnnnnnggggaaaaagaaatttcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttgnnnnnnnnnnnnnnnnnnnnnngggttgtgttaaaaaaaaaagtcggcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccnnnnnnnnnnnnnnnnnnnnnnnnnnnnnggnnnnnnnnnnnnnnnnnnnnnnnnnnnnnnnnnnnnnnnnngggagag

SEQ ID NO: 9628 - DNA, 959 bp, Diabrotica virgifera
  misc_feature (149)..(167): n is a, c, g, or t
  misc_feature (735)..(748): n is a, c, g, or t
  misc_feature (751)..(765): n is a, c, g, or t
cccacgcgtccgcgcccttttctcttagtttttcacccctgtaacttattaaaattaacattatacaagttttcagggaccttcggccctcggtaataatgcaatctttcatctgcgtttaaatttttcaaaaatacttatttcaagannnnnnnnnnnnnnnnnnngcatttaaaatacattgacgagaaattttacgcctacgcccttgattgaattttggaaaatagggtgatagcgtcatgtctgaattaagttttctttaaagttaaatagtctttgaagtttgttggttgaaatatctgattcaaattattaataatgtgggagagcagaaaaaactcaacatcgtgaacaacgcaatcaatctggcggatgttaaacttttaacacttttaatatcatgttgacagtgtaaaaataactaaaatagtaaaaattgaactgtatcttcctacgcttcttctgtttttggattttccctgcattacaaaagggtggagaaaatatatcatcgaagcatacttatcgggagctttatattgatattgcgattacaccaaaaagttttcttattctgttaaaaattaactgtataatttcaaggcgttatcttgtctttatttcttttgtttgatcagtggtatgttgaacgctaatactgatcagggccgcgtttaggtcagttgacgccctaggcaattctctagtagccgcctttcaaacatgtaccannnnnnnnnnnnnngcnnnnnnnnnnnnnnnaaatattaatacactaaaatgaatttacactacgatgtttatatacatataacagaaaaaattgccattccagttcgatttctttcttgattttctttggcggcaaaatcaagataattacagttccctttgaccatatttcaaatttagtacggtgctcggggaaaaaaggatcaaattctgctatgagtact

SEQ ID NO: 9629 - DNA, 217 bp, Diabrotica virgifera
gtatttttatagtttaatcacatttcttctaaatgtagacatttattgacttaatttttgaggtttaagtgtaacttttttgtgtttttggggtgttgtctcagtgtttccagtttttgaaatatttcatcataaaaacagaatctcgaaaaaagttaggttaagcaaaactacctcatgctttgatgaaaatagtaaggatttaacaccatggcat

SEQ ID NO: 9630 - DNA, 266 bp, Diabrotica virgifera
  misc_feature (30)..(57): n is a, c, g, or t
  misc_feature (73)..(85): n is a, c, g, or t
  misc_feature (88)..(111): n is a, c, g, or t
  misc_feature (143)..(173): n is a, c, g, or t
  misc_feature (180)..(194): n is a, c, g, or t
  misc_feature (196)..(212): n is a, c, g, or t
  misc_feature (214)..(226): n is a, c, g, or t
  misc_feature (243)..(263): n is a, c, g, or t
gcgactcgaagtgaggttgtctgtggtgtnnnnnnnnnnnnnnnnnnnnnnnnnnnntcccttgaggatttannnnnnnnnnnnntcnnnnnnnnnnnnnnnnnnnnnnnnggaaagaaagtagctgcagctcctcttgcagnnnnnnnnnnnnnnnnnnnnnnnnnnnnnnncccactnnnnnnnnnnnnnnntnnnnnnnnnnnnnnnnntnnnnnnnnnnnnnctccccgtgatttatcnnnnnnnnnnnnnnnnnnnnnata

SEQ ID NO: 9631 - DNA, 65 bp, Diabrotica virgifera
  misc_feature (4)..(4): n is a, c, g, or t
  misc_feature (37)..(37): n is a, c, g, or t
tttnaacgcacccaaagcatggatgttggacaattgngaggtgtatttgcccccgtccatccacc

SEQ ID NO: 9632 - DNA, 55 bp, Diabrotica virgifera
  misc_feature (31)..(31): n is a, c, g, or t
cgatgcatctttgaattattggtcgaatatntcatagcagataaccaagatggga

SEQ ID NO: 9633 - DNA, 85 bp, Diabrotica virgifera
agcttattagctgtgtttttctgtctagtgagcagtgatcaccacaaagacacatgtgtgacgacgatgttgcggctcttgtcgt

SEQ ID NO: 9634 - DNA, 649 bp, Diabrotica virgifera
  misc_feature (2)..(80): n is a, c, g, or t
  misc_feature (84)..(127): n is a, c, g, or t
  misc_feature (129)..(210): n is a, c, g, or t
  misc_feature (218)..(218): n is a, c, g, or t
  misc_feature (229)..(229): n is a, c, g, or t
  misc_feature (238)..(238): n is a, c, g, or t
  misc_feature (242)..(391): n is a, c, g, or t
  misc_feature (400)..(400): n is a, c, g, or t
  misc_feature (404)..(406): n is a, c, g, or t
  misc_feature (417)..(417): n is a, c, g, or t
  misc_feature (421)..(422): n is a, c, g, or t
  misc_feature (433)..(433): n is a, c, g, or t
  misc_feature (437)..(438): n is a, c, g, or t
  misc_feature (459)..(459): n is a, c, g, or t
  misc_feature (462)..(463): n is a, c, g, or t
  misc_feature (522)..(522): n is a, c, g, or t
  misc_feature (546)..(546): n is a, c, g, or t
  misc_feature (555)..(577): n is a, c, g, or t
  misc_feature (614)..(641): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnctgnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnngattttanttttaaagtanaaagcttanattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatccnattnnnttttgatatangaanntaattaccttnaggnnatacagcgtaattttattggnagnnagtcaatcgataataaagatttgcgacctcgatgttgggattaaaagtttataattggntgtagcagctatattaattaagtnctggtcgannnnnnnnnnnnnnnnnnnnnnnaggtttaaaccgtgggggaggcaaggtggtttctatnnnnnnnnnnnnnnnnnnnnnnnnnnnncgcaaagg

SEQ ID NO: 9635 - DNA, 940 bp, Diabrotica virgifera
  misc_feature (859)..(859): n is a, c, g, or t
  misc_feature (875)..(907): n is a, c, g, or t
ggctcatcgctctctacagattgtttcttagccgctttcaaaagatttttatctcgccgtgaaaatcgtaaagttttatattcagataatggcacgaattttgtggatgccaaaagagtcgtcgatgaatatcaattaactacgtcaaaaacttataaagatgcatttcaacaggaacttaataataccaaaatttcttggaaattgaatgtacttatggcagtcactttggtggtatttggaaaagcaatattaaaagcgtaaaacttcatttaagtagaattgtgggaaatcagatccttacttacgaagagtttttaactgttctaacaaaaatcgagtgtcctttgaattctcgtcctctttgtgttcaaagtaacggccctgaaaatccagtcgcgctgactccatcgcattttttatgtacagaacctttagtgtcattactctcgatggatattgatcttgataaaaatatgagtattttgaaaagatataaattactagacattgttcaacattattggaaaagatggcattcagaatatttgtcttctatgcagtctctttcaaaatggaacattaactctaatcctcccaaagaaggaatggtagttgtaataaaaaatgaaactgtcccacctttacagtggaatctgacagtcatggagactttgtatcctggaaaagatgggattgttcgaatcgtaaaagtgcgaaccaagcacggtagttatatgctcccagtcgttaaactgtgtcctctacccagtcaattaactggagaggatttttttttatttgatagttgaaattttagtttatagtgatgggttcatgtgcactcttagcatattanaatttaattagattannnnnnnnnnnnnnnnnnnnnnnnnnnnnnnnnctcggggggcaggatattttgggctcattatat

SEQ ID NO: 9636 - DNA, 681 bp, Diabrotica virgifera
  misc_feature (72)..(482): n is a, c, g, or t
  misc_feature (489)..(526): n is a, c, g, or t
  misc_feature (546)..(559): n is a, c, g, or t
  misc_feature (562)..(584): n is a, c, g, or t
  misc_feature (592)..(614): n is a, c, g, or t
  misc_feature (644)..(675): n is a, c, g, or t
aatacaaaaagacatgtttttaataaacaggtgaaaaaaatgttgccgaattcctttattaaacctatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9637 - DNA, 490 bp, Diabrotica virgifera
  misc_feature (2)..(61): n is a, c, g, or t
  misc_feature (81)..(168): n is a, c, g, or t
  misc_feature (170)..(207): n is a, c, g, or t
  misc_feature (224)..(258): n is a, c, g, or t
  misc_feature (279)..(296): n is a, c, g, or t
  misc_feature (327)..(340): n is a, c, g, or t
  misc_feature (342)..(386): n is a, c, g, or t
  misc_feature (409)..(435): n is a, c, g, or t
  misc_feature (438)..(477): n is a, c, g, or t
cnnnnnnnnnnnnnnnnnnnnnnnnnnnnnnnnnnnnnnnnnnnnnnnnnnnnnnnnnnnngaaccccccccgccccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnccccccctccctgttgnnnnnnnnnnnnnnnnnnnnnnnnnnnnnnnnnnnctttttttgttgtgggtgggnnnnnnnnnnnnnnnnnncacccccccccgcgccgcccgggcggccctnnnnnnnnnnnnnntnnnnnnnnnnnnnnnnnnnnnnnnnnnnnnnnnnnnnnnnnnnnnctttttttgggcgggggcgccgnnnnnnnnnnnnnnnnnnnnnnnnnnntgnnnnnnnnnnnnnnnnnnnnnnnnnnnnnnnnnnnnnnnnccccgggcccgcc

SEQ ID NO: 9638 - DNA, 853 bp, Diabrotica virgifera
  misc_feature (70)..(89): n is a, c, g, or t
  misc_feature (179)..(196): n is a, c, g, or t
  misc_feature (286)..(305): n is a, c, g, or t
caaaaatgtatcttttattatagcacacaaagtattttttaaactacaaatatacaattttaacttgagnnnnnnnnnnnnnnnnnnnngtctagcaaaatggttgttactctaatgcagaatttcaaaacaacttgatatatttcaatagtcgaaagagttttcctggataaagtagnnnnnnnnnnnnnnnnnncagtcgaagaccagctcaaactgttttggtaaaaaaactgctacttttgagtttacttagaacaatttgttaattttagattgattgtcnnnnnnnnnnnnnnnnnnnnttgctgtttcgtgtatttatataatttttgggccagttcgtgacattctttgaacatttcccctcgtttttatcttattctgcactttatgtagataacaaccgctttgtatgaactaaaaacataatctttggtttaacatcaacagatccataacagtttatacataaaaaatcattttggcacgttttgtgagtattcctaagtgtttcacgatgagagaaccaatcccagtcttgcgaggcacatatttttacgtaaccttacgatttcccagtagacgtcgtgagcggaacttttgaccaagcctccttcgatgtacttgaggtagtttaaaaaatcacagactgcaattatcctattccgacaaatttgcgatatgttgtaccagtcgtcggtttctccaatactcattcgataaaaacataaccttgggacttccagcaaggcacattttttcggaaacatggctttggttttgtcgcccacggcctcgatgagaagggtaccagattctacagcatgcacgacacgatgagatagttctt

SEQ ID NO: 9639 - DNA, 80 bp, Diabrotica virgifera
  misc_feature (44)..(44): n is a, c, g, or t
ggcacgaaaggcgttttgagttgagcgttcataaacctcagctncattcctggtaagggaagtcagaaagtcacatttct

SEQ ID NO: 9640 - DNA, 712 bp, Diabrotica virgifera
  misc_feature (488)..(506): n is a, c, g, or t
  misc_feature (541)..(583): n is a, c, g, or t
agagtacagagtgaggttgtaggcactttctgtgtttttctgtattgtgtagttaaattatgagttatatgctagcaaattcaataattttagagataacttaaaaaatgaatactttggggcttagtatgatattgaaaatgggttgtatctgtgcaaaagaaaacttaagtataaacggaataagatatgtggtattagaacgcttaggagaagggggattttcctgtgtagatctggtagaaaatagtacaacgaaaaagaaatacgctctaaaaagaataacatgccacagtatagaagatcagaaaatagcaatgcaggaaataaattattacaaaaaacttaggcaccctaatattatagaacttgtggattccacttttaaaggatctgcagatattgtggtacatgctacatcagaagcatttctagtactcccttactacaaaagaggtactttacatgattacctcactttaagatcnnnnnnnnnnnnnnnnnnngatgttaaggatgtctggagaatatattttgacannnnnnnnnnnnnnnnnnnnnnnnnnnnnnnnnnnnnnnnnnncatatctcacagagatatagcaactgataatatatgactaacacatcatatgccctcctattctgatgcatgtgggatcttgtgctccaggaactgctcatattgtgggagctctacatgcacaagcat

SEQ ID NO: 9641 - DNA, 957 bp, Diabrotica virgifera
  misc_feature (237)..(264): n is a, c, g, or t
  misc_feature (780)..(780): n is a, c, g, or t
  misc_feature (801)..(801): n is a, c, g, or t
  misc_feature (869)..(869): n is a, c, g, or t
  misc_feature (911)..(911): n is a, c, g, or t
gttttatgcaactaaagacttatttttttagtaagtcaaaagagacagcaataggtgctcacatgatgctaattgttaaatcacaaattaattccttatttgtaatctcacattcttcttaacttcttaaaattgtatagtttcaccgtgtataattgaaacattggaaaacatatcgagtaatattttaataattgaatgggtgattggaaaaggagaagattcctgacaaccgtnnnnnnnnnnnnnnnnnnnnnnnnnnnntttgcgtcgaagccgctagttagatagccattctcttaatatttgtatcttagtgtaattcgccaaatttttggaatgttgtcctttttccaatcacccattcaattagagttcaacctgccaatttaataaattgacaaatattatattttctaattgaacttttcaagtgttgcaataacgtcctcgattaaattgtattgtaagctcctagttcaaaggttgtcattaatatacattatttgtgaaattataaattggggatttgagctcttttgagtgcagtctattatagaaaggtacctaaccaacaactatagtggaataatcagtagctgtcatataaccatattttttacttacactttaaacatatatatatcatcgtcgatcgagaagaaacggacacacggcattagaaaacaatcgaagctgatatatacatctaaatgtgcactaattaaagacgaaataccaataagacatattatagaggctatatctggaatcaaatcngaatcatccttacttttaatnatttttttctttccccaatttctggaaatccaacgaatttcatgacgacccaaatgaaaaataacatntgacttaagcgcagcttcatcaatgcatatattatacaattnttatccatttattctggcgtagtcttaacttttaattggatagcat

SEQ ID NO: 9642 - DNA, 102 bp, Diabrotica virgifera
ctcttcctgtcagtttcacacgtactattacctatttcctggaaaagtttctctcttttattgtggtattattagaccgatttatcttcctatagttcgttt

SEQ ID NO: 9643 - DNA, 911 bp, Diabrotica virgifera
  misc_feature (261)..(279): n is a, c, g, or t
  misc_feature (315)..(351): n is a, c, g, or t
  misc_feature (368)..(392): n is a, c, g, or t
gttgcagaatgttaataatttttccaaagaggtgtaagtatcgtacacattttgttgtggtgtttatttggtcatcgctgctcgattgtataggcatgtaccatttcatacatcatagtgtatttaacttataaccccatattatgtaaaccgtagtatactggtattgtattgtatgtatcgtacaagagaatagtatgtttaatatagtagcgtacttactatattgtattgatattgtacccatgatgaaagcattgnnnnnnnnnnnnnnnnnnnattgatgaattatatagacatagacaaacagatgannnnnnnnnnnnnnnnnnnnnnnnnnnnnnnnnnnnntggtaaaaaaagtaacnnnnnnnnnnnnnnnnnnnnnnnnnctaaaagttacaattaaaatgtttagaatattgaatccacttatagagtataacaatatgttatatttttttgcatgtattcttgtagatcatcagttttttacagaataaacgttttttgtgattattgatttggtcgtttgagtagatgtgtgataatagttggtatggtccgtgtatgagctaattcggtatggtctgtgtgagtaagttccgtgattttccagcgaagcctatctatatttgggtatattattgccacaggttagttggagaagtcatccttgaagaagtaaccccatgaagaagtgaagagggaaaccgtggcgaggcccctccacttattaatgaagaagtagaccccttgttttttcaagcagccaggagaaaagctatcactttttgatttgaagatagcgtactctgtcgacactgttttgaaaataacccttgatatatggatttgttcatgttagaagtgaagaaaagtaaccccatgaagaagtgaaagaggaaacc

SEQ ID NO: 9644 - DNA, 453 bp, Diabrotica virgifera
  misc_feature (46)..(66): n is a, c, g, or t
  misc_feature (87)..(104): n is a, c, g, or t
  misc_feature (124)..(160): n is a, c, g, or t
  misc_feature (176)..(195): n is a, c, g, or t
  misc_feature (227)..(258): n is a, c, g, or t
  misc_feature (282)..(326): n is a, c, g, or t
  misc_feature (328)..(393): n is a, c, g, or t
  misc_feature (395)..(407): n is a, c, g, or t
  misc_feature (431)..(452): n is a, c, g, or t
gaactcgtcatcgttaattagtatccgtgagagaatatctttatcnnnnnnnnnnnnnnnnnnnnncttttcgtacctcgtgtatcnnnnnnnnnnnnnnnnnncaattacacatttatcatcnnnnnnnnnnnnnnnnnnnnnnnnnnnnnnnnnnnnnatcgtaaaataaatcnnnnnnnnnnnnnnnnnnnntaacgaaatcgttactcgtttttaaatcatcnnnnnnnnnnnnnnnnnnnnnnnnnnnnnnnncttatctaacaatatcatttatcnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncnnnnnnnnnnnnngttattatttatcttttatcatcnnnnnnnnnnnnnnnnnnnnnnc

SEQ ID NO: 9645 - DNA, 679 bp, Diabrotica virgifera
  misc_feature (76)..(93): n is a, c, g, or t
ccctttacgtccggtcacaatcttatgaaagaatacatgcgagctcataaatgataaaaatatcgattgtaattcnnnnnnnnnnnnnnnnnntttgtaagcaacaataatgaagtgtcattatgaagttttaagtgtatccagagatgccgaagacggtgagattaaaacagcatacagaaagttggctctaaaatggcatcccgacaaaaatttggataatgcagagtttgctaaagaacagtttcaaatagttcaacaagcttatgatgtattgagtgacagacaagaacgagcctggtatgacaaccaccgtgagcagatacttaggggctcaagctcagattttcaagacaactccctggatgtgttccaatatttcacaacgacgtgctttaatggatatggagacgacgagaatggtttttacacgatatacaaaaatgtttttgagaagttatccaaagaagacatggatttcatggaagacaaagaagagttttgtagtgtcccaagtttcagaaattctacaagtgactttgaggtagcttcacaatattatgcttattggcttaattatgcaacaacaaaatctttcgtttgactagatccttataacatcaaagatattatagacagacggtatgctaaaatggtagaaaaagaaagcaaaaaaata

SEQ ID NO: 9646 - DNA, 849 bp, Diabrotica virgifera
ctactgccgtagcgtgatgagaagatttaacactcggtctggactgtgattactcctactaacttaatgaatggaagaagacaaacaccccggctatcggacccttctttgcattcatgggagccgcgggtgctatcacttttcagatacgcatgggcgccgcctatggcacggtaaaatcactgaaccgggattgccgctatgtcggtacatgaggacggaacttatgcatgaaatgtcattatcccactatgtcatggcggatatacattgccatctacggcctggtcatagctgtactgatctctggtaacatcccagatcagctctacatattcattgcacagcggatattgtccatttgggagctggtctttcctaatgattgtcatgattggcgttaggtgtcgctattgctatggcaggtgacgctgctgtaaaactgaccggacaactgcctaaactcttcgtacgaatgatcttgatactcattttccccaaagtattacgtctttatggtctcatccaccccatttacctctatactataatttacctgcccagctcgcctatgttatcatctcctaaacacagcgtacctgaagttgcgcatctcgccccgatcatgttggatgtagtgtctacatgtaataatacaaactgtatatatggtatcaggcgatgacagtgactgaatgatgcgaatgtacataatttacttattatggggtccgtattattcgcgtcacgggcatacagatattagtaattttagatacacaatactgaggctcttcatcttctgctgtgtccacgcacacgactaataattccatatttccatattca

SEQ ID NO: 9647 - DNA, 965 bp, Diabrotica virgifera
  misc_feature (321)..(338): n is a, c, g, or t
  misc_feature (813)..(813): n is a, c, g, or t
  misc_feature (851)..(851): n is a, c, g, or t
  misc_feature (874)..(874): n is a, c, g, or t
  misc_feature (885)..(885): n is a, c, g, or t
  misc_feature (932)..(932): n is a, c, g, or t
tgaaaaggctccgtattttctcaataggattaagctctggaatttaagcaggccagtccatttttggaataccaccaagatactgtgttacaatccttgccgtgtatgatgtcgcattatcttgcattaccaataaacccagcatatggcatcacacgatcttgtaggatattcattatgtatcggtgtgttgttaatgtgcccctttcaatcaagacgagatctatatgtgctccaaaagaaatccctgcccaaaacatatggtgccgggtgttgttaccccctatgatggggttgattaagtcaaacactattaccagnnnnnnnnnnnnnnnnnnacactaactataccagtacgagttggtgtgcaaagtctatattctaactacttgatgtctaaataatgaataaagaattaatgaactgcaatactttctccgtatctataaataaactcataattgtttttattatgattgccgacaccgaatcgaccgtgaaatattaataatatcaaaatagctgactaggtctttctcgaaacgactgccctactttgtgacatcaatgtcacctagttattctactataaacaataatgtttgtgtaagacctttaaaaattaaatcgatatgaattgttcttaattttttggatgctaatataaatcctgtgcactgagccaccaccaaaagcaaacaggtatgacagtacaggcagcataacctttacaaacccttctatggactgtagttcgacccatcttaaccataaattaatattacacactcatccgtaaccaatactatttcncaatagtctactgtccaattaacatgttcaagggccanaaatgtaagtctgcgtcttttgngagcaacaganagtaaatgaccctgtgctgtgtcacaatctgtcaatccctgttctgntaacctttgtcgagcagtaaaacgctgattact

SEQ ID NO: 9648 - DNA, 960 bp, Diabrotica virgifera
  misc_feature (788)..(788): n is a, c, g, or t
cccacgcgtccgatgtcctagatctgtcctctttaagtcctgatatgtggtatcagaatatgattgatagggtcactcaagacccacaaaaatatcctgattttaaggtagagaataatattctgtacaaacacatcttaagtccgatagagtccttatccaatatgtcggagtggaaaatagttgtacctacgccaaatagggaaaatattctgcatatgtttcatgatgaagttacggcgggtcattttggtttttataagacttatcaccgtattgccgaattatattattggcctggtatgcggaagtctataaaaaggtacatttctaaatgcatggtttgtgctacttgtaaaccaagtaacctaccacaggctggacttatgggttccttcaggaacataaattttccttggcagatgatctcaatggatctcattggaccttatcctcggagttacaagggtaatacctattgcctggtagttgtggattatttcactaaatttcctttagtttgtccccttcgccaggccacaactccagcaattttaaaatatttggaggaacaagtctttttggtgtatggtgttcctcaaattgtgtcatgtgacaacggtcctcagtttgtatcgaaggcctttaaagatcttctagctaaatataaggttcaaaagaccttttataatgctgcctaccatccacaagcaaatcatactgagagagtaaatcgcagtattgtcacagctctaaggtcctatacttaccctgatcacagagcttgngatcaatatattcattccatagctcaagccataaggacttctgtccatgaagttacccagtgctctccagcatatttgaattttggtaggaatgtggctttatcaggtgaattattttggtgtaatttcagacaattccgaaaatcttcctcaaatatctgagaaacttcat

SEQ ID NO: 9649 - DNA, 110 bp, Diabrotica virgifera
cggacgcgtggggcggccttcataggttacaaagcttgggtatgacccacgtgggtagagaggcagacagacctgggttcaagatcaaacagaaaagaattgtagaggct

SEQ ID NO: 9650 - DNA, 936 bp, Diabrotica virgifera
  misc_feature (12)..(40): n is a, c, g, or t
  misc_feature (828)..(921): n is a, c, g, or t
attagataaccnnnnnnnnnnnnnnnnnnnnnnnnnnnnnttttcacggcttgtttattattacaaaaccttttatcgtagcagtgtaagaaattccaatcaaatgaatgtgacatgcagatggatatcatcagtcatatatagaaaaactagacataaagcgagattggttcaatgcatctatccaagcagtattcatacttcatttgttaactctaaaagacgaaaaactgcagaagaacgtaaatctacaagaataatagagtattctccaaaagcaaaaggtgaagttattgatgtatggaggaacattacactggaagaattagcaaaggttatgaatcaagacataagatatgtatatgacatatttcttaaccaatttaataatccaaaaatatccataactgatataaaattgctccaacaaggtatcactagaagtggaaggaggatgaggatcattggcaaaccggaagacacgatagaagaagtaattaagagggatgcttttcccagacctccacctaacaaatctgagctcagacctcggcctccagttgttactgtgatgggtcacatagatcacgggaaaacgactttactcgatgctctcagaaatgcaagagttgtagatgaagaatttggaggtatcactcaacatattggtgctttctctgtggttctggattctggggcaagaatcacttttttagatactccaggccatgcggcttttacagcgatgagatcgagaggagctaatttgacagatttggtagtattagttgtggcggcagatgacggggtaatgggacaaactttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctggtggaagcag

SEQ ID NO: 9651 - DNA, 74 bp, Diabrotica virgifera
  misc_feature (5)..(17): n is a, c, g, or t
  misc_feature (20)..(72): n is a, c, g, or t
aattnnnnnnnnnnnnnttnnnnnnnnnnnnnnnnnnnnnnnnnnnnnnnnnnnnnnnnnnnnnnnnnnnnngg

SEQ ID NO: 9652 - DNA, 971 bp, Diabrotica virgifera
  misc_feature (852)..(865): n is a, c, g, or t
  misc_feature (867)..(881): n is a, c, g, or t
  misc_feature (935)..(935): n is a, c, g, or t
agatagaaagggatacgtatctattaatgacatcagaagaagtcttaagtctttaggaatgaaactgacagatgacgagatccacgttcttttatctgagatcaatcttatgtttaacggccaactggacatggcagactatcttcacatgatgtccgcaatcaaatctggacacgttgcttattcaagattcgcgagaatggccgaattagaagaaatcaagcaagaaacagaattactgaagaagaaggtatcagtagaacgtagtggcggtggtctttaaaccgtacaaactaaaagacacgattaaaaatcatatttactgaaacgaaagacatacttatttgaaaggcacatttcttggtattctatttttgtgcttgtggcgtaaacattacgaaatttaatcaaaaagtgttaatatattactcatttaaggtttgctattacttgcatggtattttagatatgaaaaaagagtttatgtaagaaacaatactctttcttattttatttccatgactgacccttaatcttcaaaaaacgttcaattatcctaaacatatcgtattaataatggcaataataattcttttcctcctctatattttctctttcataaggatgtagtggcgtcatgtaatttgtttaaccattgctgtcaaattatctcgctcctgtgcgtgttgttttgctttggagaataattaaccagttatgtcttttatttggtccgaccatcttactggagatcttctgaatcttttgcccgctacgttgacttcaacaactatcattcgttccatgccttcttttcttccatatgtccaaaatatctcaggctctatacgnnnnnnnnnnnnnngnnnnnnnnnnnnnnnatggtcgttaattacatgataacaagctttaatgccatttagtaaggtaataanaactgtactgatccacaaaaatagaatactaaaatt

SEQ ID NO: 9653 - DNA, 218 bp, Diabrotica virgifera
  misc_feature (26)..(63): n is a, c, g, or t
  misc_feature (83)..(96): n is a, c, g, or t
  misc_feature (99)..(121): n is a, c, g, or t
  misc_feature (129)..(151): n is a, c, g, or t
  misc_feature (181)..(212): n is a, c, g, or t
gaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9654 - DNA, 655 bp, Diabrotica virgifera
  misc_feature (29)..(47): n is a, c, g, or t
  misc_feature (60)..(82): n is a, c, g, or t
  misc_feature (84)..(121): n is a, c, g, or t
  misc_feature (133)..(155): n is a, c, g, or t
  misc_feature (159)..(178): n is a, c, g, or t
  misc_feature (181)..(207): n is a, c, g, or t
  misc_feature (209)..(267): n is a, c, g, or t
  misc_feature (278)..(308): n is a, c, g, or t
  misc_feature (334)..(355): n is a, c, g, or t
  misc_feature (373)..(422): n is a, c, g, or t
  misc_feature (433)..(450): n is a, c, g, or t
  misc_feature (498)..(562): n is a, c, g, or t
  misc_feature (566)..(599): n is a, c, g, or t
  misc_feature (616)..(652): n is a, c, g, or t
gagagaaaaaaacaccccctccctctccnnnnnnnnnnnnnnnnnnnggggaggggcggnnnnnnnnnnnnnnnnnnnnnnncnnnnnnnnnnnnnnnnnnnnnnnnnnnnnnnnnnnnnnctgcgccgccgnnnnnnnnnnnnnnnnnnnnnnntacnnnnnnnnnnnnnnnnnnnnctnnnnnnnnnnnnnnnnnnnnnnnnnnntnnnnnnnnnnnnnnnnnnnnnnnnnnnnnnnnnnnnnnnnnnnnnnnnnnnnnnnnnnngcgggaaggannnnnnnnnnnnnnnnnnnnnnnnnnnnnnntttttctcctctcctccctctttccnnnnnnnnnnnnnnnnnnnnnntagattttgtttgtttgnnnnnnnnnnnnnnnnnnnnnnnnnnnnnnnnnnnnnnnnnnnnnnnnnnaccccaccccnnnnnnnnnnnnnnnnnngggagcgggggttggttttctccccgccgccccgcgcgcggggggggnnnnnnnnnnnnnnnnnnnnnnnnnnnnnnnnnnnnnnnnnnnnnnnnnnnnnnnnnnnnnnnnnggtnnnnnnnnnnnnnnnnnnnnnnnnnnnnnnnnnnaggggagaagaaacacnnnnnnnnnnnnnnnnnnnnnnnnnnnnnnnnnnnnnttc

SEQ ID NO: 9655 - DNA, 867 bp, Diabrotica virgifera
  misc_feature (4)..(51): n is a, c, g, or t
  misc_feature (55)..(75): n is a, c, g, or t
  misc_feature (96)..(124): n is a, c, g, or t
  misc_feature (132)..(176): n is a, c, g, or t
  misc_feature (210)..(261): n is a, c, g, or t
  misc_feature (264)..(281): n is a, c, g, or t
  misc_feature (307)..(329): n is a, c, g, or t
  misc_feature (332)..(350): n is a, c, g, or t
  misc_feature (356)..(400): n is a, c, g, or t
  misc_feature (411)..(472): n is a, c, g, or t
  misc_feature (482)..(495): n is a, c, g, or t
  misc_feature (497)..(532): n is a, c, g, or t
  misc_feature (553)..(687): n is a, c, g, or t
  misc_feature (700)..(732): n is a, c, g, or t
  misc_feature (739)..(859): n is a, c, g, or t
cctnnnnnnnnnnnnnnnnnnnnnnnnnnnnnnnnnnnnnnnnnnnnnnnncccnnnnnnnnnnnnnnnnnnnnnaagagtcgcgccccacccccnnnnnnnnnnnnnnnnnnnnnnnnnnnnnacgcgttnnnnnnnnnnnnnnnnnnnnnnnnnnnnnnnnnnnnnnnnnnnnncaccaccaccccccccgcggggggggagagagannnnnnnnnnnnnnnnnnnnnnnnnnnnnnnnnnnnnnnnnnnnnnnnnnnnggnnnnnnnnnnnnnnnnnncaaaacaataaaaagagggggagtannnnnnnnnnnnnnnnnnnnnnncgnnnnnnnnnnnnnnnnnnnccaccnnnnnnnnnnnnnnnnnnnnnnnnnnnnnnnnnnnnnnnnnnnnncacccccccannnnnnnnnnnnnnnnnnnnnnnnnnnnnnnnnnnnnnnnnnnnnnnnnnnnnnnnnnnnnnccgcgggggnnnnnnnnnnnnnngnnnnnnnnnnnnnnnnnnnnnnnnnnnnnnnnnnnnacaaagaaaaaacgcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacccccctcnnnnnnnnnnnnnnnnnnnnnnnnnnnnnnnnnagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaccac

SEQ ID NO: 9656 - DNA, 748 bp, Diabrotica virgifera
  misc_feature (130)..(177): n is a, c, g, or t
gtttgacaacgagtaacgtttttggcggattttattagttttacatattttattaaaaaacaattctatttagacctaaatgtttaggtaaatcatattttgagatatacaaatcttccattagttgatnnnnnnnnnnnnnnnnnnnnnnnnnnnnnnnnnnnnnnnnnnnnnnnntgggacaaggaagaaccccctgaagatgctggtacatttcaaagagcttctgaggattctttgaaaagtagagttataaaaactgcaagaaggagaaatcctatatcttcagttagggatggtggtgatggtgaaaagaaaagtgccttcaccagttttacaggttttggaaaagcagcaccgccaacatccacagctttttcttttctatccaatctggctaaacctaatacccctccaaaagtaaatggtacaggtggaatttcagaaaaatctaagaatgatgcttcagcattcaagtatagtagtagtcctgtagatcaagttatccgtgaacacattcctgcgagtatgtataaatcagaaatttcttgtataatgatactccacgataatcataccacaccggccgtaattaaaggaggacttcgatttaagtatgtagtaattgaatttgattttgatttgttactagaatcaagctatgtgattttcatttatactttagagaacgaagattcatctgtttaaattacaatctaaaatagttttataagaaattgttagtttg

SEQ ID NO: 9657 - DNA, 86 bp, Diabrotica virgifera
  misc_feature (51)..(52): n is a, c, g, or t
caagcttattagctgtgtttttctggctagtgagcagtgatcaaccacaannagacacatggtggtgacgacgatggtgcggctct

SEQ ID NO: 9658 - DNA, 121 bp, Diabrotica virgifera
  misc_feature (2)..(120): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9659 - DNA, 420 bp, Diabrotica virgifera
  misc_feature (20)..(68): n is a, c, g, or t
  misc_feature (88)..(108): n is a, c, g, or t
  misc_feature (135)..(196): n is a, c, g, or t
  misc_feature (242)..(274): n is a, c, g, or t
  misc_feature (291)..(390): n is a, c, g, or t
cggcgccgccccacaccccnnnnnnnnnnnnnnnnnnnnnnnnnnnnnnnnnnnnnnnnnnnnnnnnncgcaagatgtttttgggtgnnnnnnnnnnnnnnnnnnnnnttctttcttctggctccgtccctttcnnnnnnnnnnnnnnnnnnnnnnnnnnnnnnnnnnnnnnnnnnnnnnnnnnnnnnnnnnnnnnttgggagggaggggggtggggtgtgcgcttatcctaatatgacttnnnnnnnnnnnnnnnnnnnnnnnnnnnnnnnnnggcggcggcgcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacataaaaaaccgggggggcctccctct

SEQ ID NO: 9660 - DNA, 907 bp, Diabrotica virgifera
  misc_feature (2)..(44): n is a, c, g, or t
  misc_feature (52)..(883): n is a, c, g, or t
  misc_feature (885)..(886): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanntaattttttgatccatttttt

SEQ ID NO: 9661 - DNA, 77 bp, Diabrotica virgifera
  misc_feature (2)..(46): n is a, c, g, or t
  misc_feature (51)..(51): n is a, c, g, or t
gnnnnnnnnnnnnnnnnnnnnnnnnnnnnnnnnnnnnnnnnnnnnnagttnatgtaatttgatatttattattaata

SEQ ID NO: 9662 - DNA, 655 bp, Diabrotica virgifera
  misc_feature (5)..(35): n is a, c, g, or t
  misc_feature (48)..(71): n is a, c, g, or t
  misc_feature (103)..(198): n is a, c, g, or t
  misc_feature (200)..(336): n is a, c, g, or t
  misc_feature (350)..(411): n is a, c, g, or t
  misc_feature (418)..(437): n is a, c, g, or t
  misc_feature (520)..(570): n is a, c, g, or t
  misc_feature (595)..(622): n is a, c, g, or t
  misc_feature (629)..(653): n is a, c, g, or t
ctcgnnnnnnnnnnnnnnnnnnnnnnnnnnnnnnncaaaaaagaggcnnnnnnnnnnnnnnnnnnnnnnnncttttgggtgggggggtggggggggagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatttcctccnnnnnnnnnnnnnnnnnnnnnnnnnnnnnnnnnnnnnnnnnnnnnnnnnnnnnnnnnnnnnngaggcgnnnnnnnnnnnnnnnnnnnnaaggactccgccccattcttattgttttttgtttgttgtggtggttttgtttttatttcttttcttggataggagagggagannnnnnnnnnnnnnnnnnnnnnnnnnnnnnnnnnnnnnnnnnnnnnnnnnntccccttctcctctccccgggggcnnnnnnnnnnnnnnnnnnnnnnnnnnnngggatgnnnnnnnnnnnnnnnnnnnnnnnnnct

SEQ ID NO: 9663 - DNA, 132 bp, Diabrotica virgifera
  misc_feature (87)..(87): n is a, c, g, or t
  misc_feature (101)..(101): n is a, c, g, or t
  misc_feature (104)..(129): n is a, c, g, or t
agttccagggggaaaagtgaaagggggaagtggaagcaggagagaaaacggaacttcgggattttcgcaattagaaaaaaattattntgatgggaaagaanacnnnnnnnnnnnnnnnnnnnnnnnnnnaca

SEQ ID NO: 9664 - DNA, 79 bp, Diabrotica virgifera
gatggtgtttttgtcagtggctgaatcaatagaattccacttggagaagttttgaaagccgagggatgcactttaacag

SEQ ID NO: 9665 - DNA, 164 bp, Diabrotica virgifera
  misc_feature (120)..(120): n is a, c, g, or t
  misc_feature (147)..(148): n is a, c, g, or t
taaaagcagtgttttcgtctgcaaacaacctaaaaatggaacgagtaaccagaatatgtgctcaacatcttatcaaacatctctctgctgagaactgcgttgagattagatctctgccgngtatttgcagaaataagaaattatccnnacagtggataccttca

SEQ ID NO: 9666 - DNA, 725 bp, Diabrotica virgifera
cccccacggaacattagggtgcgaccaaaatcctcttcctctcaaatcacaagtaactagaagcaatcatgtctaaccgagcctatcatcctttcaaatgtacacccactggctaccccgactatcccttctaccccgtggcagatgccgccagcttgaagaacgccatgctaagtttcgacaccggcaagaaatacttcatccacgtcctgtcccgaagaggcatcgttcaacgtctcgatatctccgaaaccttcgagacctcctacagcaaacacctcggctcagagttgaagatcaaattgggaagtatgttccacgatgagatggaagccctcatgactccactgatcacaattgtatgacgttgaactacacaaagccatagcctgtatggctaccgctgaagaagctatcatccatatcttgtgcacattttcccactacggaatgcgcaccatctcacaattttatcaacaaatgtacagcagccctttagaacaacatttgactggagatactttaggacatttcgaatggctctgagtgtctttagtgcaagctaacctagacgaaaaagaaggcgacaatgcacaacaagccctcaccgactccgaagctatgatcgaagctggcgagatcaaatgaagctaccgaataccccatcttcaacgctgtcctcatcgccaagagttaccagcaattatgagcgacattctctgaat

SEQ ID NO: 9667 - DNA, 808 bp, Diabrotica virgifera
  misc_feature (2)..(795): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaaaatag

SEQ ID NO: 9668 - DNA, 258 bp, Diabrotica virgifera
  misc_feature (59)..(72): n is a, c, g, or t
  misc_feature (75)..(87): n is a, c, g, or t
  misc_feature (211)..(211): n is a, c, g, or t
cggacgcgtggggttgagttgtacgtgtaagatataaaagagtttttaaggtttttggnnnnnnnnnnnnnnctnnnnnnnnnnnnnaggtgtgcagattataaaagtgttatattcatattttttgtgatattagttcgatacgaattttatttttatagaataggtgcgttcagctgatatttggttgagaaactgaaaagtacatggnggaatatatgtgtacagtaccctgactaacattatggcatatattat

SEQ ID NO: 9669 - DNA, 741 bp, Diabrotica virgifera
  misc_feature (97)..(124): n is a, c, g, or t
  misc_feature (127)..(149): n is a, c, g, or t
  misc_feature (466)..(490): n is a, c, g, or t
  misc_feature (560)..(573): n is a, c, g, or t
  misc_feature (575)..(587): n is a, c, g, or t
  misc_feature (590)..(602): n is a, c, g, or t
  misc_feature (613)..(633): n is a, c, g, or t
gtgttatctattttaaaagaataaactattctgtactaagagcaaagacaaatttcatttaatgatagtgacctaggattgttgacagaatatctgnnnnnnnnnnnnnnnnnnnnnnnnnnnngannnnnnnnnnnnnnnnnnnnnnncctaataattctatatctatcatttcctagtctccgagagctaaggcattgagcatactttattgccacctacctacgtgacatacccttcttcgtgtgacatgttatctccttctccaatcctctctgattctgtaagaaatacattctatgtattcattatcactatatttatcatcacacattttcacacctattcctattaaatagtcataggcatgagcgtaccaaacacctttgattcccatttcatcttcacctccgacttaacatcctgaatgttcatcatgtaaaatatgttcttagtcatattctannnnnnnnnnnnnnnnnnnnnnnnncaatgctttattactcatcatacatttaaatcatccaaatttagtgacgatgcaaactgtagtcaaatgnnnnnnnnnnnnnncnnnnnnnnnnnnntgnnnnnnnnnnnnngccgcacatgnnnnnnnnnnnnnnnnnnnnngcatgtcgctctgtatgatccatacagactcgcctgcccactgatcaacttgaatggtcgcggtatctccaccgtgctaatgtctcatcgtcattatacttcgtattg

SEQ ID NO: 9670 - DNA, 777 bp, Diabrotica virgifera
  misc_feature (466)..(484): n is a, c, g, or t
  misc_feature (539)..(557): n is a, c, g, or t
aaaaaatacacattctattgccaataactcattttgaactaaaattagtttagttctttacgtaaggaatgtattcaaccgtttattaccttcaatttcagtaattataacttttttctaagagcttatagtttttgatttatacgtgaaaaaccgatttaaaacatgcattttttttacgacaaaataaaatctttggtctttaatagcttgaaaagtgttgatttgttttaataactttatataacaagttttgcttgtaatttgtccctctattgacttatggtattatttttaataagatagttttcacccccgagagggggcggcatccacccccggggtaaaagtgcaagttggcatcatgtcacctttgttccttgaggtatcctctaattacttaccaattttcatgaaaatcgatggaggttcaacgatggaggtgaaaaccttcaatgactgcacnnnnnnnnnnnnnnnnnnngtttgttaaaaaactgccaaataaatatttttttggtacaaaatgcatttctagnnnnnnnnnnnnnnnnnnngaacaaatgagacacacgttctagaaggagaagtacaacaaggttcaacaactggggaaggtcgatttctagtacatttcttaaatccaggttagtagaagattcgagtttcaagtattcgacaaatacaagtaaaagttttcaatttattaaaatatgaaataatattggaccattatcctggttacaccgccgtgctggtctgggtacacttcgatgc

SEQ ID NO: 9671 - DNA, 108 bp, Diabrotica virgifera
  misc_feature (2)..(50): n is a, c, g, or t
  misc_feature (52)..(94): n is a, c, g, or t
  misc_feature (99)..(99): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnncgaanttaaagagc

SEQ ID NO: 9672 - DNA, 146 bp, Diabrotica virgifera
cctctcacagccgctccgggatacgtttgtgtttttatgtgtttccctctctgagtgatattgcatataagtgccagtttaatacgtgagtgtgcttttgatcttaaacgtataatttccaccaacgatacagcagagtccgcgga

SEQ ID NO: 9673 - DNA, 846 bp, Diabrotica virgifera
  misc_feature (134)..(157): n is a, c, g, or t
aggtacttaattttatttttcgagtgatcacacgccagttagaaatcccaatcgacttggcatccccttcccgagaaggagctccaagcattctctaacgtcgaataagagtttataacaaacaactaagtgtnnnnnnnnnnnnnnnnnnnnnnnnccctgtttttaagtgtattcttttgtggcgtatgaagtacgtcacgcgtgtacttatgttacaacttgatgcgcgggtagttaaaggttaaatgcgatctccaaacggatgataaacgaaatagtatacatgtttcagtcagtcaattagcttgatgctaaatttcagtcaacgcacagtcaaattcttggaatattttacgtgttaacggttttaatggttttacgtttggcctcttttcttttacggaatggaagcatggacgttgaagggccagcttcattaacaaacttgaagtctttgaaatttggtggctgcgctgaagtcttagaatggtcatggggcagacagagtcagaaataaggaagtaataagaagagcaggcttctaggatagggaaatttttgattatgtaaaaaataagaagactggcatatttattacatatattacgaagagaacaattcaattttcagcacctggtactcgaagaaaagatagaggttaagagagggatgggacgtaagaagatgttattgctgcgtaatattgagcaatgaacagggattcacagctataagatgcttcgcaatggtgaaaaaatagaacagaataattttattctgactatctaacatctcaccctgataaagaatggtacgggtaggatgctacgtagaaatgcacga

SEQ ID NO: 9674 - DNA, 316 bp, Diabrotica virgifera
ggctagtatgttacagtaagctctaattattctactttgaatatttaaaataggttctagagaaaataggtactaaaagcagaaataggtactaaaataggtactaaagcagaatattaaaaacgaaaagtgactttgcgcacgattccccatccgtgagggtaatcatgcgcacggataggtaaatggtgcgcactgaataatggttttataaaattctttaaatatcgttcttttctggtttccagcaaatggaacatgtccctaggtgcagctggttttctggtggtggaatgaaacttaattttatatcata

SEQ ID NO: 9675 - DNA, 503 bp, Diabrotica virgifera
  misc_feature (190)..(207): n is a, c, g, or t
  misc_feature (211)..(233): n is a, c, g, or t
  misc_feature (328)..(412): n is a, c, g, or t
ataagtggaaacgtacggaagcacgtggtgtgccgtgaaagggaacaagggaacatcgtccggacgtcaccgtgtgtagtgaatcaaaacaacaataagacaaataacactataaaatataacaaaaaaagagtgtgtgtacttcgtacgcgagtaagaagttatacttctactattatgattttaacgnnnnnnnnnnnnnnnnnncagnnnnnnnnnnnnnnnnnnnnnnnattacactaatttttatacttaaaataataccaaaaaaatagcgttaatatgtaaatttttatgaattgttgcctccgcgcatttgattttctcnnnnnnnnnnnnnnnnnnnnnnnnnnnnnnnnnnnnnnnnnnnnnnnnnnnnnnnnnnnnnnnnnnnnnnnnnnnnnnnnnnnnncctattcccaactaagataaatacataactgttattgtcaccggtaaactaagttaaggaagtcaaagtggaaacaagtagtgtgctatgg

SEQ ID NO: 9676 - DNA, 895 bp, Diabrotica virgifera
  misc_feature (156)..(245): n is a, c, g, or t
  misc_feature (839)..(839): n is a, c, g, or t
gaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgccaaaaacgctttcattgatcaagaacgaaagttagaggttcgaaggcgatcagataccgccctagttctaaccataaacgatgccagctagcgattcgccgacgttctccgatgactcggcgagcagcttccgggaaaccaaagcttttgggttccgggggaagtatggttgcaaagctgaaacttaaaggaattgacggaagggcaccaccaggagtggagcctgcggcttaatttgactncacacgggaaacctcaccaggcccggacaccggaaggattgacagattgagagctc

SEQ ID NO: 9677 - DNA, 862 bp, Diabrotica virgifera
  misc_feature (2)..(836): n is a, c, g, or t
  misc_feature (842)..(861): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtnnnnnnnnnnnnnnnnnnnnc

SEQ ID NO: 9678 - DNA, 264 bp, Diabrotica virgifera
  misc_feature (49)..(66): n is a, c, g, or t
  misc_feature (70)..(88): n is a, c, g, or t
  misc_feature (156)..(175): n is a, c, g, or t
  misc_feature (207)..(258): n is a, c, g, or t
tccatttttttttgattaaaagaataaattaccttaagggataaacggnnnnnnnnnnnnnnnnnngttnnnnnnnnnnnnnnnnnnntgccccccccaagggtgggttaaaattatatatttgggggaagcagcctattttattaattctgtccnnnnnnnnnnnnnnnnnnnngatttggaattaaacccgggggggaccccggnnnnnnnnnnnnnnnnnnnnnnnnnnnnnnnnnnnnnnnnnnnnnnnnnnnngggacc

SEQ ID NO: 9679 - DNA, 139 bp, Diabrotica virgifera
  misc_feature (4)..(17): n is a, c, g, or t
  misc_feature (20)..(42): n is a, c, g, or t
  misc_feature (50)..(72): n is a, c, g, or t
  misc_feature (102)..(133): n is a, c, g, or t
gatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9680 - DNA, 1012 bp, Diabrotica virgifera
  misc_feature (851)..(851): n is a, c, g, or t
agcgaacaaggacctccgacatccttctcccgtccaccatcatgacctttcggagcgcttgaacttaggttcaatttagggggttgagtactcccccaagtatgcaggagtgttgattttttagtgataaaaattattgtgataatcatacaatcatgaagctagagtggatgattttcgtactgtaccttttttgtgttttggacttttgtttgtgtaatccggatgccaaaagactgtatgatgaccttttgagtaattataacaggctgataagacctgtcagtaacaatacggacacggttttggttaaattaggacttaggttgtctcagcttattgaattgaatcttaaagatcaaattcttacaacaaacgtctggttagagcatgaatggcaggatcacaaatttatgtgggatcctcaagaatatggaggagtaactgaattgtacgtaccatctgaacatatttggttgccggatatagtgctttataacaatgctgatggggaatacgtggttactacgatgacgaaagcggtactgaggcatactggtaaagtactttggacacctccagctatctttaaatcttcctgcgaaatagatgtgagatatttcccattcgatcaacagacttgcttcatgaaatttggatcatggacctatgacggaaatcaaattgatctaaaacacattaaccaaaaactcggtgaggataaagttgaagtaggtatcgacttacgggaatattatcccagcgtagaatgggatattcttggagtaccggcggagagacacgaaagatattatccatgctgtgctgaaccgtatcctgatatattcttncacataactttaagaaagaaaactctattctacacagtcaaccttatagtaccgtgcgtgggaatctcttatctctcagtgctggtggtctatctacctgcagactcgggcgaaaaaattgctctctgtatcaatatcctcctctcccaaaccatggtttt

SEQ ID NO: 9681 - DNA, 646 bp, Diabrotica virgifera
accggacagacgcctcgagcggactgcgatagattgacgcaaatgcctacgacgactgaagcatgaaccacacaatgcagctgatataagccgacccctagcaacgtcaatgcaaagacgccagcggtcacgctgaatacgataatgaggaaataagagactttgcagacaagctcacgccatttaaaaatgacctcaccaccaacaagaatgcattgcagtatgccaaccaacaactggaaaaccaagaatacgcattaacgtcaaagcagaacctgaaatcccctctcatcacctgagggcacaccttcttgaggaagacttgaaaagaaccgaagaaactttgcggtcaactaccactaagtggcactgattactacacaagctcgaacgatgaaagctcccttatgaccagagcactggaaaaccgtgtccatctagatgaaaaacgtatgacctaactgctacaacacgttcaaagaaatccttatacatggctgtacacgctgacaacatatcagaggaagtatcgcgtaaacttgccaccgtttaagacaaactagcaataaatgaggaccgcagaaagggtgtagattctaagattatggaactctatgaaaaactgaaagtaggacgtaacacactc

SEQ ID NO: 9682 - DNA, 854 bp, Diabrotica virgifera
  misc_feature (2)..(852): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 9683 - DNA, 710 bp, Diabrotica virgifera
tgaagaacctttgttcgacatactaagaacaaaggaacaactaggttaccatgtttactgtgccttaagggacacttatggtgttttgggctattccatcaccgttaattcccaagctaacaaatttacaactaaacatctcgacaacagaatagaggagtttttgaaacacaccgagacaattatagaaaagagttcagggaaagaatacgaagaaatgaaacaaggattaatcgaaactaaggaaatagttgattctcatttaaaagaagaagtagatcgaaactggtcggagatcataaacgacgaatacatgtttgaccggtctaagcaagaaatcgaggagattaagcaggtacttcatgaagatgtgaagaactggtggaataggcataactattttggtacaaagggcaactttagaaaaatcagcgttcaagtggtcggccacgttccggatgatgcttctaaaggagaacccgccgaaccgagcttcaccaagaaagttcagttaaaaattttagattcagataacgaaatagttgaggcaaaaagtcctgattattttgttagcgaaatcgaccaatttagatcaaaattacagtcataccctgcaagactcaaaaaatgaaaacttacctagatatttcgaaaagaaaatttttatacagctgtttactatttattgtttataaataaagtctagcaac

SEQ ID NO: 9684 - DNA, 989 bp, Diabrotica virgifera
  misc_feature (69)..(69): n is a, c, g, or t
  misc_feature (614)..(614): n is a, c, g, or t
  misc_feature (851)..(851): n is a, c, g, or t
acaaaacaatcaccatgcactttaactttgtgtacagaagagtaccactcgtagtagattatcgtacanatagttctcggtttaatacccgcacggtttttgattttggtggctcacttcattatttgtgttactttattatggaacaaggaggagtcagtgaatgcttgtttagtggagcagatggacctagaggtagaaaaaattcatggcagttaccttacacagatatttccatagaacgccccggatggacgtttctgttgatattggcaggaacggcaacaacgataggactgtcattaccagtaggatacaatataggcgttgtaaatactcctgcagagataatcaaggaattttgtcgaaatattatcacagagagatttggaaatgagccgagcacataccaactcgaattaatatggtcatcgatagtatccatatttttggttggagcagcaattgggtcattgggaggttcggtattggctgacaagatcggccggaaaggcgtattagcagtttgttctggattagcagctctttctgcactagtgttttttataagtcgaccagtaatgtcaatagaattgtttcatcggaagattatntagttggattttcttcaggccttacaactactgttgttcctatgtatttaactgagttagcacctattcacttaaggggatctacgggtgtactatgccccctaggagtgacgataggtgtactgatgggtcagattatgtccatgcatgatatattaggtaataacgattattggccttattgtttggctgcatatgtaattcctgtgattatctgctcctttacactgccaatantgcctgaaagtccgaagtacttgttttgtataaaaagagatcaacaaagagccgtccaacattaaaccgtctcaggaattcaaacatctgcagtaaattagaaatattggaactaaaaaagaacacagacacgaaaaa

SEQ ID NO: 9685 - DNA, 381 bp, Diabrotica virgifera
  misc_feature (2)..(283): n is a, c, g, or t
  misc_feature (288)..(344): n is a, c, g, or t
  misc_feature (346)..(379): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnncc

SEQ ID NO: 9686 - DNA, 1066 bp, Diabrotica virgifera
  misc_feature (2)..(519): n is a, c, g, or t
  misc_feature (521)..(732): n is a, c, g, or t
  misc_feature (740)..(778): n is a, c, g, or t
  misc_feature (780)..(796): n is a, c, g, or t
  misc_feature (798)..(826): n is a, c, g, or t
  misc_feature (1042)..(1062): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggcnnnnnnnnnnnnnnnnnnnnnnnnnnnnnnnnnnnnnnngnnnnnnnnnnnnnnnnnannnnnnnnnnnnnnnnnnnnnnnnnnnnntccttaaggaaaacagcgtaattttatgggaaagttcaaaccgatataaagattgcaactccgaagttggattaaaggtctaaaagatggaccatttatattataaatcctgtcggctttttaaaatttactggattaaatttaaccccgggggaggcccgttgggttctaattttaatttttacctctttttaaaccaagggcccaaattatacnnnnnnnnnnnnnnnnnnnnntttt

SEQ ID NO: 9687 - DNA, 570 bp, Diabrotica virgifera
  misc_feature (547)..(566): n is a, c, g, or t
cccttaacgtccggaggtgtttgcctctagaaatacctcatttcctcttggtagcctcacctactgtggatgtggtcgggatatatgcaggcgtcgctgcctactgcagagatgtaccgctgtagctccagaagaacacccgttcctcctctctgagtctcctctcatcctccctgcaatcttattagagacgactcaaagtatggttgaatccttcgtcacaaccaccattgttgaactcatcaccgacgtactctctctggcacgcgtatggtcatacctctgttaatgtattggattccggagaagatgtcgacgatgcctttccctacaacacatgctgcactctttctcgcatcatccgccatttcgaattgaccggtcgagacctgttcctactacctcatgactaatcttacctgcaacatgtcactcattcacctccaccgctgtggaggaaattgtgcgcgacatctcaccaatagtctgacatctcagcctcttgtacacagatgtaacgtccactggtgatgtttccacctcccannnnnnnnnnnnnnnnnnnncaga

SEQ ID NO: 9688 - DNA, 880 bp, Diabrotica virgifera
  misc_feature (192)..(214): n is a, c, g, or t
  misc_feature (597)..(617): n is a, c, g, or t
  misc_feature (713)..(713): n is a, c, g, or t
  misc_feature (750)..(767): n is a, c, g, or t
caaaaagaggaaacagaaagatgttttaaaatcaactgaggaagacgtagaaccttccgaaggaatagttcaagaagtcgaagaagaagaaatcattacagaagaaaaagtagaacttgtagctgatgaaaccacaagtaaacttcaacagtctactgtaactgtagtggaagagcccgtcaatctagctgnnnnnnnnnnnnnnnnnnnnnnngcaccaagaaagattgaaccaaaaacaaccaaagctcccaaatttttattaaagagcaggatagttcacgttccattcccaccagaaaatgaagccaattctattcctgtaatcaaggaacttcctcctgtatacagggacaatggagttctatctagaaatctaaaagaatctgaaaaggttcccaaaaagaagaagatcagggttaaagatattgaaagggaaattaaatcactggaaaaactggacaaagatttcgaagattctaaaaagggactcgaaaaggttgatgatgaatataaagcacctaagaaaccaaaagaaaagccagaaataattgaagaagaagcaaaaccactaaaaattggaaaaggaaaattacnnnnnnnnnnnnnnnnnnnnnaaccagatgaaaaactgcctgaagaagttactaagaaacctaaaaagcccaaagtaaaaccaaaacctgaaactgaagaaatcactttagaattgngtaaagggcaaccaaaggaagaagaagaaacccctgnnnnnnnnnnnnnnnnnnaacagaagccaaaaccggaggaagttgttgaaaaacctggactcaagccgttcaaaaagaagatgataacgagacatatacagtaattgttgaagaaccaaaagaacccttaa

SEQ ID NO: 9689 - DNA, 884 bp, Diabrotica virgifera
  misc_feature (860)..(860): n is a, c, g, or t
aagaagaagtagtggtgttgtcgccttttgggggttcttcagcatttgatcggaaacgagatgctctccaaggttcatttttgggttcgtcagcaggtttctcgtccctcctccaagaagagctattcttggggtctttcctccaagaatcttttcctttgtcgctgctttctttctccattgctaatttcttttcgatttcttcctctttagctttctgcattgtccaagctctatccaaactctcttgatgttccttcttcttcctttcttgttcctcctttagtgcgcgttcttgttgctcctgttctttcctcgctatttaaacgctcaatgtattcctttctatcctcaataatcttgtgtctttgtaaaattttctggtgttcccttacctttgtttcgtgataattctgaaccataacagctctaagtttttcgcgttcaagcttcttcttattaggattaatgacttgtatggcttgattcaaaacagtagacatgttaataagttgatttctgacttgctcactaggcataacttgcaaagtgggtccctctggtttgtcctctctttgactctcactcaagtccattccaaagtggatacagtctttgccatgatcaatacgaatttgcatatcattgtgtctcacacaatcaaccaaaagtctctccagatgaaaaggtgtagtaaatttggcaatctggatcaacctagcaaattcaatggtctgatagacttgtgctatctgtctcactagacgcaccagagttacatcttgtaaagctggcacatattgttggagggctgcattttcttcagactcgagagatttgattacctcatgcactctctngacacatagtaaaggatggaactc

SEQ ID NO: 9690 - DNA, 328 bp, Diabrotica virgifera
ccaaggacaaacaaacaaaacaaaaccaaccacgacaaaatacaccaacaaccaaaatcctccaagacaaccgggcgaaaaacaagcagcacaacacaagacacacccaaggaccggggcgacggaccaaaggcgcccataaacccgaccgaagacccaaagaacaagaccagggccaaaaagcacgccggaaggaagaaaacccgaagctagccaagaaagagggaccgaacccagcccagacagaaaaaaccagcgccccacactgaaaatcataagacccacaatacaatactcctccgtagtataccaacgatgtactgcccac

SEQ ID NO: 9691 - DNA, 933 bp, Diabrotica virgifera
  misc_feature (21)..(42): n is a, c, g, or t
aaagtttttaatattaccaannnnnnnnnnnnnnnnnnnnnnttagtcttttagttttacttcttcttcttcttcagcctgtgttcgtttactgctggacatatgcctcttccatttgcttccatcgatttctactcttggcaattctcatccactgcttgcctgcgacttgtttgatatcatctgcccacctcttctgcggtctgcctactcctcgcctgttctctgttggtctccagtttgttagtctctgtgtccatttttcgggattatctcgagcaacatgtccgacccattgccttgctatacgttctgcgacatcagtcatctttgttctttcacgaatgtcgatatttagaattctgtctctcaaactaatcgctagcatggtcctctccattgctctttgggttgtactgagctgctctaaggttttctttgtaaaggccatggtctccaatccatatgtagttacaggcaagatacatttgtcataaactctacgttttaaacacattggtatatctttattcttcaagataaagcttaacttgccgaaagctacccaagacaattgtatgcgtcttttgatttcggatatttggttttctttgccgattttaatagtatgtccaagatatatatagtggtctacattttcaagactgacgttgtcaataacagattagtttgtacattcctcatatttttgttttctgaagagattcattttgagagctattttatttgactgctggtttaattccttcatcatttgctccagacctataattaaaataacagatgggcgatggacacagagattactggaatcgagaccaagggaagacaagataagcgttggtccaccacctacacgatggactgacaattgaagaaggctaaatacaaaatggccgagaatagcgcatg

SEQ ID NO: 9692 - DNA, 859 bp, Diabrotica virgifera
  misc_feature (89)..(110): n is a, c, g, or t
  misc_feature (260)..(279): n is a, c, g, or t
caaagttgctggtgacgttcggtggaattgtaaacaactctggaaaaatgtatggattcgtaaattatgcccttgaagtgttggtggtnnnnnnnnnnnnnnnnnnnnnntgggaaatcataaaaaagaaagcagacttccagatggaaggacattttttagtcagacaaatttacgaagatgaacttacttacaatctcataggagcggctgttgaagttctaaaaattcctgcgactacaatattagaactattcggnnnnnnnnnnnnnnnnnnnngtcaggattccggatatgacaaaattctccaagtactaggcgccacacccagagattttttaacgaatttggatgccctgcacgaccacctgggtactctatatcctggtatgaaagctccttcgtttagatgcaccgaaagaccggaagacggagcactgattcttcattattactcagatagagctggtcttgaacatattgtgattggaattgtgaaaacagttgctagcagacttcacaatacggaagtggaagtggaactaatacaaactaaagatgaaagtgatcacgtgcaatttcttattacagaaaaatttgggacaaagaagtcccaattgcgggagatggatgagattgaaactctgtcattagaaccaaaagttagcccagcaacattctgtaggatctttccctttcatataatgtttgatgctgagatgaagatcgttcagacgggattctcagtagcaaaaataattccataagtgagttcaactggatgtaaaagtaacggacatattggaccccggccagacttcatttgggaacttaacttttgaaaaccattctttgttcc

SEQ ID NO: 9693 - DNA, 61 bp, Diabrotica virgifera
ccctccccgtccgagttctgttacatacgatacatcatgaagtccctgctgctttttgttg

SEQ ID NO: 9694 - DNA, 522 bp, Diabrotica virgifera
  misc_feature (2)..(43): n is a, c, g, or t
  misc_feature (49)..(71): n is a, c, g, or t
  misc_feature (265)..(336): n is a, c, g, or t
  misc_feature (341)..(406): n is a, c, g, or t
  misc_feature (424)..(442): n is a, c, g, or t
  misc_feature (451)..(465): n is a, c, g, or t
  misc_feature (467)..(483): n is a, c, g, or t
  misc_feature (486)..(504): n is a, c, g, or t
gnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 9695 - DNA, 138 bp, Diabrotica virgifera
  misc_feature (7)..(44): n is a, c, g, or t
  misc_feature (82)..(104): n is a, c, g, or t
  misc_feature (112)..(135): n is a, c, g, or t
taacagnnnnnnnnnnnnnnnnnnnnnnnnnnnnnnnnnnnnnntggcgacctcgatggttggattaaaagttataattggnnnnnnnnnnnnnnnnnnnnnnntggtcgannnnnnnnnnnnnnnnnnnnnnnnagt

SEQ ID NO: 9696 - DNA, 927 bp, Diabrotica virgifera
  misc_feature (41)..(66): n is a, c, g, or t
  misc_feature (441)..(458): n is a, c, g, or t
  misc_feature (463)..(480): n is a, c, g, or t
  misc_feature (837)..(837): n is a, c, g, or t
  misc_feature (842)..(843): n is a, c, g, or t
  misc_feature (856)..(856): n is a, c, g, or t
tttatgtaacagcatactgcgaaacgctcccatggtctgcnnnnnnnnnnnnnnnnnnnnnnnnnnctttctatttttgtagagggccccacagaccttgccgcttcccgcgtttctatcgctatcgttttctatctgttcagtctcccttctccaaagccctgtctgtcataacgctctggataccaaattgctggtcttcctcgttttcttctatgccgtggtacatagtttaatacctttttttagccagtgatctgccaccattctcataacgtgctcataccacaataatatactcgatcaataaaaaaagtgaagaccgaaaataaatcatgcaatatttgatatataaatatttgatatcacaaattttagatatttcaattcattacaaacacgtcaatgtatggctggtatttatgttccctgcattactannnnnnnnnnnnnnnnnncattnnnnnnnnnnnnnnnnnntgtggcggtatacttgccataaaattattgcaggaaaccttaatcttaagcttgttacaaattcatttgtgtttgaatggtgtggttaagtttactgtacaggtagaaattaataaatgttaatctattgtccctttaattattatacctgctattcagtctgtaggtttacctctcgaaacttaaggatgccatttagatacaagtgactttgttacaggattaagatacggttttcttcaatttgatggaaagtatacttgtattactaactttgccttcgtcaacaagccgactggctgcagtacgaccggtttataacagacgaattccaggaaaaaaaactttaccttcccnacatnnatatttaatgtcnaatttaatggtagaaaatctattttttaaaaacccttgaatgtgtaatggttcctttgtaaaaagctttac

SEQ ID NO: 9697 - DNA, 966 bp, Diabrotica virgifera
cgaatcggcaaagtttgagcgcggaacttttaaaaatagaacgcttttttcaaccgactcccgcaaagggataagtcagtgtcgatagcaattttttaacgtttttatttgtttggtgtaggtacttgttgctttttatgatcggtttcgaaatggataagtttaagtttgttctgacagttggatttttgagctgcgcctattctaccattgtgataaaggacatgacagttcctcaatcaattgaactaaacagtactgtggaccatgccgactttgactgcaattatgaagcagtgaatgaatctgatatagaagttaaatggttctttaatggtgatgttgaacaagtttatcaatggcttccaggatacaataccacaggttatggaatgaattcgcttcgagataagctggatatagagtataaggcaacaaacgatagcgatacggagtaccgaggatttcgaataaaacatattggaagagaattgacagggaattatacttgtaaagtcagcagcgacacccacgaagcatacgatacaaggcaaatggttatttatacccctgttgaatccgaattggatctcgtattactcagcagtgatgccttagtcaaatgtatggcaagtggaatttcacctatgccagaagttgacttttctcttctaagcgaaaatgggaccaaaatcgaccttaccgaaactgtcgagatggacgacgacagtgagggatattataacataactgcaactcacaattttgcatcgtacaaccatactttaacaggtcccactaaattcatttgtaatgttagcattccgggcacttcgtacttcttgactaaggaaataactcaccagggaagtactgcttcactaatcccgggtttcagcatcacttttcattctacttatatcattgttactgatgcttgactaagttttaaggattttttttttt

SEQ ID NO: 9698 - DNA, 897 bp, Diabrotica virgifera
  misc_feature (27)..(48): n is a, c, g, or t
  misc_feature (194)..(206): n is a, c, g, or t
  misc_feature (208)..(220): n is a, c, g, or t
  misc_feature (305)..(332): n is a, c, g, or t
  misc_feature (704)..(704): n is a, c, g, or t
  misc_feature (814)..(814): n is a, c, g, or t
  misc_feature (817)..(818): n is a, c, g, or t
agtgtatgtaagtaatgttttctttgnnnnnnnnnnnnnnnnnnnnnntataatcataatatatcaattaaatgcgaaaactgtaatttttattttccatcacaaaggtatttaaatgaaattacaaaatgtatttcaaaacaagctacacacatttaatattatggtcaaaatttagtattgatttaattaannnnnnnnnnnnngnnnnnnnnnnnnncttttctgtttaggtttacttcattataagtgtacgtgtacgaagagtttgacaaaagttttacgttgtgtaaaatgttgtttannnnnnnnnnnnnnnnnnnnnnnnnnnnttttttaattgccggatgcgccaggtaacaaaatctcgagtgttgatttagcatacatttcaaaacagatagctgtaatttgtgttgcataagttgcattctttagcgttgacgtgttgggaaaggataggctattcagccaacaatgcaatgacaggtatcttaatttttagggttatgtgattttcgactgaaaagtaattttcttttctcggtctgtatttatggaatgaattattgaaataaacgaaaaatatggcagataaagttccaataaaattagggggaacagattacacccaagtgttcattgcagtttttgtcatagttataactttgggtatgtaccaacatatggatatgttttattanaatttatgacaaaggtagccactaagatattgtatggttactgttgaataaatatacataatgtaaccttctctttactaaattttcttttagttctaattgctctttancannagaagaagagttctcgccagggaatacttttaactggtatctgtgacagtggaaaaactttatattttccccactaatt

SEQ ID NO: 9699 - DNA, 940 bp, Diabrotica virgifera
cgacgcgcaagaactcaagctgcgcaagctccgggcgcttaggggacaagtcgaccaacacaagcagaacaacatttctctcacaagtgaccttgattcaatacgagcccttttcaatgaaaaggagaaggagctatctctggctgtggccaaagtggaggagttaactagacagttggaggaattaaggagaggacggtcgaacaaaaactcgccaccaccttctgccttagaattggataaactccgaagggagctcatgtatcgaaacaaattaaacgagcaacaaaatcaaaggctacaccaacaacgggaggctttaacggcgagacaggaggagatgagtgcaatcgacaaacgaatatcagagcttcaagagcgactgcaccggaaacggatgctaaatcagcaattagccaatcagataagcgctacgtcacacaaggcggcgtaccaccagttagtaaggttgactggaaatcaagatcagaccaaccaagcggcttttgcgaggaaacaccagcaaaacaatgatcggaaaggcttatcgagaggcaatattgctgctgtcgagccgtataaccatatccccgtccaacctcaacctactcatcaaattaacaatataaatactcatcctgatattaagttacagagcacctatgacccttatcaaccagtatactatatgaagaaggaccaagactcccccaaatcgaacttggagtcccaagacgtgggaagcaaattaccaaacctgtatcctcccaaaaccgacgaaaatgagcttcacaaagatttcccggcgtcgaaaacggaccccaaatatcaaacgcttccttacaatacgaagttcacggtgaacctcatcatgaaacacgcgaataagccgaacaaagaggaaatctcaaaaacaacgaagacaaatagacgctactaa

SEQ ID NO: 9700 - DNA, 114 bp, Diabrotica virgifera
  misc_feature (72)..(95): n is a, c, g, or t
cacccgccggcccgctcatcgctagtttttttttaatctccctcaccatgtctgacgaagaagagtttactnnnnnnnnnnnnnnnnnnnnnnnntcgttgaaacgactaccac

SEQ ID NO: 9701 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9702 - DNA, 233 bp, Diabrotica virgifera
  misc_feature (29)..(56): n is a, c, g, or t
  misc_feature (93)..(115): n is a, c, g, or t
  misc_feature (190)..(222): n is a, c, g, or t
ccctaggggataaacagcttaatttttannnnnnnnnnnnnnnnnnnnnnnnnnnntgcgacctcgatgttggattaaaggttaataattggnnnnnnnnnnnnnnnnnnnnnnntgtttcgacttttaaaattttacatgaatctgaagtttaaaccgggtggggaagccagggttgggtttcttatcnnnnnnnnnnnnnnnnnnnnnnnnnnnnnnnnnccaaaagggac

SEQ ID NO: 9703 - DNA, 319 bp, Diabrotica virgifera
cccccctcccgtccgatcttttgcaaaactataaacaaatcttttacgaaatctgatcgaaacactttattcaaggatcgtgagctacaatcgcgcccgatcaattaatttcaattacagacaagtttctttgttggccctcggcactcacggctacataacttcataatactatttcccagccacctcacgaatctataaacaccctaacgacttccgctctctgatgggagaaacctccactccgaggacgtctcatggcaagaggcggccttcgactcaagatatctccagatctacacgagatccaccaactata

SEQ ID NO: 9704 - DNA, 896 bp, Diabrotica virgifera
  misc_feature (169)..(190): n is a, c, g, or t
  misc_feature (502)..(520): n is a, c, g, or t
cgcctgtgtaaaactaaatttagtacaaaaaattgattctctaaaatcgcagtgtgatgacaaggaaaattttgtcaaaaataatattgaagtttttgaagggacaggcaaagttccttttcaatataaaataatgcttaaaaatgattataaaccatatataagttcnnnnnnnnnnnnnnnnnnnnnngtaaaaccattgttaaaaaatacattagaagacttagaacgtagagacataatttgtaggttggatgaaccaacggagtgggttaacaacattgtaattgttgagaagcctaataaaagtcttagaatttgcttagatccaatgcatttaaataacaacatatgtaccgagcaatttcctatacccactgtggatgagttgtcattgaagttacaaggtaagtcaatatttacagtattagacttgaaagagggtttttatcatgtccctcttgacaaggaaagtatgaattacactgcttttatcacaccnnnnnnnnnnnnnnnnnnnaagaggttagcatttggtttaaatattagtccacaagtatttcaacgtataaatgaaaagatttttggagatttaaatattgggatatattttgatgatcttattattccagcatctgatgaggaaacacatgatttaattttgtcaaaagtgttgcaaagagcaaagaaatttggagtaaaatttaacaaaaataaaattcaatataaagtaagggaagtaaaatatgtaggtcaaatattttcaagagaaggggtaaaaccagatccttcctatgttgaagccgtcttaaaatacaagatccgactaataaaaagagttattaagaataattggtatgattattacctaactaaatacattccaattttgtctc

SEQ ID NO: 9705 - DNA, 938 bp, Diabrotica virgifera
  misc_feature (9)..(41): n is a, c, g, or t
  misc_feature (45)..(613): n is a, c, g, or t
  misc_feature (615)..(929): n is a, c, g, or t
ttacgtccnnnnnnnnnnnnnnnnnnnnnnnnnnnnnnnnncctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataatt

SEQ ID NO: 9706 - DNA, 905 bp, Diabrotica virgifera
  misc_feature (2)..(44): n is a, c, g, or t
  misc_feature (52)..(739): n is a, c, g, or t
  misc_feature (743)..(861): n is a, c, g, or t
  misc_feature (863)..(893): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnntaattttttgat

SEQ ID NO: 9707 - DNA, 417 bp, Diabrotica virgifera
  misc_feature (2)..(340): n is a, c, g, or t
  misc_feature (349)..(349): n is a, c, g, or t
  misc_feature (353)..(353): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatccnattnttttgattataagaaataattacctttagggatacagcgtaattttattggagaagtcaaatcg

SEQ ID NO: 9708 - DNA, 993 bp, Diabrotica virgifera
  misc_feature (50)..(992): n is a, c, g, or t
gcctctgaggtacttttaaccggtagtgtacaaaaaacatattcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9709 - DNA, 967 bp, Diabrotica virgifera
  misc_feature (14)..(34): n is a, c, g, or t
  misc_feature (396)..(414): n is a, c, g, or t
  misc_feature (844)..(844): n is a, c, g, or t
  misc_feature (909)..(909): n is a, c, g, or t
cccatctttcagcnnnnnnnnnnnnnnnnnnnnngccgccagaatgctttcctgaaacctgaaatatgctttctttcctgaaataggagtgttgagtattgcagcctgaagtattaaaccgctgcagccattgtggctcgttaggggaggaaggaaaacatttatttttggcttagacatgtagtaattaatgagcaaaaaatgcgtacttggttttagctctttaaactggttattttcactttttgtgaattccggggaatgatgatagcggtaggggttgaaggggtgagtttgtaaattcttgtaaactcaatctttcagcaattgattagcaataaaatatgccgccggaagctaccctatatctactttcgttccggaaatatgaatgtnnnnnnnnnnnnnnnnnnnttaagctaaaatggccacctgtttctctgaaggggttgaagcaataaatttttgttttgcgtaataaattagcaattaattagtaataaaataggccaccggaagaaactctctatctactttcgttccggatatatgaatgttggcctttctagcttaatattaagctggaatggccacctgtttttctgaaggggatgaagcaataaatttttgttttgcgtaataaattagcaattaactagcaataaaataggccaccggaagcaactctctatctactttcgttccggatatatgaatgttggcctttctagcttaatattaagctggaatggccacctgtttctctgaaggggatgaagcaataaatttttgttttacgtaataaattagcaattaattagcaatgaaataggctaccggaatncactctctatctactttcgttccggatatatgaatgttggcctttctagcttatattaagctggnaatggcaccctgttctctgaaggggatgaaagcataaatttgtgttttgcataataaa

SEQ ID NO: 9710 - DNA, 845 bp, Diabrotica virgifera
  misc_feature (16)..(45): n is a, c, g, or t
  misc_feature (49)..(713): n is a, c, g, or t
  misc_feature (715)..(743): n is a, c, g, or t
  misc_feature (746)..(780): n is a, c, g, or t
  misc_feature (783)..(800): n is a, c, g, or t
  misc_feature (803)..(832): n is a, c, g, or t
tcctacctcgtccgtnnnnnnnnnnnnnnnnnnnnnnnnnnnnnncatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnncannnnnnnnnnnnnnnnnnnnnnnnnnnnnnnnnnngannnnnnnnnnnnnnnnnnggnnnnnnnnnnnnnnnnnnnnnnnnnnnnnngatatttttgatc

SEQ ID NO: 9711 - DNA, 812 bp, Diabrotica virgifera
  misc_feature (27)..(61): n is a, c, g, or t
  misc_feature (77)..(96): n is a, c, g, or t
  misc_feature (98)..(178): n is a, c, g, or t
  misc_feature (192)..(303): n is a, c, g, or t
  misc_feature (305)..(555): n is a, c, g, or t
  misc_feature (570)..(608): n is a, c, g, or t
  misc_feature (614)..(682): n is a, c, g, or t
  misc_feature (691)..(709): n is a, c, g, or t
  misc_feature (711)..(809): n is a, c, g, or t
gatagttaatcagtatcctgagagaannnnnnnnnnnnnnnnnnnnnnnnnnnnnnnnnnngtacctccggtatcannnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnntaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacagnnnnnnnnnnnnnnnnnnnnnnnnnnnnnnnnnnnnnnngattannnnnnnnnnnnnnnnnnnnnnnnnnnnnnnnnnnnnnnnnnnnnnnnnnnnnnnnnnnnnnnnnnnnngaatggaannnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntag

SEQ ID NO: 9712 - DNA, 700 bp, Diabrotica virgifera
cgccgcccggttaatgagcgagaactagcgtgggaaaatatatcggagggtagtaggacgtatatcaatggcaataaattacttgcgattttaagtatcccattcataaggcatccagcaagccacctgcggcttatagcgccattaccggctataccatgcgacggggtaatagatcgttgtcgcagaagaccaaactccattacataaaaatcgtggagctaaaagatatactgaatgaaaatattggttgtctcatcatgaatttaccaagaaacttccccatgaagaatccaaaatgactacctgagatggtgtccattcataggaggaggatttatgccaccgatcgcacgaaactacgatgtaaggtccatagaaccttatgactgaagacatgaatctcgaaagcatcactgaccgagttggtctactgggtattattaggatacaagacgattcactggacggtcctggatatgcaggactaaaagattaagtactgactttaatgtgggcctgctaatcatatgaatttcaatggagatcccatgacgttagcatatttggacaaagtgcgggagggagctctgttggtggtttgctgttatcttcttacagtccaaggattatttcatcaagtcatagttcagagagattcgacttttaattcataggtatcagaaaaactcgacatgcc

SEQ ID NO: 9713 - DNA, 968 bp, Diabrotica virgifera
  misc_feature (26)..(43): n is a, c, g, or t
  misc_feature (871)..(871): n is a, c, g, or t
gcgaaggttatgatatctgtcacaannnnnnnnnnnnnnnnnntgatttacagctttctgatacattacaaagatatttttccgatgttttcttgtgttgtgatgaagataattccggtaaagcatcattagctaagacagtcgaacttattcaatcagggagtgtacctgaggatgtcatttcgcaaatttcagacatttgttggacactaggcaccaattatctcaacaaaaaacaattcttttctgcattaaagcttgtagcagcctatcaggctaatattcctatcaggagtgaggttttaacttcaaaagttgaactacctttgccccgtttcacatggactgttatagacaacaagagccccataggagatttgattgaacttagaaatgagccaaatgattattctgaacatgtcgatactagtacagattcagaaatagagagtgagactgttaaaaatggatccccagatgcttctagcgccacatccgatagtcccacaccaactaatagtgtccaagataggagttggttagtgtcgggagtgtggcatggactgatttcagaagaacaaagacaattactaggtactgaagaagaatcgtcagagaaacatagtagcgaagatgacacagaagtttctagcgaagtttggactataaccaatgaacaaagagaatactatacaaatcaatttagatccctccaacctgacaccaatgccttattagctggtcccgtagctcgaacttttttcgagagatcccgcctacccatacacgaacttcggaaatatggcagcttgcggacgtaaccaaagatggcgctctatcgttgcatgaatttacacagcatgcatctggntgtgttagaaagaccacattgactaccctgatgtcttccaccactctcgtacctgaaacaaactcctttgtctgtgagtcagaaactgaacctatac

SEQ ID NO: 9714 - DNA, 188 bp, Diabrotica virgifera
  misc_feature (119)..(148): n is a, c, g, or t
attttatccaatcaataaaatattattttgaagattactatccattgtaatttttttaacatgaattggagcacgaccagtcgaagacccatatattttaactggacaaattttaactnnnnnnnnnnnnnnnnnnnnnnnnnnnnnnccattaataagaaaatgatgagattcaattatttttaatt

SEQ ID NO: 9715 - DNA, 202 bp, Diabrotica virgifera
  misc_feature (4)..(65): n is a, c, g, or t
  misc_feature (68)..(100): n is a, c, g, or t
gggnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnntaaaggaaaaacaggcgtaatttttattgggaaaggttcaaattcaataataaaaaattggcgacccttgatttttgggatttaaaatttttttacttgggg

SEQ ID NO: 9716 - DNA, 81 bp, Diabrotica virgifera
  misc_feature (4)..(54): n is a, c, g, or t
  misc_feature (60)..(60): n is a, c, g, or t
ttgnnnnnnnnnnnnnnnnnnnnnnnnnnnnnnnnnnnnnnnnnnnnnnnnnnntaattnttttgatcccaattttttttg

SEQ ID NO: 9717 - DNA, 168 bp, Diabrotica virgifera
  misc_feature (3)..(27): n is a, c, g, or t
acnnnnnnnnnnnnnnnnnnnnnnnnngaacgaacgaatcgctatcgatcgggagtatcgatttctttacgaattttacgcatacgtatacgcaaacaagttttttcgtgcggaattttttttgtcattttttgcgggttttattttttttacttaacgaaaaatttt

SEQ ID NO: 9718 - DNA, 286 bp, Diabrotica virgifera
  misc_feature (41)..(86): n is a, c, g, or t
agatcaaggttcagtttatatagaagtagaaatgggttacnnnnnnnnnnnnnnnnnnnnnnnnnnnnnnnnnnnnnnnnnnnnnnggatttaaatgtaatattaattaattagttaatatgattttggctctaaggtatgtacatattgcccgtcgctttcatttaatatgaaataagtcgtaacaaagtagatttactggaaagtgaatctagattatcaaattagagcttgatagaagtattttagttacattaaaaagttaattgtgaaattcaatttaatt

SEQ ID NO: 9719 - DNA, 879 bp, Diabrotica virgifera
  misc_feature (785)..(785): n is a, c, g, or t
  misc_feature (822)..(822): n is a, c, g, or t
aacaaaacaaaacaaagataaaataagaactataagaagtagtgtcatgtagtgtttacttttcaaatgtatctattattttaagacatacacttaatacctaatatttcagcgttgtgacaaggtagtataaggatgtattacttttcattattcttgctatttaacatattatggataatagcaacatgttcagtaattaatcaccgggaagtatcaaactctatagtggacgaaaaagcatgccaagatgttgcaattatttgtcacaacttaagtgagaaagacgatttacttattctcgaatgtttattatcctcaaatccacaccaagttaatcgtttaaatagagaatgcatgaatattgtatggggtagagtgaataacctcaccagttccagtggtgtaaaagaacgcctgttgccggaatgcggcaaggaattagataagttgcagtgccaagaaaataattatttacaatgtatagtgaaaaatgtaaataatatacaagatcaaaattgttataataccataaatcgcctagaaagcatcgcctttactgactacaagtggataacagactttttacatgaatgtgctcaagatattaacaaatttcaatgtggaattatcgatggagacaacttttcgcaaatcagaacagtagaatgtttgcaaaataaaattgtagaagtctcggaagaatgtaggaaggaagtgtttcatttatcagaattgcaatcaaataatattaaacttgatgctcagttatatttggaatgtanggaggactaccagagatattgttcccaatttaagaangtacaggaagagtatttccctgtttattaagcagcttcatttggatgattcaaaatt

SEQ ID NO: 9720 - DNA, 813 bp, Diabrotica virgifera
agctcatgaggtgcgactatcggaggaaagaatttcgggaggccccaagacacatcttcgagggacaacaatgtcgttcctcttgatgtatcccatagcaacaagcatcgcagcaaagctagccatacggccttaagaggaccattcacctgcgtcaaccatgcccacgggcgaaaagaacccatcgcataagacgagactcgcattccaatagagaacattgatactgaaagaatatactgtgagaacaagattgcttgacgcatcctgtatttacaaataaaacttccccactgaagaatcccaactgaagccagggatggtgaacattcatggatgacgccttatactatgatctcccggaactaccataaaagcacccaaacatcctctgagtgaatacacacaaccccaaagcatcactaaacaaatggccctactgatgtttaataccatcaacaacccctccatggatgtacccgtcaaatgccggactctcctagcacgcttcgggtcttaccactggtacagcattgcatctccagatatcggtggcacatcacaccaaccctacctatcataaggaaaactcttccccacggcatccgccgaatggacgcggccatctccgacttgaccgactacctcctgaagattcttacttgaaagaggttactacttcaccaccaccgactcaagggaactcgcccgcgacttcaaatactgactctgctatgccaccctcgacttctaacatgaaacggtcaccgctgctgcttccacctcccgctaagagagctacacaatcgcctg

SEQ ID NO: 9721 - DNA, 375 bp, Diabrotica virgifera
gttccatgccgggtccccccgcggcgggcttgggttaagctgaataggtcaggttcatgaatgtcgatgatagaatgtctatagtgatagatcatcggtgatgtaaagaaacacgtagaagcatagcaggcgaccctgcgataatatggccagaagacggcaatacggagtcaacgggggtggaggttgcggaagagaccgagacctgcttactggtcgggcgtaactcgggtagtgtgtggaagaaatggcatactcctctgaattaccgataatggtaccctgctgaaacctccgatagccactgagaccgttccaacgctgagtaacgatgatacaacgtctcaactcagctacttaaaaaagtggaaagaa

SEQ ID NO: 9722 - DNA, 73 bp, Diabrotica virgifera
  misc_feature (2)..(42): n is a, c, g, or t
  misc_feature (47)..(71): n is a, c, g, or t
gnnnnnnnnnnnnnnnnnnnnnnnnnnnnnnnnnnnnnnnnntattnnnnnnnnnnnnnnnnnnnnnnnnnat

SEQ ID NO: 9723 - DNA, 208 bp, Diabrotica virgifera
  misc_feature (160)..(202): n is a, c, g, or t
taaattaccttaggataacacgaattttattggaaagttcaatcgataataaagatgcgacctcaatggtggattaaggtatatttggggaacagcttattatatagctggttcactttaaaaattttcatgatttgagttaaaccgggggggacccagnnnnnnnnnnnnnnnnnnnnnnnnnnnnnnnnnnnnnnnnnnnggaccc

SEQ ID NO: 9724 - DNA, 862 bp, Diabrotica virgifera
  misc_feature (83)..(104): n is a, c, g, or t
  misc_feature (489)..(515): n is a, c, g, or t
  misc_feature (551)..(573): n is a, c, g, or t
gcagcgcaaagttaagatctagccgttctttctatttttgaatctgtgcttctgaactttttcttccattaaaaaaaccgcannnnnnnnnnnnnnnnnnnnnnttgttggcatgtgttgctgtatttaatgccgtaagcgcacttgattgctacacttgcaccgacgatgcctgcaaaaaagatataaaagaaatgcaaaaagttacgtacggtaaacccgctgaccaaaatcaagaatccgtttgccaaaaagtaacatacaaaggcaaggatggcaaggaacacatcgaaagaaaatgtgcctatgctcccaagaacggagaggctcagtgtcccgcatccataaacaaagctgatgtaactgacctaaaatgcccatcctgtaaagctgatctttgcaactcagctaccaccatcaacttcagcctaacagcattcgctgcagtagtttttgccatcgtaggccaaaaattcttaatgtaaaacnnnnnnnnnnnnnnnnnnnnnnnnnnntacatgccacttttcttccgaacgagcgaatgtgtnnnnnnnnnnnnnnnnnnnnnnngtgtttaagaactaaaaattgtaacgtttttgataaatgtgtatggtgtattaaaatgttgttttgctactatatttgtccgaaattattcataatgatatgaagtagctacttaaaaaaaccacatacgcatagaaattgctttacttgtaagacctattacgtgaattaagattttgtaagatgaaaaataagtatgtagaaggaatttgtattacctcaggtcatttttcaacgagatatttttctttgtaaataaagtttttaatattacagctgatgaattcat

SEQ ID NO: 9725 - DNA, 542 bp, Diabrotica virgifera
  misc_feature (2)..(343): n is a, c, g, or t
  misc_feature (350)..(373): n is a, c, g, or t
  misc_feature (407)..(420): n is a, c, g, or t
  misc_feature (423)..(445): n is a, c, g, or t
  misc_feature (453)..(475): n is a, c, g, or t
  misc_feature (505)..(536): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcgatgataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9726 - DNA, 604 bp, Diabrotica virgifera
  misc_feature (2)..(537): n is a, c, g, or t
  misc_feature (546)..(546): n is a, c, g, or t
  misc_feature (555)..(555): n is a, c, g, or t
  misc_feature (557)..(589): n is a, c, g, or t
  misc_feature (597)..(597): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttataanattattaantnnnnnnnnnnnnnnnnnnnnnnnnnnnnnnnnnaaattatntaaattg

SEQ ID NO: 9727 - DNA, 384 bp, Diabrotica virgifera
  misc_feature (279)..(298): n is a, c, g, or t
aattattttcaaaagaatataaatactatgtagagtccaaaaagggaacatgaagctacaattggaaatactgttgcatgttcccttttattactaacctaactatctttacgtagattgaccatactgtctaccatgcggttatgacagaaatgctagcttcggcaaatgaagatgtacttgctaaaaaaaaatctcctcgcattaggaaaatacattcacccgaggggtttattgcccaagtgactattcactgttcaccatctctactactatacnnnnnnnnnnnnnnnnnnnngaattcagtatatatatcctgtgatagaactatgtaactttttctcaaaatctcctacataaaaaacacaatggatcattatctcc

SEQ ID NO: 9728 - DNA, 811 bp, Diabrotica virgifera
ccccccttcaaggccggctcgcgagcgaccgcccgcggccgacctctctttcaaaaatcgccactgcaacaagagcacacaaagcattttttaaactacaaatatacaactttaacttgatattttctatataataaaactgtctaccaaaatggccgctactctaatgcagaatttcaaaacaacttgatataattcaataggcgaaagagtttccctgcataaagtagagatattgttataaaatacaggcgaagaccagctcaaactgattgggcaaaaaacctgctacttttgagattacttagaaccatttgttaattacagattgattggcctaattttttaaaccgaaaattgctgatacgggtatttatataatttttggcccagtccgtgacattctttgaacatttcccctcgttcttatcttatactgcactttatgtagataaccacccgctttgtatgaactaaaaacataagcattggttcaccatccacagatcgctaacagtttatacataaaaaatcattttgtgacgcttcgtgagaattcctaagtgtttcacgatgagacaaccaatccccgacttgcgaggcacgtatttttacgtagccttaccatttcccagtagacgccgagagcggaacttctgaccctgcctccctcgatgtacttcgaggtacgctaaaaaatcccagacagcaattatcccattcccacaaatttgcagaatgtcgtaccaagcttcggtttctccaatactcatttcataaaaactaaccttgcgacttccagcaaggcaca

SEQ ID NO: 9729 - DNA, 603 bp, Diabrotica virgifera
ctttgaaattaaggatgtcaaaacattaaagggagaccaccagtctagagctataggaagacttgctggaaaaggaggaagaactaaattcacaatagaaaattggttaaaaatattcacacctgtagttgagcacttgcaactccaaatccgatttaatttaaaaaccagaaacgtagaaattagggcatgtaaggaaaccccagatatttctaatttacaaaaagctgcagatttcgttaaagcttttatttatggttttgaagttgaagatgcccttgccttaattcgtctagatgatctgtttgtggaaacctttgaaattaaggatgtcaaaacattaaagggagaccaccagtctagagctataggaagacttgctggaaaaggaggaagaactaaattcacaatagaaaatgttacaaaaactagaatagtattagcagatagcaaaattcacattttaggtagctttcaaaatatagccctggcaagaagggcagtatgtaatctaattttaggttcacctccttctaaagtttatggacaattaagaaatgttgcatctagggtatctgaaagaatgtgaataaatgatttatt

SEQ ID NO: 9730 - DNA, 955 bp, Diabrotica virgifera
  misc_feature (259)..(276): n is a, c, g, or t
  misc_feature (876)..(876): n is a, c, g, or t
ctgaccattgacatattaagcgtagactcgacatactcaccaaaaaagcgtaacgcggaaacagcatggaaacagtcgatcggtggtctatctatctcttttagccaaacaatcccgcgcatgtgactgacaaagatggctagaccactcaatcatatgtcgacgttacaccccgatgcatgagtggcatatccctagccaagtctgtccttttacatgtctctgagactgacacctgaacaacacttccaaattatgnnnnnnnnnnnnnnnnnncatgcttctgttcgaaatacgtatcgcgcactacgtccattttatggtcaacatatcgttaattcgattaaccatggaatgtttccgtaccacgtttactctaaatgctaatacacttccatacagacgtcgtacagtgcgtacagaagaagttgttgctgctgtagagcgtagcgtagagcaagacccgaatcagtctaccctccatcctgtacagcagttggatacgtgtccatccactgtatggaaaactttgcggaaagatcttggtttgcgttcttacaaaatcaactcgtgtaagaattgatactacacgattacctagcaaggcgtagattcggtgaaagggcccaaaacgagattgccgtttatccctattttaaaagcgaattttgtttggcgatgaaactcaatttttgttgaagggctacgtcaataaacaaaattgccgtacttggaatgaaaataattctcaagtgtatgttgagacaccaaacatgactgtttggtgtgttccgtacttcttcaaaaacgatgctggccagaaagctacagtcaatggtgaccgttatagagccatgattaggcctactactgacnttttcattcctcaattgaatcaccatgatgtgcaggagctgtggtttcacaaaatgacgcacatgtaacacagctcatg

SEQ ID NO: 9731 - DNA, 675 bp, Diabrotica virgifera
  misc_feature (177)..(191): n is a, c, g, or t
  misc_feature (558)..(558): n is a, c, g, or t
  misc_feature (650)..(650): n is a, c, g, or t
ataaggggtgctttaagacatccttggttggaaagagccgataagaagtatacagatgagttccaaattagatctaagtatcttagtgactactggaggctctacagagaatggtacgacaacgcctcatgtagaaggtggttcaggcgtagacctctcgaaggagctttcactcannnnnnnnnnnnnnnatatccaccaggtgactacgattcgcccagaggcactccagcacctctagataaaacaccaagagttccaagaacttgggaagaccagttgcctactaggtcacctcttaactatgaaattggtgttattaaatcagagagtcattaccaaaatggtccagacacatatttgcttcaactaagagatgttgacttcccagtgcgtcttcgtgaatatatgaaagttgctgctattcgcggtccaggatccggttatatcctctcagacgaaaatggatacgattggggaacacctattattcgagaacgacgaagatttactgacattatggatgaggaaattgatgacgaaaggaaagctcgcatncacagatacggctccgttgaaagagaacccgacaccagaagaattagacacgaattgggatcacgtttagatgcatacgtggaagctgaggncttccttgagctaacaagaaagacg

SEQ ID NO: 9732 - DNA, 225 bp, Diabrotica virgifera
  misc_feature (137)..(161): n is a, c, g, or t
  misc_feature (187)..(224): n is a, c, g, or t
tcttataacaccttataagatcttaaaagtctgtatatttacttactataactattttgaaactgggcaggaaaataaatcctatctagtactaaacctgcctattatttcgattaagaacgagaatatgatgtaannnnnnnnnnnnnnnnnnnnnnnnngcatagtttatataccatatacaatnnnnnnnnnnnnnnnnnnnnnnnnnnnnnnnnnnnnnna

SEQ ID NO: 9733 - DNA, 700 bp, Diabrotica virgifera
  misc_feature (189)..(209): n is a, c, g, or t
  misc_feature (288)..(307): n is a, c, g, or t
  misc_feature (372)..(420): n is a, c, g, or t
  misc_feature (560)..(580): n is a, c, g, or t
ttggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 9734 - DNA, 233 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(191): n is a, c, g, or t
  misc_feature (198)..(230): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagcccaggtggttnnnnnnnnnnnnnnnnnnnnnnnnnnnnnnngaaaggnnnnnnnnnnnnnnnnnnnnnnnnnnnnnnnnngat

SEQ ID NO: 9735 - DNA, 934 bp, Diabrotica virgifera
  misc_feature (225)..(245): n is a, c, g, or t
  misc_feature (840)..(840): n is a, c, g, or t
gaaatttcttttcgtgccgccagcgataaaattagaaaatacttttaccatcacggggcttgcgcgccgccatggatttccgttatcgaacgaaataccagtcagttttggtcagagactcatgaagtgcgtatagtgtgcagcaaaatttttttttcaagcggcgaaggtctagaatccatcaaatatacgccctttaaatggaataaagacatcctaaatacnnnnnnnnnnnnnnnnnnnnngtttaaagcaacagtaacccaaagatatacaaattaatttaagtactaaaaccacaccgaaatggcgaccaattaacagccgtaagctgcacacagattctaggtaagctttagattatcatttcttattgaaaacagccgaaattcataatttatatcgtaattttgggatttagtttgcgaggagcaggagaatttcatgtagtttttatgtaaagcttccattttaaaatcatttcttgtccatttacttatcagttttttttttgattgaataaaaagataccaccggtttcaaagttttatcgcgcagatgcatgtgaacgcgcatgcttctttcaatgcttggactgacaaccactcagttcgtcacagatttaaacataacctaatgttttgtttgggagaaatcagtaatgttttgtttggtctggtacgggaaatctaaactgttgcaattactcatagaagcttttaaatattcattatgttactttgtagacttcgccgcatccgatagtccaaatccttggaatattgtatagcatcccaaggcaaattgttgaaagccttacctatatttgcataactgatncacaggacaccagtagcttggcttcctttcaacagccttcagacacttgaggatgtgtagtgctaagaggattcatcctaatagacctgtcgtc

SEQ ID NO: 9736 - DNA, 608 bp, Diabrotica virgifera
  misc_feature (2)..(91): n is a, c, g, or t
  misc_feature (93)..(159): n is a, c, g, or t
  misc_feature (161)..(174): n is a, c, g, or t
  misc_feature (176)..(198): n is a, c, g, or t
  misc_feature (584)..(602): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnncnnnnnnnnnnnnnngnnnnnnnnnnnnnnnnnnnnnnncctttatttgtttaaagaccagaagacccttagagtttctaaaacttataatagttttttacaaataatttcttccttataaacttctttaattgggggcggctcaacattcaattgacctttctttaattatactttacttatacttttttgcccccctttgttcccccccaccaaaaacttccccctgccacccccccccacccccccacgggaaaccgcttttttctcctacccccatctcctcccccggctcccccccccaaggttttaggcctgggcctccctttaaactccccgccgcctcgccccctccctttcgtcactattacccggcccgtaaactcctccaccaatccccaaactatttccccctttctctccannnnnnnnnnnnnnnnnnnttcctc

SEQ ID NO: 9737 - DNA, 714 bp, Diabrotica virgifera
  misc_feature (80)..(95): n is a, c, g, or t
  misc_feature (97)..(119): n is a, c, g, or t
  misc_feature (462)..(483): n is a, c, g, or t
  misc_feature (499)..(520): n is a, c, g, or t
acactcttttctccgtagtcatggattggaatatatttattctatacagaaaatttatttcctcggccttgtgtatcacnnnnnnnnnnnnnnnncnnnnnnnnnnnnnnnnnnnnnnnattaactacctcaacacttctcaattttattgtaagataactatttaaaataattcttatgtatggataccgctttcaatgacatatatatctaatttttttctactcaaatgacattgattgattacctacatttctgtcatcaaacatgtttacctcagtactatgcttctagttctcatggatgatcctaaatatactgccttcttgacttttaagtattagatagctgttaagatcaatcactttcatattgtaacacatggcatgatctcttaatatgtatgattattctaatatattatcaattttatattaaagtatatgtccgaataatacaccnnnnnnnnnnnnnnnnnnnnnntccattaactcattgnnnnnnnnnnnnnnnnnnnnnnggtctatcaaggtattcttcaacattttttactcctgttcattgatgacatgacattttgtattctacatctattctcacctgcccactgattgctttgaatgcccgcgatgttttgatcgagctaacgtagcataatcataaccatttatattcgaagctgcaatgaagggttgcatgaaaaattcactgact

SEQ ID NO: 9738 - DNA, 243 bp, Diabrotica virgifera
  misc_feature (16)..(16): n is a, c, g, or t
  misc_feature (41)..(41): n is a, c, g, or t
  misc_feature (101)..(118): n is a, c, g, or t
  misc_feature (134)..(153): n is a, c, g, or t
  misc_feature (197)..(233): n is a, c, g, or t
gaataaattaccttanggataacagcgtaatttttattggnagagtcaaatcgataataaagatgccgacctcgatgttggaataaagtttataatttggnnnnnnnnnnnnnnnnnntaagtctggttccacnnnnnnnnnnnnnnnnnnnntcttaggttaaaaacgggggggggggccagggttgggtttcttnnnnnnnnnnnnnnnnnnnnnnnnnnnnnnnnnnnnngaaaaagggc

SEQ ID NO: 9739 - DNA, 633 bp, Diabrotica virgifera
  misc_feature (2)..(18): n is a, c, g, or t
  misc_feature (20)..(632): n is a, c, g, or t
cnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9740 - DNA, 770 bp, Diabrotica virgifera
  misc_feature (401)..(419): n is a, c, g, or t
aatgttagtagtgtatcggtttttatttatgtagtactgttataaacaaaaaaggattacagtgaagtaacttattttttaattcattgatatagtaaaaatgaaaaacctcggaatttttgcagtgtttaccattctattagtttatacacgtgctgataatttggacgattttccattatgtaaagcatgtggctgtagcttcaactccaacaacactgaagctaatgtaacctgcacaaaacaaaatccgagccaactcctacaggattacttctggatcaaaaagggaaccaacaactcgataccgtataatcgtgttatgataaacaacgagaaatttattaacttcacttacgttttcccaagttctccattagtgtatttgaatttggcgtacnnnnnnnnnnnnnnnnnnnccgatagtattttcaagaacttgcaaaatatgcaggtgctcattcttagttataacgacttggaagtaatccatccggatacctttaagggtttatatttaccagagagactaatgcccttaaaaagtctcatagaattaagactggaccacaacaaactccatacactcaaccaagatacttttgatcatacaacggatattcaaatattggacttgagctataatccgcttgaagtaattgatcaccatactcttatagctatcaacgaattattatatctaagagaactgtatcttcaaaacaccgaaatcaaaacgctgcctgacaatatgttgcatacaccacaat
